United States Patent 11,931,406 (FLAVIVIRUS VACCINE) - sequence listing, part 57

SEQ ID NO: 20414 - RNA, 9873 nt, Artificial Sequence
  derived and/or modified CDS sequence (opt5) from DENV-3__FJ850086__SS-prME
acaagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucauguggggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcgccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccaaaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagaugcgcccuguaaaauuccuuucagcacagaggacggccaagggaaggcucauaacggaagacugaucaccgccaaucccguugugaccaagaaggaugagcccgucaacauugaagccgagccuccguucggcgaauccaauaucgugauugggaucggcgacaacgcucugaaaaucaauugguauaagaagggaucuagcauuggcaaaauguuugaggccaccgcuagaggggccagacgcauggcgauccuuggagauacggccugggacuucggcuccgucgggggaguucucaacagccugggcaagacaguccaccagauuuuugggucugcuuacaccgcccuguucuccggcgugagcugggugaugaaaaucggaauuggcguccuccugaccuggaucgggcuuaauucuaagaacacaagcauguccuuuucuugcauugcuaucggaaucauuacccuguaucucggcgccgugguucaggcggauauggggugugugaucaauuggaaaggaaaggaacugaagugcggcagcgggauuuucgucacaaacgaggugcauacguggaccgagcaguacaaauuucaagccgacucccccaagcggcuggcuacagccaucgcuggcgccugggaaaauggaguuuguggcauuagaagcaccacacgcauggagaaccuucucuggaaacagguggccaaugaacugaacuauauccugugggagaauaacaucaagcucaccgucgugguuggggauauuaucggagugcuggaacagggcaaacggacgcuuaccccucagcccauggagcugaaguacucuuggaaaacaugggggaaggcuaagauugucaccgcggagacacaaaacuccagcuucaucauugacggaccuaauacccccgaaugcccgucugccuccagagcuuggaacgugugggagguggaagacuauggcuuuggcgucuucacaaccaauaucuggcucaaacugcgcgagguuuacacgcagcugugugaucaccggcuuaugagcgccgccgugaaggacgaaagagcugugcacgccgauaugggguacuggaucgagucccagaaaaacggaucuuggaagcucgagaaagcgagccugauugaagucaagacaugcaccuggccuaagucccauacccuguggucuaauggcgugcucgagagcgacaugaucauucccaaaucccuggcugggccuaucagccagcacaaccaucgccccggauaucacacacaaaccgccggcccuuggcaccuugggaagcuggaacucgauuuuaauuacugcgagggaacgacaguugugauuaccgagaacuguggcacacggggccccucucugagaaccacaaccgucuccgggaaacugauccaugaauggugcugucgcagcugcacgcuuccgccucuccgguauaugggagaggacggcuguugguacgggauggaaaucagacccauuucugagaaggaagagaauauggugaaaucccugguuagcgccggaucuggcaagguggauaacuucaccauggggguccugugccucgcuauccuguuugaggaagugaugcggggaaaguucggcaaaaagcacaugauugccggcguuuucuuuauguucgugcuucugcucagcgggcagaucacauggcgcgacauggcgcauacccugauuaugaucggauccaaugcuagcgauagaaugggcaugggggucacauaucuggcccuuauugccaccuuuaaaauccagcccuuccuggcucucggauuuuuccugcggaagcucacgucuagagagaaccugcuucugggcguggggcucgccauggcuacaacccugcaacugccugaagacaucgagcagauggccaauggaauugcgcuuggccugauggcccucaaacugaucacacaguuugaaaccuaccagcucuggaccgcucugauuucccuuacauguagcaacacgauguucacccugacaguggccuggcgcaccgcuacacucauccuggccggcgucucccugcuuccgguuugccaaucuagcuccaugcggaagaccgauuggcugcccauggccguggcugcgaugggggugccuccccucccucuguuuauuuucucucucaaggacacgcugaaaagacgcagcuggccccuuaaugagggagucauggccgugggccugguuuccauccuggcuucuagccuccugagaaacgaugugccuauggccgggccccuugucgccggaggccugcucaucgcuuguuaugugauuacagggaccuccgccgaccugaccguugagaaggcggcugacaucacaugggaagaggaagccgagcagaccggagugagccacaaccucaugauuacagucgaugacgauggcacgaugcggaucaaagacgaugaaaccgagaauauucugacagugcuucugaagaccgcccugcucaucgucucuggcguguuuccguacuccaucccugcuacacugcuuguuuggcauaccuggcagaaacagacgcaacgcagcggggugcugugggacguccccucuccucccgagacccagaaggccgaacucgaggaaggaguguacagaauuaaacagcagggcaucuucgggaagacacaaguuggagugggcguccagaaggaggggguguuucacaccauguggcacgugacacggggagcgguucugaccuauaacggcaaacgccucgagccgaauugggcuuccgucaagaaagaucugauuagcuacggcgggggauggagacuuucugcccaguggcaaaagggcgaagagguccaggugaucgccgucgaaccugggaaaaaccccaagaauuuccagacaaugccuggaacguuccagaccacaaccggcgagauuggggcuaucgcccuggacuuuaagcccggaaccuccggcagccccauuaucaaccgggaaggcaaagugguugggcuguauggaaauggcguggucacaaagaacgggggauacguguccggcaucgcucaaacgaaugccgagccugaugggccgacccccgagcucgaagaggaaauguucaaaaagcgcaaccugacaauuauggaccuucauccuggcagcggaaaaaccagaaaguaucugcccgcgaucguucgggaggccauuaagcgcagacuccggacacugauccucgcuccuaccagaguggucgccgcugaaauggaggaggcccugaaaggccuucccauucgcuaccagacgacagccaccaagucugaacacaccgggcgggagaucguggaucugaugugccaugcuacauuuaccaugagacugcucagcccuguucgcgugccgaauuauaaccugaucauuauggacgaagcgcacuucacagaucccgccuccaucgcugcccggggauacauuucuaccagagucggcaugggggaggccgcugccaucuuuaugacggcgacaccucccggaaccgcugacgccuucccucagagcaaugcccccauucaggacgaggaacgcgauaucccggagcgguccuggaacucuggcaaugaauggaucacagacuuugcugggaaaaccgugugguucgugccuagcauuaaggccggcaacgauaucgcgaacugucuucgcaaaaauggaaagaaggucauucaacuguccagaaaaacguuugacaccgaguaccagaagacaaaacucaacgauugggacuucguugugaccacagauaucucugaaaugggcgccaauuuuaaggcugaccgggugauugaucccagacggugccugaaacccgucauccugaccgacgggccugagcgcgugauucucgccggacccaugccuguuacagcugccagcgcugcccagagacggggccgcguggggagaaacccgcagaaggagaaugaucaauauaucuucaccggacagccccuuaacaaugacgaagaccaugcgcacuggacggaggccaagaugcugcuggauaacaucaauacaccugaaggcauuauccccgcucucuucgagccugaacgggagaaauccgccgcuauugacggggaguacagacugaagggcgaaagccgcaaaaccuuugucgagcuuaugcggagaggagaucugcccguguggcucgcccacaagguugccucugaaggcaucaaauauaccgaccgcaaguggugcuucgaugggcagcggaacaaucagauucuggaggaaaacauggacguggagaucuggacaaaagagggagaaaagaagaaacugagaccgcgcuggcucgaugcucggaccuacuccgacccucuugcgcugaaggaguuuaaagauuucgccgcuggcagaaagagcaucgcccuggaccucgucacagaaauugggcgcgugcccucucaucuggcccacagaacgcggaaugcucuugauaaccuggucaugcuccauaccuccgagcacggaggccgcgccuauagacacgcgguggaggaacugccugagacaauggaaacccugcuccuucugggccugaugauccuccugacagggggagccaugcuuuuucugauuagcggcaaagggaucggaaagaccuccauuggccucaucuguguuaucgcuucuagcgggaugcuguggauggccgagauuccccugcaauggaucgcuuccgccauugugcucgaguucuuuaugauggugcuucugaucccugagcccgagaagcagcggacgccgcaggacaaucaacuggcguacgucguuauuggaauccucacccuggccgcuauuaucgccgcuaacgaaaugggccuucuggagacaaccaaacgcgaucucggcaugagcaaggaaccugggguggugucucccacauccuaucuggacgucgaccugcaucccgccagcgcuuggacccucuacgccguggcgacgacaguuaucaccccuaugcuuagacacacaauugaaaauucuaccgccaacgugagccuggcugccaucgcuaaccaggccgucgugcugaugggacucgauaaaggcuggccgauuuccaagauggaccugggggucccccuucuggcccucggaugcuacucucaggugaauccucugacccugacagcggcuguucuccuucugaucacgcauuaugccauuaucggccccgggcugcaggcuaaagccacccgggaagcccaaaagagaacagcugccggaaucaugaagaacccuaccguggauggcauuaugacaaucgaccucgaucccgucauuuacgacagcaaauucgagaagcagcugggccaggugaugcuucugguucucugugcggugcagcugcugcucaugcgcaccuccugggcccuuugcgaggcucugacgcuggccacagggccuaucaccacccucugggaaggaucuccgggcaaauuuuggaauacaaccauugcugucagcauggccaacaucuuccggggguccuaucuggcgggagccggccuugcuuuuagcaucaugaagucuguggggacaggaaaaagaggcacgggcucccaaggggagacccugggagaaaaguggaagaaaaagcucaaucagcugagccgcaaagaguucgaucuguacaagaaauccggcauuacagaaguggaccggaccgaggccaaggaggggcucaaaagaggagaaacaacccaccaugcuguuucucggggcagcgccaaacuucagugguuugucgagcgcaacauggugauccccgaagggagagugauugaucugggauguggccggggcgggugguccuauuacugcgcuggacugaagaaagucacggagguucgcggcuauaccaaagggggaccuggccacgaggaacccgugccuaugucuacauacggguggaauaucauuaaacucaugagcggaaaggacguguucuaccugcccccggagaaaugugauacccuucugugcgacaucggcgaauccagcccuucucccacagucgaggaauccagaaccauucgggugcucaagaugguugagcccuggcugaagaacaaucaguucuguaucaaaauccugaacccuuauaugcccacagugauugagcaccucgaacgccuucaaagaaagcauggcgggaugcugguccggaauccucugagccgcaacucuacccacgagauguacuggaucuccaauggaacgggcaacauuguggccagcguuaauauggugucuagacuccugcuuaaccgguuuacaaugacccauagacgcccgaccaucgaaaaagaugucgaccugggggcgggaacacggcacgugaacgccgagcccgaaacgccuaauauggacgugauuggcgagagaaucaagcgcaucaaagaggaacacaacagcaccuggcauuaugaugacgagaaucccuacaagacaugggcuuaucacggguccuacgaagucaaggccaccggaucugcuagcuccaugauuaacggcguugugaaacuccugacaaagccuugggaugugguccccauggugacccagauggccaugacagacaccacgccguucggccagcaacggguuuuuaaagagaagguggauaccagaacaccucgcagcaugcccgggacccggagagucaugggaaucacagccgaauggcuguggcgcacccucggccggaauaaaaagccuagacugugcacgcgcgaggaguucacaaagaaagugcggaccaacgcggcuaugggggccguuuuuacagaagagaaucagugggacuccgccaaggcugccguggaagaugaggacuucuggaaacuugucgauagagaacgcgagcugcauaagcucggaaaauguggcucuugcguguauaacaugauggggaagagagagaaaaagcugggcgaauuuggaaaggcuaaaggcagccgggccauuugguacauguggcuuggggcgcgcuaccuggaguucgaagcccucggauuucugaaugaggaccacugguucuccagagagaacucuuauagcggcguugaaggggagggacugcauaagcucggcuacauccugcgggauauuuccaaaauccccgggggcgcuauguaugccgacgacaccgcuggaugggauacgagaaucaccgaagacgaucuucacaaugaggaaaagauuacacagcagauggacccugagcaccggcaacuggccaacgcgaucuuuaaacucaccuaccagaauaagguggucaaggugcagcgccccacaccgaccggcacagucauggauauuaucucuagaaaagaccagcgggggagcggacaagugggcaccuaugggcugaacacguucacaaauauggaggcccagcuuauucgccagauggaaggagagggcguucuguccaaggcugaucucgaaaacccucaucugcccgagaaaaagaucacccaguggcuggaaaccaaagggguggagagacucaagcggauggccaucagcggcgacgauugcgucgugaagcccauugacgaucgcuuugcuaacgcccugcuugcucugaaugacaugggaaaagugagaaaggauaucccucaauggcagccgucuaaaggcuggcacgacuggcagcagguucccuucuguucccaucacuuccacgagcucauuaugaaggacgggcggaaacugguggucccuugccgcccccaagaugaacuuaucggacgggcccggauuagccagggcgcgggguggucucugcgcgagacagccugucucggaaaggcuuacgcccagauguggucccugauguauuuucauagacgggaccugcgccucgccagcaacgcuaucugcucugccgugccuguucacugggugcccaccuccagaacaacguggagcauucaugcgcaccaucaauggaugaccacagaagauaugcugaccgucuggaaucggguguggaucgaggacaacccuuggauggaagauaagacacccgucaccacgugggaggacgugccguaccuuggcaaaagagaggaucaguggugugggucccugaucggccucaccagccgcgcuacaugggcccagaauauuccuaccgccauccagcaaguucggucucugauuggaaacgaagaguuccuugacuacaugcccagcaugaagagauuucgcaaagaagaggaguccgaaggcgcuaucugguga

SEQ ID NO: 20415 - RNA, 9873 nt, Artificial Sequence
  derived and/or modified CDS sequence (opt5) from DENV-3__FJ850089__SS-prME
accagccugugccucaugaugauccugcccgccgcucuugccuuccaccugacaucccgggacggagagccucggaugauuguggggaagaacgaacgcggaaagucucuccuguuuaagacggcgagcggcaucaauauguguacccuuauugcuauggaucugggggagaugugcgacgauacagucaccuacaaguguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcagcaugaaaaucucaaguauacagucaucaucaccgugcacacaggggaccagcaucagguuggaaacgagacgcaaggcgugaccgcugaaauuacaccucaggccucuaccacagaggucauccugcccgaauacggcacccuggggcucgagugcuccccucgcacgggacuggacuucaaugagaugauucuucugaccaugaaaaacaaggcuuggauggugcacagacagugguuuuucgaucucccccugccguggacaagcggcgccaccacagaaaccccuacguggaaucggaaagagcuucuggucacauuuaagaacgcccacgcuaaaaagcaagaagugguugugcucgggucucaggagggagcgaugcauaccgcccugacaggcgcuaccgaaauccaaaauuccgggggcaccagcauuuucgccggacaccugaagugucgccucaaaauggacaagcuggagcuuaaaggcaugucuuaugccaugugcacaaacacguuuguccugaagaaagagguguccgaaacccagcaugggacaauccucaucaagguugaguacaagggagaagaugcucccuguaaaauuccuuucagcaccgaggacggccaagggaaggcccacaacggaagacugaucacagcgaaucccguggucaccaaaaaggaugagcccgugaacauugaagcugagccuccguucggcgaauccaauaucgugauugggaucggcgacaacgcccugaaaaucaauugguacaagaagggaucuagcauuggcaaaauguuugaggccacggcuagaggggcgagacgcauggcuauccuuggagauacagccugggacuucggcuccguugggggaguccucaacagccugggcaagauggugcaucagauuuuugggucugcguauaccgcccuguucuccggcgugagcugggucaugaaagugggaaucggcguucuccugaccuggauugggcuuaauucuaagaacacaagcauguccuuuucuugcaucgcuauuggaaucaucacccuguaccucggcgccgugguccaggcugauauggggugugugauuaauuggaaaggaaaggaacugaagugcggcagcgggaucuucguuacaaacgaggugcacacguggaccgagcaguauaaauuucaagccgacucccccaagcggcuggcgacagccauugcuggcgccugggaaaauggagucuguggcaucagaagcaccacacgcauggagaaccuucucuggaaacagauugcuaaugaacugaacuacauccugugggagaauaacaucaagcucaccgugguugugggggauauuaucggaguccuggaacagggcaaacggacgcuuaccccucagcccauggagcugaaguauucuuggaaaacaugggggaaggccaagauugugaccgccgagacacaaaacuccagcuucaucauugacggaccuaauacccccgaaugcccgucugcuuccagagcguggaacgugugggaggucgaagacuacggcuuuggcguuuucacaaccaauaucuggcucaaacugcgcgagguguauacgcagcugugugaucaccggcuuaugagcgccgcugugaaggacgaaagagccguccaugccgauaugggguacuggaucgagucccagaaaaacggaucuuggaagcucgagaaagcuagccugauugaagugaagacaugcaccuggccuaagucccacacccuguggucuaauggcguucucgagagcgacaugaucauucccaaaucccuggccgggccuaucagccagcauaaccaccgccccggauaccacacacaaaccgcgggcccuuggcaucuugggaagcuggaacucgauuuuaauuauugcgagggaacgacaguggucauuaccgagaacuguggcacacggggccccucucugagaaccacaaccguguccgggaaacugauccacgaauggugcugucgcagcugcacgcuuccgccucuccgguacaugggagaggacggcuguugguaugggauggaaaucagacccauuucugagaaggaagagaauaugguuaaaucccuggugagcgcuggaucuggcaaggucgauaacuucaccaugggggugcugugccucgccauccuguuugaggaaguuaugcggggaaaguucggcaaaaagcauaugauugccggcguguucuuuacauucguccuucugcucagcgggcagaucaccuggcgcgacauggcucacacacugauuaugaucggauccaaugccagcgauagaaugggcaugggggugaccuaccuggcgcuuauugcuacguuuaaaauccagcccuuccuggcccucggauuuuuccugcggaagcucacaucuagagagaaccugcuucugggcguggggcucgccauggcuaccacacugcaacugccugaagacaucgagcagauggccaauggaauugcucuuggccugauggcccucaaacugaucacccaguuugaaaccuaucagcucuggacagcgcugauuucccuuacguguagcaacaccauguucacacugaccgucgccuggcgcacagcuacccucauccuggccggcguuucccugcuuccggugugccaaucuagcuccaugcggaagacggauuggcugcccauggcuguggccgccaugggggucccuccccucccucuguuuauuuucucucucaaggacacacugaaaagacgcagcuggccccuuaaugagggagugauggcuguuggccugguguccauccuggcgucuagccuccugagaaacgaugucccuauggccgggccccuuguggcuggaggccugcucaucgccuguuacguuauuaccgggaccuccgccgaccugacaguggagaaggcugccgacaucaccugggaagaggaagcggagcagacaggagucagccauaaccucaugauuacgguggaugacgauggcaccaugcggaucaaagacgaugaaacagagaauauucugaccguccuucugaagacagcucugcucaucgugucuggcguuuuuccguauuccaucccugccacccugcuuguguggcacacguggcagaaacagacccaacgcagcgggguccugugggacgugcccucuccucccgagacacagaaggccgaacucgaggaaggaguuuacagaauuaaacagcagggcaucuucgggaagacccaagugggagucggcgugcagaaggaggggguguuucacacaauguggcauguuacccggggagcuguccugacauacaacggcaaacgccucgagccgaauugggccuccgugaagaaagaucugauuagcuauggcgggggauggagacuuucugcgcaguggcaaaagggcgaagaggugcagaucauugcugucgaaccugggaaaaaccccaagaauuuccagacgaugccuggaaccuuccagacaaccaccggcgagaucggggccauugcccuggacuuuaagcccggaacauccggcagccccaucaucaaccgggaaggcaaagugguugggcuguacggaaauggcguggucacgaagaacgggggauauguguccggcauugcucaaaccaaugccgagccugaugggccgacacccgagcucgaagaggaaauguucaaaaagcgcaaccugaccaucauggaccuucacccuggcagcggaaaaacaagaaaguaccugcccgcuauuguucgggaggccaucaagcgcagacuccggacccugauucucgcgccuacgagaguggucgccgcugaaauggaggaggcccugaaaggccuucccauccgcuaucagacaaccgcuaccaagucugaacauacagggcgggagaucguggaucugaugugccacgccaccuuuacaaugagacugcucagcccuguucgcgugccgaauuacaaccugauuaucauggacgaagcccauuucaccgaucccgcuuccauugcggcccggggauauaucucuacgagagucggcaugggggaggcugccgccauuuuuaugacagcuaccccucccggaacagccgacgcguucccucagagcaaugcucccauccaggacgaggaacgcgauaucccggagcgguccuggaacucuggcaaugaauggauuaccgacuuugccgggaaaacggugugguucgugccuagcaucaaggccggcaacgauauugcuaacugucuucgcaaaaauggaaagaaggucauccaacuguccagaaaaaccuuugacacagaguaccagaagaccaaacucaacgauugggacuucguugugacaaccgauauuucugaaaugggcgccaauuuuaaggcggaccgggugaucgaucccagacggugccugaaacccgucauucugacagacgggccugagcgcgugauccucgccggacccaugccuguuaccgcugccagcgcugcccagagacggggccgcguggggagaaacccgcagaaggagaaugaucaauacaucuucacgggacagccccuuaacaaugacgaagaccacgcucacuggacagaggccaagaugcugcuggauaacauuaauaccccugaaggcaucauucccgcccucuucgagccugaacgggagaaauccgccgcuaucgacggggaguauagacugaagggcgaaagccgcaaaaccuuugucgagcuuaugcggagaggagaucugcccguguggcucgcccauaagguugcuucugaaggcauuaaauacacagaccgcaaguggugcuucgaugggcagcggaacaaucagauccuggaggaaaacauggacguggagaucuggaccaaagagggagaaaagaagaaacugagaccgcgcuggcucgaugcccggacauauuccgacccucuugcccugaaggaguuuaaagauuucgcugcgggcagaaagagcauugcccuggaccucgucacggaaaucgggcgcgugcccucucaccuggcucauagaacccggaaugcccuugauaaccuggucaugcuccacacauccgagcacggaggccgcgccuacagacaugcuguggaggaacugccugagaccauggaaacacugcuccuucugggccugaugauucuccugaccgggggagccaugcuuuuucugaucagcggcaaagggauuggaaagacguccaucggccucaucuguguuauugcgucuagcgggaugcuguggauggccgagaucccccugcaauggauugcuuccgccaucgugcucgaguucuuuaugauggugcuucugauuccugagcccgagaagcagcggaccccgcaggacaaucaacuggcuuaugucguuaucggcauucucacacuggccgcgaucaucgccgcuaacgaaaugggccuucuggagaccacaaaacgcgaucucggcaugagcaaggaaccugggguggugucucccaccuccuaccuggacgucgaccugcaccccgccagcgcuuggacgcucuaugccguggcuacaaccguuauuacaccuaugcuuagacauaccaucgaaaauucuaccgccaacgugagccuggcggccauugcuaaccaggccgucgugcugaugggacucgauaaaggcuggccgaucuccaagauggaccugggggucccccuucuggcucucggaugcuacucucaggugaauccucugacacugacggccgccguucuccuucugauuacccacuacgcgaucaucggccccgggcugcaggcuaaagccacacgggaagcucaaaagagaaccgccgccggaauuaugaagaacccuacaguggauggcaucaugaccauugaccucgaucccgucaucuaugacagcaaauucgagaagcagcugggccaggugaugcuucugguucucugugcugugcagcugcugcucaugcgcacguccugggcccuuugcgaggcgcugacacuggccaccgggccuauuaccacacucugggaaggaucuccgggcaaauuuuggaauaccacaaucgcugucagcauggccaacaucuuccggggguccuaccuggcuggagccggccuugcguuuagcauuaugaagucuguggggacgggaaaaagaggcaccggcucccaaggggagacacugggagaaaaguggaagaaaaagcucaaucagcugagccgcaaagaguucgaucuguauaagaaauccggcaucaccgaaguggaccggacagaggccaaggaggggcucaaaagaggagaaaccacgcaucacgcuguuucucggggcagcgccaaacuucagugguuugucgagcgcaacauggugauucccgaagggagagugaucgaucugggauguggccggggcgggugguccuacuauugcgcuggacugaagaaagucaccgagguucgcggcuacacaaaagggggaccuggccacgaggaacccgugccuaugucuaccuauggguggaauauugugaaacucaugagcggaaaggacgucuucuaccugcccccggagaaaugugauacacuucugugcgacaucggcgaauccagcccuucucccaccguggaggaauccagaacaauucggguucucaagaugguggagcccuggcugaagaacaaucaguucuguaucaaaauccugaacccuuacaugcccaccgucauugagcaucucgaacgccuucaaagaaagcacggcgggaugcuggugcggaauccucugagccgcaacucuacgcaugagauguauuggaucuccaauggaacaggcaacauuguugccagcgugaauauggucucuagacuccugcuuaaccgguuuaccaugacccacagacgcccgacaaucgaaaaagauguggaccugggggcuggaacgcggcacgugaacgccgagcccgaaaccccuaauauggacgucauuggcgagagaaucaagcgcaucaaagaggaacauaacagcacauggcacuacgaugacgagaaucccuauaagaccugggcguaccauggguccuaugaaguuaaggccacaggaucugcuagcuccaugauuaacggcguggugaaacuccugaccaagccuugggaugucgugcccaugguuacacagauggccaugaccgacacgaccccguucggccagcaacggguguuuaaagagaaggucgauacaagaaccccucgcagcaugcccgggacacggagagugaugggaaucaccgcugaauggcuguggcgcacgcucggccggaauaaaaagccuagacugugcacacgcgaggaguucaccaagaaaguucggacaaacgccgccaugggggcgguguuuaccgaagagaaucagugggacuccgcuaaggccgccgucgaagaugaggacuucuggaaacuuguggauagagaacgcgagcugcacaagcucggaaaauguggcucuugcguuuacaacaugauggggaagagagagaaaaagcugggcgaauuuggaaaggcuaaaggcagccgggccauuugguauauguggcuuggggcucgcuaccuggaguucgaagcccucggauuucugaaugaggaccauugguucuccagagagaacucuuacagcggcguggaaggggagggacugcacaagcucggcuauauccugcgggauauuuccaaaauccccgggggcgcgauguacgccgacgacacggcuggaugggauaccagaaucacagaagacgaucuucacaaugaggaaaagauuacccagcagauggacccugagcaucggcaacuggccaacgcuaucuuuaaacucacauaucagaauaaggucgugaagguccagcgccccaccccgacaggcaccgugauggauauuaucucuagaaaagaccagcgggggagcggacaaguuggcacguacgggcugaacacauucaccaauauggaggcccagcuuauucgccagauggaaggagagggcgugcuguccaaggcggaucucgaaaacccucaucugcccgagaaaaagaucacccaguggcuggaaacaaaaggggucgagagacucaagcggauggccaucagcggcgacgauugcguggugaagcccauugacgaucgcuuugcuaacgcccugcuugcucugaaugacaugggaaaaguuagaaaggauaucccucaauggcagccgucuaaaggcuggcaugacuggcaacaggugcccuucuguucccaccacuuccaugagcucauuaugaaggacgggcggaaacuggucgugccuugccgcccccaagaugaacuuaucggacgggcccggauuagccagggcgcuggguggucucugcgcgagaccgccugucucggaaaggcguaugcccagauguggucccugauguacuuucacagacgggaccugcgccucgcuagcaacgccaucugcucugccguuccugugcauuggguccccacauccagaacgaccuggagcauucacgcucaucaccaauggaugacaaccgaagauaugcugacaguguggaaucgggucuggaucgaggacaacccuuggauggaagauaagacccccgugacgaccugggaggacguuccguaucuuggcaaaagagaggaucaguggugugggucccugaucggccucacaagccgcgccaccugggcgcagaauauuccuacagcuauccagcaagugcggucucugauuggaaacgaagaguuccuugacuacaugcccagcaugaagagauuucgcaaagaagaggaguccgaaggcgccaucugguga

SEQ ID NO: 20416 - RNA, 9873 nt, Artificial Sequence
  derived and/or modified CDS sequence (opt5) from DENV-3__FJ850092__SS-prME
accagccugugccucaugaugauccugcccgccgcucuugccuuccaccugacaucccgggacggagagccucggaugauuguggggaagaacgaacgcggaaagucucuccuguuuaagacggcgagcggcaucaauauguguacccuuauugcuauggaucugggggagaugugcgacgauacagucaccuacaaguguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcagcaugaaaaucucaaguauacagucaucaucaccgugcacacaggggaccagcaucagguuggaaacgagacgcaaggcgugaccgcugaaauuacaccucaggccucuaccacagaggucauccugcccgaauacggcacccuggggcucgagugcuccccucgcacgggacuggacuucaaugagaugauucuucugaccaugaaaaacaaggcuuggauggugcacagacagugguuuuucgaucucccccugccguggacaagcggcgucaccacagaaaccccuacguggaaucggaaagagcuucuggugacauuuaagaacgcccacgccaaaaagcaagaaguugugguccucgggucucaggagggagcuaugcauaccgcgcugacaggcgccaccgaaauccaaaauuccgggggcaccagcauuuucgcuggacaccugaagugucgccucaaaauggacaagcuggagcuuaaaggcaugucuuaugccaugugcacaaacacguuugugcugaagaaagagguuuccgaaacccagcaugggacaauccucaucaagguggaguacaagggagaagaugcccccuguaaaauuccuuucagcaccgaggacggccaagggaaggcucacaacggaagacugaucacagccaaucccgucgugaccaaaaaggaugagcccgugaacauugaagcggagccuccguucggcgaauccaauaucguuauugggaucggcgacaacgcucugaaaaucaauugguacaagaagggaucuagcauuggcaaaauguuugaggccacggccagaggggcuagacgcauggccauccuuggagauacagcuugggacuucggcuccgucgggggagugcucaacagccugggcaagauggugcaucagauuuuugggucugccuauaccgcgcuguucuccggcgucagcugggugaugaaaguuggaaucggcgugcuccugaccuggauugggcuuaauucuaagaacacaagcauguccuuuucuugcaucgccauuggaaucaucacccuguaccucggcgcugucgugcaggccgauaugggguguguuauuaauuggaaaggaaaggaacugaagugcggcagcgggaucuucgugacaaacgagguccacacguggaccgagcaguauaaauuucaagcugacucccccaagcggcuggccacagcgauugccggcgcuugggaaaauggaguguguggcaucagaagcaccacacgcauggagaaccuucucuggaaacagauugccaaugaacugaacuacauccugugggagaauaacaucaagcucaccguuguggucggggauauuaucggagugcuggaacagggcaaacggacgcuuaccccucagcccauggagcugaaguauucuuggaaaacaugggggaaggcuaagauugugaccgccgagacacaaaacuccagcuucaucauugacggaccuaauacccccgaaugcccgucugccuccagagcuuggaacgucugggagguugaagacuacggcuuuggcguguucacaaccaauaucuggcucaaacugcgcgagguguauacgcagcugugugaucaccggcuuaugagcgcggccgucaaggacgaaagagcugugcaugccgauaugggguacuggaucgagucccagaaaaacggaucuuggaagcucgagaaagccagccugauugaaguuaagacaugcaccuggccuaagucccacacccuguggucuaauggcgugcucgagagcgacaugaucauucccaaaucccuggcugggccuaucagccagcauaaccaccgccccggauaccacacacaaaccgccggcccuuggcaucuugggaagcuggaacucgauuuuaauuauugcgagggaacgacagucgugauuaccgagaacuguggcacacggggccccucucugagaaccacaaccguuuccgggaaacugauccacgaauggugcugucgcagcugcacgcuuccgccucuccgguacaugggagaggacggcuguugguaugggauggaaaucagacccauuucugagaaggaagagaauauggugaaaucccuggucagcgcgggaucuggcaagguggauaacuucaccauggggguucugugccucgcuauccuguuugaggaagugaugcggggaaaguucggcaaaaagcauaugauugccggcgucuucuuuacauucgugcuucugcucagcgggcagaucaccuggcgcgacauggcccacacacugauuaugaucggauccaaugcuagcgauagaaugggcaugggggugaccuaccuggcccuuauugcgacguuuaaaauccagcccuuccuggcucucggauuuuuccugcggaagcucacaucuagagagaaccugcuucugggcgucgggcucgccauggccaccacacugcaacugccugaagacaucgagcagauggcuaauggaauugcccuuggccugauggcucucaaacugaucacccaguuugaaaccuaucagcucuggacagcccugauuucccuuacguguagcaacaccauguucacacugaccguugcguggcgcacagccacccucauccuggcuggcgugucccugcuuccggugugccaaucuagcuccaugcggaagacggauuggcugcccauggccgucgcugccaugggggugccuccccucccucuguuuauuuucucucucaaggacacacugaaaagacgcagcuggccccuuaaugagggaguuauggccgugggccuggucuccauccuggcuucuagccuccugagaaacgaugugccuauggcggggccccuuguugccggaggccugcucaucgcuuguuacgugauuaccgggaccuccgccgaccugaucgucgagaaggccgcugacauuacaugggaagaggaagccgagcagaccggagugagccauaaccucaugaucacagucgaugacgauggcacgaugcggauuaaagacgaugaaaccgagaauauccugacagugcuucugaagaccgcgcugcucaucguuucuggcguguuuccguauuccauuccugcuacacugcuugucuggcacaccuggcagaaacagacgcaacgcagcggggugcugugggacguucccucuccucccgagacccagaaggccgaacucgaggaaggaguguacagaaucaaacagcagggcauuuucgggaagacacaagucggagugggcgugcagaaggaggggguuuuucacaccauguggcaugucacacggggagccgugcugaccuacaacggcaaacgccucgagccgaauugggcuuccgugaagaaagaucugaucagcuauggcgggggauggagacuuucugcccaguggcaaaagggcgaagagguccaggugauugcgguugaaccugggaaaaaccccaagaauuuccagacaaugccuggaacguuccagaccacaaccggcgagaucggggcuauugcccuggacuuuaagcccggaaccuccggcagccccaucaucaaccgggaaggcaaaguggucgggcuguacggaaauggcgugguuacaaagaacgggggauauguguccggcauugcccaaacgaaugcugagccugaugggccgacccccgagcucgaagaggaaauguucaaaaagcgcaaccugacaaucauggaccuucacccuggcagcggaaaaaccagaaaguaccugcccgccauuguccgggaggcuaucaagcgcagacuccggacacugauucucgccccuaccagagugguugcggccgaaauggaggaggcucugaaaggccuucccauccgcuaucagacgacagccaccaagucugaacauaccgggcgggagaucguggaucugaugugccacgcuacauuuaccaugagacugcucagcccuguccgcgugccgaauuacaaccugauuaucauggacgaagcccauuucacagaucccgccuccauugcugcgcggggauauaucucuaccagagugggcaugggggaggccgcugccauuuuuaugacggccacaccucccggaaccgcugacgccuucccucagagcaaugcgcccauccaggacgaggaacgcgauaucccggagcgguccuggaacucuggcaaugaauggauuacagacuuugcugggaaaaccgucugguucguuccuagcaucaaggccggcaacgauauugccaacugucuucgcaaaaauggaaagaaggugauccaacuguccagaaaaacguuugacaccgaguaccagaagacaaaacucaacgauugggacuucguggucaccacagauauuucugaaaugggcgcuaauuuuaaggccgaccgggugaucgaucccagacggugccugaaacccguuauucugaccgacgggccugagcgcgugauccucgcgggacccaugccugucacagccgcuagcgccgcucagagacggggccgcguggggagaaacccgcagaaggagaaugaucaauacaucuucaccggacagccccuuaacaaugacgaagaccacgcccacuggacggaggcuaagaugcugcuggauaacauuaauacaccugaaggcaucauucccgcccucuucgagccugaacgggagaaauccgcggccaucgacggggaguauagacugaagggcgaaagccgcaaaaccuuuguugagcuuaugcggagaggagaucugcccguguggcucgcucauaaggucgccucugaaggcauuaaauacaccgaccgcaaguggugcuucgaugggcagcggaacaaucagauccuggaggaaaacauggacguggagaucuggacaaaagagggagaaaagaagaaacugagaccgcgcuggcucgaugcucggaccuauuccgacccucuugcccugaaggaguuuaaagauuucgccgcuggcagaaagagcauugcgcuggaccucgucacagaaaucgggcgcgugcccucucaccuggcccauagaacgcggaaugcucuugauaaccugguuaugcuccacaccuccgagcacggaggccgcgccuacagacaugccguggaggaacugccugagacaauggaaacccugcuccuucugggccugaugauucuccugacagggggagcuaugcuuuuucugaucagcggcaaagggauuggaaagaccuccaucggccucaucugugugauugccucuagcgggaugcuguggauggcggagaucccccugcaauggauugccuccgcuaucguccucgaguucuuuaugaugguucuucugauuccugagcccgagaagcagcggacgccgcaggacaaucaacuggccuauguggugaucggcauucucacccuggcugccaucaucgcggccaacgaaaugggccuucuggagacaaccaaacgcgaucucggcaugagcaaggaaccuggggucgugucucccacauccuaccuggacguugaccugcaccccgcuagcgccuggacccucuaugcuguggccacgacagucauuaccccuaugcuuagacauacaaucgaaaauucuaccgcuaacgugagccuggccgcgauugccaaccaggcugucgugcugaugggacucgauaaaggcuggccgaucuccaagauggaccuggggguuccccuucuggcccucggaugcuacucucaggugaauccucugacccugacagcugccguccuccuucugauuacgcacuacgccaucaucggccccgggcugcaggcgaaagcuacccgggaagcccaaaagagaacagcugccggaauuaugaagaacccuaccguggauggcaucaugacaauugaccucgaucccguuaucuaugacagcaaauucgagaagcagcugggccaggugaugcuucugguccucugugccgugcagcugcugcucaugcgcaccuccugggcucuuugcgaggcccugacgcuggcgacagggccuauuaccacccucugggaaggaucuccgggcaaauuuuggaauacaaccaucgccgugagcauggcuaacaucuuccggggguccuaccuggccggagcuggccuugccuuuagcauuaugaagucuguugggacaggaaaaagaggcacgggcucccaaggggagacccugggagaaaaguggaagaaaaagcucaaucagcugagccgcaaagaguucgaucuguauaagaaauccggcaucacagaagucgaccggaccgaggcgaaggaggggcucaaaagaggagaaacaacccaucacgccgugucucggggcagcgcuaaacuucagugguuuguggagcgcaacauggucauucccgaagggagaguuaucgaucugggauguggccggggcgggugguccuacuauugcgccggacugaagaaagugacggaggugcgcggcuacaccaaagggggaccuggccacgaggaacccgucccuaugucuacauauggguggaauauugugaaacucaugagcggaaaggacguuuucuaccugcccccggagaaaugugauacccuucugugcgacaucggcgaauccagcccuucucccacaguggaggaauccagaaccauucggguccucaagaugguggagcccuggcugaagaacaaucaguucuguaucaaaauccugaacccuuacaugcccacaguuauugagcaucucgaacgccuucaaagaaagcacggcgggaugcuggugcggaauccucugagccgcaacucuacccaugagauguauuggaucuccaauggaacgggcaacauugucgcuagcgugaauauggugucuagacuccugcuuaaccgguuuacaaugacccacagacgcccgaccaucgaaaaagaugucgaccugggggccggaacacggcacguuaacgcugagcccgaaacgccuaauauggacgugauuggcgagagaaucaagcgcaucaaagaggaacauaacagcaccuggcacuacgaugacgagaaucccuauaagacaugggccuaccauggguccuaugaagugaaggcgaccggaucugccagcuccaugauuaacggcgucgugaaacuccugacaaagccuugggauguugugcccauggucacccagauggcuaugacagacaccacgccguucggccagcaacggguguuuaaagagaagguugauaccagaacaccucgcagcaugcccgggacccggagagugaugggaaucacagccgaauggcuguggcgcacccucggccggaauaaaaagccuagacugugcacgcgcgaggaguucacaaagaaaguccggaccaacgcugccaugggggccguguuuacagaagagaaucagugggacuccgcgaaggcugccguugaagaugaggacuucuggaaacuuguggauagagaacgcgagcugcacaagcucggaaaauguggcucuugcgucuacaacaugauggggaagagagagaaaaagcugggcgaauuuggaaaggccaaaggcagccgggcuauuugguauauguggcuuggggcccgcuaccuggaguucgaagcucucggauuucugaaugaggaccauugguucuccagagagaacucuuacagcggcguggaaggggagggacugcacaagcucggcuauauccugcgggauauuuccaaaauccccgggggcgccauguacgcggacgacaccgccggaugggauacgagaaucaccgaagacgaucuucacaaugaggaaaagauuacacagcagauggacccugagcaucggcaacuggcuaacgccaucuuuaaacucaccuaucagaauaaggucgugaagguucagcgccccacaccgaccggcacagugauggauauuaucucuagaaaagaccagcgggggagcggacaagucggcaccuacgggcugaacacguucacaaauauggaggcucagcuuauucgccagauggaaggagagggcgugcuguccaaggccgaucucgaaaacccucaucugcccgagaaaaagaucacccaguggcuggaaaccaaagggguggagagacucaagcggauggcgaucagcggcgacgauugcguugugaagcccauugacgaucgcuuugccaacgcucugcuugcccugaaugacaugggaaaagucagaaaggauaucccucaauggcagccgucuaaaggcuggcaugacuggcaacaggugcccuucuguucccaccacuuccaugagcucauuaugaaggacgggcggaaacugguugugccuugccgcccccaagaugaacuuaucggacgggcucggauuagccagggcgccggguggucucugcgcgagacagcuugucucggaaaggccuaugcgcagauguggucccugauguacuuucacagacgggaccugcgccucgccagcaacgcuaucugcucugccgucccugugcauuggguccccaccuccagaacaacguggagcauucacgcccaucaccaauggaugaccacagaagauaugcugaccguguggaaucggguuuggaucgaggacaacccuuggauggaagauaagacacccgugaccacgugggaggacgucccguaucuuggcaaaagagaggaucaguggugugggucccugaucggccucaccagccgcgcuacaugggcccagaauauuccuaccgcgauccagcaagugcggucucugauuggaaacgaagaguuccuugacuacaugcccagcaugaagagauuucgcaaagaagaggaguccgaaggcgcuaucugguga

SEQ ID NO: 20417 - RNA, 9873 nt, Artificial Sequence
  derived and/or modified CDS sequence (opt5) from DENV-3__FJ850094__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagggaccccuacguggaaucggaaagaacuucuggugacauuuaagaacgcucacgcgaaaaagcaagaggucgugguucucggaucucaggaaggcgccaugcacaccgcucugacaggggccaccgagauccagaauuccggcggaaccagcauuuucgccggccaucugaagugucgccucaaaauggacaagcuggaacuuaaagggaugucuuacgcuaugugcacaaacacguuugugcugaagaaagaggucuccgagacccagcacggaacaauccucaucaagguggaauacaagggcgaggaugcccccuguaaaauuccuuucagcaccgaagacgggcaaggaaaggcgcauaacggcagacugaucacagcuaaucccguugugaccaaaaaggaugagcccgucaacauugaggccgaaccuccguucggggaguccaauaucgugauuggcaucggagacaacgcccugaaaaucaauugguauaagaagggcucuagcauugggaaaauguuugaagcuacggcccggggagcuagacgcauggccauccuuggcgauacagcgugggacuucggguccgugggaggcguucucaacagccuggggaagaugguccaccagauuuuuggcucugccuacaccgcucuguucuccggagugagcugggugaugaaaaucggcauugggguccuccugaccuggaucggacuuaauucuaagaacacaagcauguccuuuucuugcauugccaucggcaucauuacccuguaucucggggcugugguucaggccgauaugggauguguggucaauuggaaaggcaaggagcugaagugcgggagcggcaucuucgugacaaacgaaguucauacguggaccgagcaguacaaauuucaagcggacucccccaagcggcuggccacagcuauugccggagcuugggagaauggcgugugugggaucagaagcaccacacgcauggaaaaccuucucuggaaacagauugccaaugagcugaacuauauccugugggaaaauaacaucaagcucaccgucgugguuggagauacgauuggcgugcuggagcaggggaaacggacccuuacaccucagcccauggaacugaaguacucuuggaaaaccuggggaaaggccaagaucgucacagcugagacccaaaacuccagcuucauuaucgacggcccuaauacacccgagugcccgucugcguccagagccuggaacgugugggaaguggaggacuauggcuuuggggucuucaccacgaauauuuggcucaaacugcgcgaaguuuacacacagcugugugaucaccggcuuaugagcgcugccgugaaggacgagagagccgugcacgcugauaugggauacuggaucgaaucccagaaaaacggcucuuggaagcucgagaaagccagccugaucgaggucaagaccugcaccuggccuaagucccauacacuguggucuaauggggugcucgaaagcgacaugauuauccccaaaucccuggcgggaccuauuagccagcacaacuaucgccccggcuaccauacccaaacggcugggccuuggcaccuuggaaagcuggagcucgauuuuaauuauugcgaaggcacaaccguugugaucacagagaacuguggcacccgggggcccucucugagaacaaccacggucuccggaaaacugauucacgaguggugcugucgcagcugcacccuuccgccucuccgguacaugggcgaagacggguguugguauggaauggagaucagacccaucucugaaaaggaggaaaauauggugaaaucccugguuagcgccggcucugggaagguggauaacuucacaaugggaguccugugccucgccauucuguuugaggaggugaugcggggcaaguucggcaaaaagcauaugaucgcugggguuuucuuuaccuucgugcuucugcucagcggacagauuacauggcgcgacauggcccacacccugaucaugauuggcuccaaugcgagcgauagaauggggaugggagucacguaccuggcucuuaucgccacauuuaaaauucagcccuuccuggcccucggcuuuuuccugcggaagcucaccucuagagaaaaccugcuucugggggugggacucgcuauggccacaacccugcaacugccugaggacaucgaacagauggcuaauggcaucgcccuuggccugauggcgcucaaacugauuacccaguuugagacauaucagcucuggacggcccugaucucccuuaccuguagcaacacaauguucacccugacaguggcuuggcgcaccgccacgcucauucuggcuggggucucccugcuuccgguuugccaaucuagcuccaugcggaagacagauuggcugcccauggccguggccgcuaugggagugccuccccucccucuguuuaucuucucucucaaggacaccuuuaaaagacgcagcuggccccugaaugaaggcgucauggcgguggggcuuguuuccauucuggccucuagccugcucagaaacgaugugccuauggcuggaccccuggucgccggcgggcuucugaucgccuguuacgugaucaccggaacauccgcugaccucaccguugagaaggccgcggacauuacaugggaggaagaggcugaacagacgggcgugagccauaaccugaugaucaccgucgaugacgauggcacaaugcggauuaaagacgaugagaccgaaaauauccucacagugcugcuuaagaccgcccugcugauugucucugggguguucccguacuccaucccugccacgcuccugguuuggcacaccuggcagaaacagacacaacgcagcggagugcuuugggacguccccucuccucccgagacccagaaggcugagcuggaagagggcguguauagaaucaaacagcaggggauuuuuggaaagacacaaguuggcguggggguccagaaggaaggaguguuccauaccauguggcacgugacacggggcgccguucucacguacaacggcaaacgccuggagccgaauugggcguccgucaagaaagaucucaucagcuaugggggaggcuggagacugucugcucaguggcaaaagggggaggaagugcaggugauugccgucgagccuggaaaaaaccccaagaauuuccagaccaugccuggcacauuucagaccaccacaggggaaaucggagccauugcucuugacuucaagcccggcacguccggcagccccaucauuaaccgggaggggaaagugguuggacuguacggcaaugggguggucaccaagaacggaggcuauguguccgggaucgcccaaacaaaugcugaaccugauggcccgacccccgagcuggaggaagagauguuuaaaaagcgcaaccucacaaucauggaccugcacccuggaagcggcaaaaccagaaaguaccuucccgccauuguucgggaagcgaucaagcgcagacugcggacgcucauucuggccccuacaagaguggucgcugccgagauggaagaggcucucaaagggcugcccauccgcuaucagaccaccgccacaaagucugagcauaccggacgggaaauuguggaucuuaugugccacgccacauucaccaugagacugcugagcccuguucgcgugccgaauuacaaccucaucaucauggacgaggcucauuuuacggaucccgcguccauugccgcucggggcuacaucucuacaagagucgggaugggagaagccgccgcuauuuucaugaccgccacaccucccggcaccgcggacgcuuuuccucagagcaaugcccccauccaggacgaggaacgcgauauuccggagcgguccuggaacucugggaaugaguggaucacggacuucgccggcaaaaccgugugguuugugccuagcaucaaggcuggaaacggcauugccaacugucugagaaaaaaugggaagaaggucauccaacuuucccgcaaaacauucgauaccgaauaucagaagacaaaacugaacgacugggauuuuguugugaccacagacauuucugagaugggagcgaauuucaaggccgaucgggugaucgaccccagacggugccucaaacccgucauucugaccgauggcccugaacgcgugauccuggcugggcccaugccuguuacggccgcuagcgccgcucagagacggggacgcgugggcagaaacccgcagaaggagaaugaccaauacauuuucacagggcagccccucaacaaugaugaggaccacgcccauuggaccgaagcgaagaugcuucuggacaacaucaauaccccugagggcaucauucccgcccuguuugaaccugagcgggaaaaauccgcugccaucgauggagaguauagacucaagggcgagagccgcaaaacauucgucgaacugaugcggagaggggaccuucccguguggcuggcucacaagguugccucugagggaauuaaauacaccgaucgcaaguggugcuuugacggccagcggaacaaucagauccucgaagagaacauggauguggaaauuuggacaaaagagggggagaagaagaaacugagaccgcgcuggcuggacgcccggacguauuccgauccucucgcucuuaaggaauucaaagacuuugcggccggaagaaagagcaucgcucuggaucuggucaccgagaucggccgcgugcccucucaccucgcccauagaacacggaaugcccuggacaaccuugucaugcugcacaccuccgaacauggcgggcgcgcuuacagacacgccguggaggaacucccugagacaauggagacccugcugcuccuuggacugaugauucugcucacgggcggggcgaugcuguuccuuaucagcggaaaaggcauugggaagaccuccaucggacugauuuguguuaucgccucuagcggcaugcucuggauggcugaaaucccccugcaauggauugccuccgcuaucgugcuggaguuuuucaugauggugcuccuuauuccugaacccgagaagcagcggacaccgcaggauaaucaacuggccuaugucguuaucggcauucugacccucgcggccaucauugcugccaacgagauggggcugcuugaaacaaccaaacgcgaccugggaaugagcaaggagccuggcguggugucucccacguccuaccucgaugucgaccugcaccccgcuagcgccuggacacuguacgcuguggccaccacaguuaucaccccuaugcucagacauaccaucgaaaauucuacagcgaacgugagccuugccgcuauugccaaccaggcugucgugcugauggggcuggacaaaggauggccgaucuccaagauggaucucggcgucccccugcuugcccuggggugcuauucucaggugaauccucucacgcugaccgccgcgguucugcuccuuauuacacacuacgcuaucauuggacccggccugcaggccaaagcuacccgggaggcccaaaagagaacagccgcuggcaucaugaagaacccuaccguggacgggaucaugacgauugaucuggaccccgucaucuaugauagcaaauuugaaaagcagcucggacaggugaugcugcuuguucugugugccgugcagcuccugcugaugcgcacauccugggcgcucugcgaggcccuuacccuggcuaccggcccuauuacaacccugugggaggggucuccgggaaaauucuggaauacaacgaucgccgucagcauggcuaacauuuuucggggcuccuaccucgccggggcgggacuggccuucagcaucaugaagucugugggcaccggcaaaagagggacaggaucccaaggcgaaacccuuggggagaaguggaagaaaaagcugaaucagcucagccgcaaagaauuugaccuguauaagaaauccggaaucacagagguggaucggaccgaagcuaaggagggccugaaaagaggggagacgacccaucacgccguuucucggggaagcgcuaagcuccagugguucgucgaacgcaacauggugauucccgagggcagagugaucgaccuuggcugugggcggggaggcugguccuacuauugcgccgggcugaagaaagucacagaaguucgcggauacaccaagggcgggccuggacaugaggaacccgugccuaugucuacauacggcuggaauauugugaaacugaugagcggcaaggaugucuucuaucuccccccggagaaaugugacacccugcuuugcgauaucggggaguccagcccuucucccacaguggaagaguccagaaccauucggguucugaagaugguggaacccuggcucaagaacaaucaguuuuguaucaaaauucugaacccuuacaugcccacggucaucgagcaccuggagcgccuccaaagaaagcacggaggcaugcuugugcggaauccucugagccgcaacucuacacaugaaauguauuggaucuccaaugggaccggaaacauuguugcuagcgugaauauggucucuagacugcuccugaaccgguucaccaugacacacagacgcccgacgaucgagaaagacguggaucuuggcgccgggacccggcaugugaacgcggaacccgagacaccuaauauggacgucauuggagaaagaaucaagcgcauuaaagaggagcacaacagcaccuggcacuacgacgaugaaaaucccuauaagacaugggccuaccauggcuccuaugagguuaaggcuaccggcucugccagcuccaugaucaacgggguggugaaacugcucacaaagccuugggacgucgugcccaugguuacccagauggcuaugacggauaccacaccguuuggacagcaacggguguucaaagaaaaggucgacaccagaacaccucgcagcaugcccggcacccggagagugauggggaucacggccgaguggcuguggcgcacacugggacggaauaaaaagccuagacucugcacccgcgaagaguuuacaaagaaaguucggaccaacgccgcgaugggcgcuguguucacggaggaaaaucagugggauuccgccaaggccgcugucgaggacgaagauuuuuggaaacugguggacagagagcgcgaacuucacaagcuggggaaauguggcucuugcguuuacaacaugaugggaaagagagagaaaaagcucggcgaguucgggaaggccaaaggaagccgggcuauuugguacauguggcugggcgcccgcuaucuugaauuugaggcgcugggguuccucaaugaagaucauugguuuuccagagagaacucuuacagcggaguggagggcgaagggcugcacaagcugggcuauauccuccgggacauuuccaaaauccccggaggcgccauguacgcugaugacaccgccgggugggacacaagaauuaccgaggaugaccugcauaaugaagagaagaucacacagcagauggauccugaacaccggcaacuugcuaacgccaucuucaaacugaccuaucagaauaaggucgugaagguccagcgccccacaccgaccggaacggugauggacauuaucucuagaaaagaucagcggggcagcgggcaaguuggaacauacggccucaacaccuuuaccaauauggaggcgcagcugauucgccagauggagggggaaggcgugcuuuccaaggccgaccuggagaacccucaccuccccgaaaaaaagaucacacaguggcuggagaccaaaggagucgaaagacugaagcggauggcuauuagcggcgaugacugcguggugaagcccaucgaugaccgcuucgccaacgcucuccuggcccuuaaugauauggggaaaguuagaaaggacaucccucaauggcagccgucuaaaggauggcaugauuggcagcaggugcccuucuguucccaccauuuucacgagcugauuaugaaggacggccggaaacucgucgugccuugccgcccccaagacgagcugaucgggagagcucggauuagccagggagccggcuggucucuucgcgaaacagcgugucuggggaaggccuaugcucagauguggucccucauguacuuccacagacgggaucugcgccuggccagcaacgccaucugcucugcuguuccugugcauuggguccccacguccagaaccacauggagcauucacgcccaucaccaauggaugaccacagaggacaugcucaccguguggaaucgggucuggaucgaagauaacccuuggauggaggacaagacgcccgugaccacaugggaagauguuccguaccugggcaaaagagaggaccagugguguggaucccuuauuggccugaccagccgcgcgacaugggcucagaauaucccuaccgccauccagcaagugcggucucucauugggaacgaggaauuucuggauuauaugcccagcaugaagagauuccgcaaagaggaagaguccgagggagccaucugguga

SEQ ID NO: 20418 - RNA, 9873 nt, Artificial Sequence
  derived and/or modified CDS sequence (opt5) from DENV-3__FJ898446__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuugugcugaagaaagaggucuccgaaacccagcaugggacaauccucaucaagguggaguacaagggagaagaugcccccuguaaaauuccuuucagcaccgaggacggccaagggaaggcgcacaacggacggcugaucacagcuaaucccguugugaccaaaaaggaggaacccgucaacauugaggccgaaccuccguucggcgaguccaauaucgugauugggacgggcgauaacgcccugaaaaucaauugguauaagaagggaucuagcaucggcaaaauguuugaaacaaccgcuagaggggcccgccggauggcuauucuuggagacaccgccugggauuucggcuccguggggggaguucucaacagccugggcaagaugguccaucagaucuuugggucugcguacacagcccuguucuccggcgugagcugggugaugaaaauuggaaucggcguccuccugaccuggauugggcuuaauucuaagaacacaagcauguccuuuucuugcaucgcuauuggaaucaucacgcuguaucucggcgccgugguucaggcugacauggggugugugauuaauuggaaaggaaaggagcugaagugcggcagcgggaucuucgucaccaacgaggugcacacauggaccgaacaguacaaauuucaagccgauucccccaagagacuggcgacagccauugcuggcgccugggagaauggaguuuguggcauccgcagcaccacgcggauggaaaaccuucucuggaaacagauugcuaaugagcugaacuauauccugugggaaaauaacaucaagcucaccguggucgugggggacauuaucggaguucuggagcagggcaaaagaacacuuaccccucagcccauggagcugaaguacucuuggaaaacaugggggaaggccaagauugugaccgccgaaacacaaaacuccagcuucaucauugauggaccuaauacccccgagugcccgucugcuucccgcgcguggaacgucugggaaguggaggacuauggcuuuggcguguucacgacaaauaucuggcucaaacugcgggaagucuacacccagcugugugaccauagacuuaugagcgccgcuguuaaggaugagcgcgccgugcacgccgacaugggguacuggaucgagucccagaaaaacggaucuuggaagcucgaaaaagcuagccugauugaggugaagaccugcacauggccuaagucccacacccuguggucuaauggcguccucgaaagcgauaugaucauucccaaaucccuggccgggccuaucagccagcauaaccaccggcccggauaucauacgcaaacagcgggcccuuggcaccuugggaagcuggagcucgacuuuaauuacugcgagggaaccacagugguuauuaccgaaaacuguggcacaagaggccccucucugcgcaccacgaccguguccgggaaacugauccacgaguggugcugucggagcugcacacuuccgccucucagauauaugggagaagauggcuguugguacgggauggagauccggcccauuucugaaaaggaggagaauauggucaaaucccuggugagcgcuggaucuggcaagguugacaacuucaccaugggggugcugugccucgccauccuguuugaagaggucaugcgcggaaaguucggcaaaaagcauaugauugccggcguguucuuuacauucguucuucugcucagcgggcagaucaccuggagagauauggcucacacgcugauuaugaucggauccaaugccagcgaccggaugggcaugggggugacauaucuggcgcuuauugcuaccuuuaaaauccagcccuuccuggcccucggauuuuuccugagaaagcucacaucucgcgaaaaccugcuucugggcgucgggcucgccauggcuaccacccugcaacugccugaggauaucgaacagauggccaauggaauugcucuuggccugauggcccucaaacugaucacacaguuugagacguaccagcucuggaccgcgcugauuucccuuacauguagcaacaccauguucacacugaccguggccuggcggacggcuacacucauccuggccggcgugucccugcuuccggucugccaaucuagcuccaugagaaagaccgacuggcugcccauggcuguugccgccaugggggugccuccccucccucuguuuauuuucucucucaaggauacccugaaacgcagaagcuggccccuuaaugagggagugauggcugucggccugguguccauccuggcgucuagccuccugcggaacgacguuccuauggccgggccccuuguggcuggaggccugcucaucgccuguuaugucauuacagggaccuccgccgaucugacaguggaaaaggcugccgacaucacgugggaggaagaggcggaacagaccggaguuagccauaaccucaugauuacaguggacgaugacggcaccaugcgcaucaaagaugacgagacagagaauauucugaccguccuucugaagacggcucugcucaucgugucuggcgucuuuccguacuccaucccugccacccugcuuguguggcacacauggcagaaacagacccaaagaagcgggguucugugggaugugcccucuccucccgaaacacagaaggccgagcucgaagagggagucuaccggauuaaacagcagggcaucuucgggaagacccaagugggaguuggcgugcagaaggagggggucuuucauacaauguggcacgugacgcgcggagcugugcugaccuauaacggcaaaagacucgaaccgaauugggccuccguuaagaaagaccugauuagcuacggcgggggauggcggcuuucugcgcaguggcaaaagggcgaggaaguccaggugaucgcuguggagccugggaaaaaccccaagaauuuccagacaaugccuggaaccuuccagaccacaacgggcgaaauuggggccaucgcccuggauuuuaagcccggaaccuccggcagccccauuaucaaccgcgagggcaaagucguggggcuguauggaaauggcguugugacaaagaacgggggauacgucuccggcaucgcucaaaccaaugccgagccugacgggccgacacccgaacucgaggaagagauguucaaaaagagaaaccugaccauuauggaucuucacccuggcagcggaaaaacgcggaaguaucugcccgcuaucgugcgcgaagccauuaagagacggcucagaacacugauccucgcgccuacccgcguuguggccgcugagauggaggaagcccugaaaggccuucccauucgguaccagaccacagcuaccaagucugagcauacagggagagaaaucgucgaccugaugugccacgccaccuuuacgaugcgccugcucagcccugugcggguuccgaauuauaaccugaucauuauggaugaggcccauuucacagaccccgcuuccaucgcggccagaggauacauuucuacccgcgugggcaugggggaagcugccgccaucuuuaugacagcuaccccucccggaacggccgaugcguucccucagagcaaugcucccauucaggacgaggagcgggacaucccggaaagauccuggaacucuggcaaugaguggaucaccgauuuugccgggaaaacagucugguucgugccuagcauuaaggccggcaacgacaucgcuaacugucuucgcaaaaauggaaagaaggugauucaacugucccggaaaaccuuugauacagaauaccagaagaccaaacucaacgacugggauuucgucguuacaaccgacaucucugagaugggcgccaauuuuaaggcggauagagugauugacccccggcgcugccugaaacccgugauccugacggaugggccugagagagucauucucgccggacccaugccugugacagcugccagcgcugcccagcggcgcggcagaguugggcggaacccgcagaaggaaaaugaccaauauaucuucaccggacagccccuuaacaaugaugaggaccacgcucauuggaccgaagccaagaugcugcuggacaacaucaauacaccugagggcauuauccccgcgcucuucgaaccugagagagagaaauccgccgcuauugauggggaauaccgccugaagggcgagagccggaaaaccuuuguggaacuuaugagacgcggagaccugcccgucuggcucgcccacaagguggcuucugagggcaucaaauauacagaucggaaguggugcuucgacgggcagagaaacaaucagauucuggaagagaacauggauguugagaucuggacgaaagaaggagagaagaagaaacugcgcccgcgguggcucgacgccagaaccuacuccgauccucuugcccugaaggaauuuaaagacuucgcugcgggccgcaagagcaucgcccuggaucucgugacagagauugggagaguccccucucaccuggcucaucggacccgcaaugcccuugacaaccuggugaugcuccacacauccgaacauggaggcagagccuaucggcacgcugucgaggagcugccugaaaccauggagacgcugcuccuucugggccugaugauccuccugaccgggggagccaugcuuuuucugauuagcggcaaagggaucggaaagacauccauuggccucaucugugugaucgcgucuagcgggaugcuguggauggccgaaauuccccugcaauggaucgcuuccgccauuguucucgaguucuuuaugauggugcuucugaucccugagcccgaaaagcagcgcaccccgcaggauaaucaacuggcuuacguggucauuggaauccucacacuggccgcgauuaucgccgcuaacgagaugggccuucuggaaaccacgaaaagagaccucggcaugagcaaggagccugggguugugucucccacauccuaucuggauguggaccugcaccccgccagcgcuuggacccucuacgccgucgcuacaaccgugaucaccccuaugcuucggcauacaauugaaaauucuacggccaacguuagccuggcggccaucgcuaaccaggccgugguccugaugggacucgacaaaggcuggccgauuuccaagauggaucugggggugccccuucuggcucucggaugcuacucucaggucaauccucugacccugacagccgccgugcuccuucugaucacccacuaugcgauuaucggccccgggcugcaggcuaaagccacaagagaggcucaaaagcgcaccgccgccggaaucaugaagaacccuacgguugacggcauuaugacaaucgaucucgaccccgugauuuacgauagcaaauucgagaagcagcugggccaggucaugcuucuggugcucugugcuguucagcugcugcucaugcggaccuccugggcccuuugcgaagcgcugacccuggccacagggccuaucaccacacucugggagggaucuccgggcaaauuuuggaauacgaccauugcugugagcauggccaacaucuucagaggguccuaucuggcuggagccggccuugcguuuagcaucaugaagucugucgggacaggaaaacgcggcaccggcucccaaggggaaacacugggagagaaguggaagaaaaagcucaaucagcugagccggaaagaauucgaccuguacaagaaauccggcauuaccgagguggauagaacggaggccaaggaagggcucaaacggggagagaucacccaucacgcugugucucgcggcagcgccaagcuucagugguuuguugaaagaaacauggucauucccgaggggcgggugaucgaccugggauguggccgcggcgggugguccuauuacugcgcuggacugaagaaagugacagaagucagaggcuauaccaaggggggaccuggccaugaggagcccguuccuaugucuacauacggguggaauauugugaaacucaugagcggaaaggauguguucuaccugcccccggaaaaaugugacacccuucugugcgauaucggcgaguccagcccuucucccacagucgaagagucccggaccauucgcgugcucaagaugguugagcccuggcugaagaacaaucaguucuguaucaaagugcugaacccuuauaugcccacggucaucgaacaccucgagagacuucaacggaagcacggcgggaugcuggugcgcaauccucugagcagaaacucuacacaugaaauguacuggauuuccaauggaaccggcaacaucguugccagcgugaauauggucucucggcuccugcuuaacagauuuaccaugacacaccgccggccgacgauugagaaagacguggaucugggggcuggaaccagacaugugaacgccgaacccgagacaccuaauauggacgucaucggcgagcgcauuaagcggaucaaagaagagcacaacagcaccuggcacuaugacgaugaaaaucccuacaagacaugggcguaucauggguccuacgagguuaaggccaccggaucugcuagcuccaugaucaacggcguggugaaacuccugacaaagccuugggacgucgugcccaugguuacccagauggccaugacggauaccacaccguucggccagcaaagaguguuuaaagaaaaggucgacacccgcacaccucggagcaugcccgggaccagacgcgugaugggaauuacggcugaguggcuguggcggacacucggcagaaauaaaaagccucgccugugcacccgggaggaauucacaaagaaaguuagaaccaacgccgccaugggggcgguguuuacggaggaaaaucagugggauuccgcuaaggccgccgucgaggacgaagauuucuggaaacuuguggaccgcgagagagagcugcacaagcucggaaaauguggcucuugcguuuauaacaugauggggaagcgggaaaaaaagcugggcgaguuuggaaaggcuaaaggcagccgcgccaucugguacauguggcuuggggcuagauaccuggaauucgaggcccucggauuucugaaugaggaucauugguucucccgggaaaacucuuauagcggcguggagggggaaggacugcacaagcucggcuacauucugagagacaucuccaaaauucccgggggcgcgauguaugccgaugacaccgcuggaugggacacacggaucaccgaggaugaccuucauaaugaagagaagaucacacagcagauggauccugagcaccgccaacuggccaacgcuauuuuuaaacucaccuaccagaauaaggucgugaagguccagagacccacaccgaccggcacggugauggacaucauuucucggaaagaucagcgcgggagcggacaaguuggcacauaugggcugaacaccuucaccaauauggaagcccagcuuaucagacagauggagggagaaggcgugcuguccaaggcggaccucgagaacccucaccugcccgaaaaaaagauuacacaguggcuggagaccaaaggggucgagcggcucaagcgcauggccaucagcggcgaugacugcguggugaagcccaucgaugacagauuugcuaacgcccugcuugcucugaaugauaugggaaaaguucggaaggacauuccucaauggcagccgucuaaaggcuggcaugauuggcagcaggugcccuucuguucccaccauuuccacgaacucaucaugaaggacgggcgcaaacuggucgugccuugcagaccccaagacgagcuuauuggacgggcccgcaucagccagggcgcuggguggucucugagagaaacagccugucucggaaaggcguacgcccagauguggucccugauguauuuucaccggcgcgaucugagacucgcuagcaacgccauuugcucugccguuccugugcauuggguccccacgucccggaccacauggagcauccacgcucaucaccaauggaugaccacagaggacaugcugaccguguggaauagagucuggauugaagauaacccuuggauggaggacaagacgcccgugaccacaugggagaauguuccguaccuuggcaaacgcgaagaucaguggugugggucccugaucggccucaccagccgggccacaugggcgcagaacaucccuaccgcuauucagcaagugagaucucugaucggaaaugaggaauuccuugacuacaugcccagcaugaagcgcuuucggaaagaggaggaauccgagggcgccauuugguga

SEQ ID NO: 20419 - RNA, 9873 nt, Artificial Sequence
  derived and/or modified CDS sequence (opt5) from DENV-3__GU131844__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcucauugagggcaaaguugugcaguaugaaaaucugaaguacacagucaucaucaccgugcacacaggggaccagcaucagguuggaaacgagacgcaaggcgugaccgcugaaauuacaccccaggccucuaccacagaggcuauccugccugaauauggcacccucgggcuggagugcucccccagaacgggacuugacuucaaugagaugauucugcucaccaugaaaaacaaggccuggaugguccaccggcagugguuuuucgaucugccucuucccuggacaagcggcgccaccacagaaaccccgacguggaaucgcaaagagcugcucgugacauuuaagaacgcucaugcgaaaaagcaagaagucgugguucuggggucucaggagggagccaugcacaccgcucugacaggcgccaccgaaauccagaauuccgggggcaccagcauuuucgccggacaccucaaguguagacugaaaauggacaagcuugagcugaaaggcaugucuuacgcuaugugcacaaacacguuugugcucaagaaagaggucuccgaaacccagcaugggacaauccugaucaagguggaguacaagggagaagaugccccuuguaaaauucccuucagcaccgaggacggccaagggaaggcgcacaacggacggcugaucacagcuaauccuguugugaccaaaaaggaggaacccgucaacauugaggccgaacccccuuucggcgaguccaauaucgugauugggacgggcgauaacgcccuuaaaaucaauugguauaagaagggaucuagcaucggcaaaauguuugaagcuacagccagaggggcucgccggauggccauucucggagacaccgcgugggauuucggcuccguggggggaguucugaacagccugggcaagaugguccaucagaucuuugggucugccuacaccgcucucuucuccggcgugagcugggugaugaaaauuggaaucggcguccugcuuacauggauugggcugaauucuaagaacaccagcauguccuuuucuugcaucgccauuggaaucaucacacucuaucugggcgcugugguucaggccgacauggggugugugauuaauuggaaaggaaaggagcugaagugcggcagcgggaucuucgucacgaacgaggugcacaccuggacagaacaguacaaauuucaagcggauuccccgaagagacuugccaccgcuauugccggcgcuugggagaauggaguuuguggcauccgcagcacaacccggauggaaaaccuccuguggaaacagauugccaaugagcugaacuauauccucugggaaaauaacgugaagcugacggucgugguuggggacaucauuggagugcuugagcagggcaaaagaacccugacaccccagccuauggagcucaaguacucuuggaaaaccugggggaaggccaagaucgucacagcugaaacccaaaacuccagcuucauuaucgauggacccaauacaccugagugccccucugcgucccgcgccuggaacgugugggaaguggaggacuauggcuuuggcgucuucaccacgaauauuuggcugaaacugcgggaaguuuacacacagcuuugugaccauagacucaugagcgcugccgugaaggaugagcgcgccgugcacgcugacaugggguacuggaucgagucccagaaaaacggaucuuggaagcuggaaaaagccagccugaucgaggucaagaccugcaccuggccgaagucccacacacucuggucuaauggcgugcuggaaagcgauaugauuaucccuaaaucccuugcggggcccauuagccagcauaaccaccggccuggauaucauacccaaacggcuggccccuggcaccuggggaagcucgagcuggacuuuaauuacugcgagggaacaaccguugugaucacagaaaacuguggcaccagaggcccuucucugcgcacaaccacggucuccgggaaacuuauucacgaguggugcugucggagcugcacccuccccccgcugagauauaugggagaagauggcuguugguacgggauggagauccggccuaucucugaaaaggaggagaauauggugaaaucccugguuagcgccggaucuggcaagguggacaacuucacaauggggguccucugccuggccauucuuuuugaagaggugaugcgcggaaaguucggcaaaaagcauaugaucgcuggcguuuucuuuaccuucgugcugcuccugagcgggcagauuacauggagagauauggcccacacccugaucaugauuggauccaaugcgagcgaccggaugggcaugggggucacguaucuugcucugaucgccacauuuaaaauucagcccuuccucgcccugggauuuuuccucagaaagcugaccucucgcgaaaaccuucugcucggcguggggcuggcuauggccacaacccugcaacuucccgaggauaucgaacagauggcuaauggaaucgcccugggccucauggcgcugaaacucauuacccaguuugagacauaccagcuguggacggcccuuaucucccugaccuguagcaacacaauguucacccucacaguggcuuggcggaccgccacgcugauucuggcuggcgucucccuucugccuguuugccaaucuagcuccaugagaaagacagacuggcucccgauggccguggccgcuaugggggugcccccucugccccucuuuaucuucucucugaaggauacccuuaaacgcagaagcuggccucugaaugagggagucauggcggugggccugguuuccauucucgccucuagccugcuucggaacgacgugcccauggcugggccucuggucgccggaggccuccugaucgccuguuaugugaucaccgggacauccgcugaucucaccguugaaaaggccgcggacauuacaugggaggaagaggcugaacagacgggagugagccauaaccugaugaucaccgucgacgaugacggcacaaugcgcauuaaagaugacgagaccgagaauauccuuacagugcugcugaagaccgcccuccugauugucucuggcguguuucccuacuccaucccggccacgcuucugguuuggcacaccuggcagaaacagacacaaagaagcggggugcucugggaugucccuucucccccugaaacccagaaggcugagcuggaagagggaguguaccggaucaaacagcagggcauuuucgggaagacacaaguuggagugggcguccagaaggaggggguguuucauaccauguggcacgugacacgcggagccguucucacguauaacggcaaaagacuggaacccaauugggcguccgucaagaaagaccuuaucagcuacggcgggggauggcggcugucugcucaguggcaaaagggcgaggaagugcaggugauugccgucgagccggggaaaaacccuaagaauuuccagaccaugcccggaacauuccagaccaccacaggcgaaaucggggccauugcucuggauuuuaagccuggaacguccggcagccccaucauuaaccgcgagggcaaagugguugggcucuauggaaauggcguggucaccaagaacgggggauacguguccggcaucgcccaaacaaaugcugagcccgacgggccuaccccggaacuggaggaagagauguucaaaaagagaaaccuuacaaucauggaucugcaccccggcagcggaaaaacccggaaguaucucccugccauuguucgcgaagcgaucaagagacggcugagaacgcucauucuggcccccacacgcguggucgcugccgagauggaggaagcucuuaaaggccugccuauccgguaccagaccaccgccacaaagucugagcauaccgggagagaaauuguggaccugaugugccacgccacauuuaccaugcgccuccugagccccguucgggugccuaauuauaaccuuaucaucauggaugaggcucauuucacggacccggcguccauugccgcuagaggauacaucucuacacgcgucggcaugggggaagccgccgcuauuuuuaugaccgccacacccccuggaaccgcggaugcuuucccccagagcaaugccccuauccaggacgaggagcgggacauucccgaaagauccuggaacucuggcaaugaguggaucacggauuuugccgggaaaaccgugugguucgugccgagcaucaaggcuggcaacgacauugccaacugucugcgcaaaaauggaaagaaggucauccaacucucccggaaaacauuugauaccgaauaccagaagacaaaacugaacgacugggauuucguugugaccacagacauuucugagaugggcgcgaauuuuaaggccgauagagugaucgacccucggcgcugccugaaacccgucauucucaccgaugggcccgagagagugauccuugcuggaccuaugcccguuacggccgcuagcgccgcucagcggcgcggcagaguggggcggaacccucagaaggaaaaugaccaauauauuuucacaggacagccgcugaacaaugaugaggaccacgcccauuggaccgaagcgaagaugcugcucgacaacaucaauacccccgagggcaucauuccugcccuguucgaacccgagagagagaaauccgcugccaucgauggggaauaccgccuuaagggcgagagccggaaaacauuugucgaacugaugagacgcggagaccucccuguguggcuggcucacaagguugccucugagggcauuaaauauaccgaucggaaguggugcuucgacgggcagagaaacaaucagauccuggaagagaacauggauguggagauuuggacaaaagaaggagagaagaagaaacuccgcccccgguggcuugacgccagaacguacuccgauccgcuggcucugaaggaauuuaaagacuucgcggccggccgcaagagcaucgcucucgaucuggucaccgagaucgggagagugccuucucaccuugcccaucggacacgcaaugcccuggacaaccucgucaugcugcacaccuccgaacauggaggcagagcuuaucggcacgccguggaggagcugcccgaaacaauggagacccuccuucugcugggccucaugauucugcuuacggggggagcgaugcuguuucucaucagcggcaaagggauuggaaagaccuccaucggccugauuuguguuaucgccucuagcgggaugcuguggauggcugaaaucccucuccaauggauugccuccgcuaucgugcuugaguucuuuaugauggugcugcugauucccgagccugaaaagcagcgcacaccccaggauaaucaacucgccuacgucguuaucggaauucugacccuugcggccaucauugcugccaacgagaugggccugcucgaaacaaccaaaagagaccugggcaugagcaaggagccggggguggugucuccuacguccuaucuggaugucgaccuccaccccgcuagcgccuggacacuuuacgcuguggccaccacaguuaucacccccaugcugcggcauaccaucgaaaauucuacagcgaacgugagccuggccgcuauugccaaccaggcugucgugcucaugggacuggacaaaggcuggccuaucuccaagauggaucuuggggucccgcugcucgcccugggaugcuacucucaggugaauccccugacgcucaccgccgcgguucuucugcugauuacacacuaugcuaucauuggcccugggcuccaggccaaagcuaccagagaggcccaaaagcgcacagccgcuggaaucaugaagaaccccaccguggacggcaucaugacgauugaucuggacccugucaucuacgauagcaaauucgagaagcagcuuggccaggugaugcugcucguucugugugccgcgcagcugcuccuuaugcggacauccugggcccugugcgaagcucugacccucgccaccgggcccauuacaacccugugggagggaucuccuggcaaauuuuggaauacaacgaucgcugugagcauggccaacauuuucagaggguccuaucuugcgggagccggccuggcuuuuagcaucaugaagucugucgggaccggaaaacgcggcacaggcucccaaggggaaacccucggagagaaguggaagaaaaagcugaaucagcugagccggaaagaauucgaccucuacaagaaauccggcaucacagagguggauagaaccgaggccaaggaagggcuuaaacggggagagauuacgcaucacgcugugucucgcggcagcgccaagcugcagugguuuguugaaagaaacauggucaucccggaggggcgggugauugaccugggauguggccgcggcgggugguccuauuacugcgcuggacucaagaaagugaccgaagucagaggcuauacaaaggggggacccggccaugaggagccuguucccaugucuaccuacggguggaauaucgugaaacugaugagcggaaaggauguguucuaccuuccucccgaaaaaugugacacacugcucugcgauauuggcgaguccagcccgucuccuaccgucgaagagucccggacaauccgcgugcugaagaugguugagcccuggcugaagaacaaucaguucuguauuaaagugcucaaccccuauaugccuaccgucaucgaacaccuugagagacugcaacggaagcacggcgggaugcuggugcgcaauccccucagcagaaacucuacgcaugaaauguacuggaucuccaauggaacaggcaacauuguugccagcgugaauauggucucucggcugcuucugaacagauuuaccaugacccaccgccggccuacaaucgagaaagacguggaucucggggcgggaacgagacaugugaacgccgaaccggagacccccaauauggacgucauuggcgagcgcaucaagcggauuaaagaagagcacaacagcacauggcacuaugacgaugaaaauccuuacaagaccugggcuuaucauggguccuacgagguuaaggccacaggaucugcuagcuccaugaucaacggcguggugaaacugcugaccaagcccugggacgucgugccuaugguuacacagauggccaugaccgauacgacccccuucggccagcaaagaguguuuaaagaaaaggucgacacacgcaccccgcggagcaugccugggacaagacgcgugaugggaaucaccgccgaguggcucuggcggacgcugggcagaaauaaaaagccccgccuuugcacacgggaggaauucaccaagaaaguuagaacaaacgcggcuaugggggccguguuuaccgaggaaaaucagugggauuccgccaaggcugccgucgaggacgaagauuucuggaaacugguggaccgcgagagagagcuccacaagcugggaaaauguggcucuugcguuuauaacaugauggggaagcgggaaaaaaagcuuggcgaguuuggaaaggcuaaaggcagccgcgccauuugguacauguggcugggggcgagauaccucgaauucgaggcccugggauuucugaaugaggaucauugguucucccgggaaaacucuuauagcggcguggagggggaaggacuccacaagcugggcuacauccuuagagacauuuccaaaaucccugggggcgcuauguaugccgaugacacggcuggaugggacacccggauuacagaggaugaccugcauaaugaagagaagaucacccagcagauggaucccgagcaccgccaacucgccaacgcgaucuuuaaacugacauaccagaauaaggucgugaagguccagagaccuacccccacaggcaccgugauggacauuaucucucggaaagaucagcgcgggagcggacaaguuggcacguaugggcuuaacacauucaccaauauggaagcccagcugauuagacagauggagggagaaggcgugcucuccaaggcugaccuggagaacccgcaccugccugaaaaaaagaucgcccaguggcucgagaccaaaggggucgagcggcugaagcgcauggcuauuagcggcgaugacugcguggugaagcccaucgaugacagauuugccaacgcucuucuggcccucaaugauaugggaaaaguucggaaggacaucccccaauggcagccuucuaaaggcuggcaugauuggcagcaggugccguucuguucccaccauuuccacgaacugauuaugaaggacgggcgcaaacuugucgugcccugcagaccucaagacgagcugaucggacgggcgcgcauuagccagggcucuggguggucccucagagaaacagccugucugggaaaggcuuacgcccagauguggagccugauguauuuucaccggcgcgaucucagacuggccucuaacgcuaucugcuccgccguucccgugcauugggucccuaccagccggacaacgugguccauucacgcgcaucaccaauggaugaccacagaggacaugcuugcuguguggaauagagucuggaucgaagauaaccccuggauggaggacaagaccccugugacaaccugggagaauguucccuaccugggcaaacgcgaagaucaguggugugggagccucauuggccugacgucucgggccaccugggcccagaacaucccgacagcuauccagcaagugagaagccuuauuggaaaugaggaauuccuggacuacaugccuuccaugaagcgcuuucggaaagaggaggaaucugagggcgccaucugguga

SEQ ID NO: 20420 - RNA, 9873 nt, Artificial Sequence
  derived and/or modified CDS sequence (opt5) from DENV-3__GU131849__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccaucgaggcuauucugcccgaauauggcacacuggggcucgagugcuccccuagaaccggacuggacuucaaugagaugauccuucugacgaugaaaaacaaggccuggauggugcaccggcagugguuuuucgaucucccccugccguggaccagcggcgccacaaccgaaacaccuaccuggaaucgcaaagagcuucuggucacguuuaagaacgcucaugcgaaaaagcaagaagugguugugcucgggucucaggagggagccaugcacacagcucugaccggcgccacagaaauucagaauuccgggggcaccagcaucuucgccggacaccugaaguguagacucaaaauggacaagcuggagcuuaaaggcaugucuuacgcuaugugcaccaacacauuuguccugaagaaagagguguccgaaacgcagcaugggaccauccucauuaagguugaguaccggggagaagaugcccccuguaagaucccuuucagcacagaggacggccaagggaaagcgcacaacggaagacugauuaccgcuaaucccguggucacaaagaaagaggaacccgugaacaucgaggccgaaccuccguucggcgaguccaauauugugaucgggaucggcgauaacgcccugaagauuaauugguauaaaaagggaucuagcaucggcaagauguuugaagcuaccgcccgcggggcucggagaauggccauucuuggagacacggcgugggauuucggcuccguugggggaguccucaacagccugggcaaaauggugcaucagaucuuugggucugccuacacagcucuguucuccggcgugagcugggucaugaagauuggaaucggcauucuccugaccuggaucgggcuuaauucuaaaaacaccagcauguccuuuucuugcaucgccauuggaaucauuacacuguaucucggcgcugugguucaggccgacauggggugugugaucaauuggaagggaaaagagcugaagugcggcagcgggauuuucgucaccaacgaggugcacacauggacggaacaguacaaguuucaagcggauucccccaaacgccuggccaccgcuaucgccggcgcuugggagaauggaguuuguggcauccggagcacaaccagaauggaaaaccuucucuggaagcagauugccaaugagcugaacuauauccugugggaaaauaacauuaaacucacaguggucgugggggacaucauuggaguucuggagcagggcaagcgcacccuuacgccucagcccauggagcugaaauacucuuggaagaccugggggaaagccaagaucgugacagcugaaacccaaaacuccagcuucaucauugauggaccuaauacacccgagugcccgucugcgucccgggccuggaacgucugggaaguggaggacuauggcuuuggcguguucaccacaaauaucuggcucaagcugagagaagucuacacccagcugugugaccaucgccuuaugagcgcugccguuaaagaugagcgggccgugcacgcugacaugggguacuggauugagucccagaagaacggaucuuggaaacucgaaaaggccagccugaucgaggugaaaacgugcacauggccuaagucccacacccuguggucuaauggcguccucgaaagcgauaugauuauccccaagucccuggcggggccuaucagccagcauaaccacagacccggauaucauacccaaacagcuggcccuuggcaccuugggaaacuggagcucgacuuuaauuacugcgagggaaccacggugguuauuacagaaaacuguggcacccgcggccccucucugcggacaaccacaguguccgggaagcugauccacgaguggugcuguagaagcugcacccuuccgccucuccgguauaugggagaagauggcuguugguacgggauggagauucgccccaucucugaaaaagaggagaauauggucaagucccuggugagcgccggaucuggcaaaguugacaacuucacgaugggggugcugugccucgccauucuguuugaagaggucaugagaggaaaguucggcaagaaacauaugaucgcuggcguguucuuuaccuucguucuucugcucagcgggcagauuacauggcgggauaugacccacacacugaucaugaucggauccaaugccagcgacagaaugggcaugggggugaccuaucuggcgcuuauugcuacguuuaagauccagcccuuccuggcccucggauuuuuccugcgcaaacucacaucucgggaaaaccugcuucugggcgucgggcucgccauggcuaccaugcugcaacugccugaggauauugaacagauggccaauggaaucgcucuuggccugauggcccucaagcugauuacacaguuugagaccuaccagcucuggaccgcgcugaucucccuuacauguagcaacacgauguucacccugacaguggccuggagaaccgcuacacucauccuggccggcgugucccugcuuccggucugccaaucuagcuccaugcgcaaaaccgacuggcugcccauggcuguugccgccaugggggugccuccccucccucuguuuauuuucucucucaaggauacgcugaagagacggagcuggccccuuaaugagggagugauggcugucggccugguguccauccuggcgucuagccuccugcgcaacgacguuccuauggccgggccccuuguggcuggaggccugcucauugccuguuaugucaucacagggaccuccgccgaucugaccguggaaaaagcugccgacauuacaugggaggaagaggcggaacagaccggaguuagccauaaccucaugaucacaguggacgaugacggcacgaugagaaucaaggaugacgagaccgagaauauucugacaguccuucugaaaaccgcucugcucaucgugucuggcgucuuuccguacuccauuccugccacacugcuuguguggcacaccuggcagaagcagacgcaacggagcgggguucugugggaugugcccucuccucccgaaacccagaaagccgagcucgaagagggagucuaccgcaucaagcagcagggcauuuucgggaaaacacaagugggaguuggcgugcagaaggagggggucuuucauaccauguggcacgugacaagaggagcugugcugaccuauaacggcaagcggcucgaaccgaauugggccuccguuaaaaaggaccugaucagcuacggcgggggauggcgccuuucugcgcaguggcaaaaaggcgaggaaguccaggugauugcuguggagccugggaagaaccccaaaaauuuccagacaacgccuggaaccuuccagacaaccaccggcgaaaucggggccaucgcccuggauuuuaagcccggaacauccggcagccccauuaucaacagagagggcaaggucguggggcuguauggaaauggcguugugacgaaaaacgggggauacgucuccggcauugcucaaaccaaugccgagccugacgggccgacacccgaacucgaggaagagauguucaagaaacggaaccugaccaucauggaucuucacccuggcagcggaaagacacgcaaauaucugcccgcuauuaucagagaagccaucaagcggagacuccgcacccugauucucgcgccuacgcgggugguugccgcugagauggaggaagcccugaagggccuucccaucagauaccagacaaccgcuaccaaaucugagcauacagggcgcgaaauuguggaccugaugugccacgccaccuuuacaaugcggcugcucagcccugucagagugccgaauuauaaccugaucauuauggaugaggcccauuucaccgaccccgcuuccaucgcggcccgcggauacaucucuacgcggguuggcaugggggaagcugccgccauuuuuaugacagcuaccccucccggaacagccgaugcguucccucagagcaaugcucccauccaggacgaggagagagacauuccggaacgcuccuggaacucuggcaaugaguggaucaccgauuuugccgggaagacggugugguucgucccuagcauuaaagccggcaacgacaucgcuaacugucuucggaagaauggaaaaaaggugauucaacuguccagaaagaccuuugauacagaauaccagaaaaccaagcucaacgacugggauuucguggucacaaccgacaucucugagaugggcgccaauuuuaaagcggaucggguuaucgacccccgcagaugccugaagcccgugauucugacagaugggccugagcgggugauccucgccggacccaugccugucaccgcugccagcgcugcccagcgcagaggccggguggggagaaacccgcagaaagaaaaugaccaauauauuuucacgggacagccccuuaacaaugaugaggaccacgcucauuggacagaagccaagaugcugcuggacaacaucaauaccccugagggcauuauccccgcgcucuucgaaccugagcgcgagaaguccgccgcuaucgauggggaauaccggcugaaaggcgagagcagaaagaccuuuguugaacuuaugcgccggggagaccugcccguguggcucgcccacaaagucgcuucugagggcauuaaguauacagauagaaaauggugcuucgacgggcagcgcaacaaucagauccuggaagagaacauggauguggagauuuggaccaaggaaggagagaaaaagaagcugcggccgagauggcucgacgcccgcacauacuccgauccucuugcccugaaagaauuuaaggacuucgcugcgggcagaaaaagcaucgcccuggaucucguuacggagauugggcgggugcccucucaccuggcucaucgcaccagaaaugcccuugacaaccuggucaugcuccacacauccgaacauggaggccgggccuaucgccacgcuguggaggagcugccugaaaccauggagacacugcuccuucugggccugaugauccuccugaccgggggagccaugcuuuuucugaucagcggcaaggggauuggaaaaacguccaucggccucauuugugucaucgcgucuagcgggaugcuguggauggccgaaauuccccugcaauggaucgcuuccgccauugugcucgaguucuuuaugaugguucuucugaucccugagcccgaaaagcagagaaccccgcaggauaaucaacuggcuuacguggugaucggaauucucacacuggccgcgaucauugccgcuaacgagaugggccuucuggaaaccacaaagcgggaccucggcaugagcaaagagccuggggucguuucucccaccuccuaucuggauguggaccugcaccccgccagcgcuuggacgcucuacgccguggcuacaaccgucaucacaccuaugcuuagacauaccauugaaaauucuaccgccaacgugagccuggcggccaucgcuaaccaggccguugugcugaugggacucgacaagggcuggccgaucuccaaaauggaucugggggucccccuucuggcucucggaugcuacucucaggugaauccucugacacugacggccgccguccuccuucugauuacccacuaugcgaucauuggccccgggcugcaggcuaaggccacacgcgaggcucaaaaacggaccgccgccggaaucaugaagaacccuacaguggacggcauuaugaccaucgaucucgaccccguuaucuacgauagcaaguucgagaaacagcugggccaggugaugcuucugguccucugugcugugcagcugcugcucaugagaacguccugggcccuuugcgaagcgcugacacuggccaccgggccuauuaccacacucugggagggaucuccgggcaaguuuuggaauaccacaaucgcuguuagcauggccaacauuuuccgcggguccuaucuggcuggagccggccuugcguuuagcaucaugaaaucuguggggacgggaaagcggggcaccggcucccaaggggaaacacugggagagaaauggaagaagaaacucaaucagcugagcagaaaggaauucgaccuguacaaaaaguccggcauuaccgaggucgaucggacagaggccaaagaagggcucaagcgcggagagaucacccaucacgcugugucuagaggcagcgccaaacuucagugguuuguggaacggaacaugguuauucccgaggggcgcgucaucgaccugggauguggcagaggcgggugguccuauuacugcgcuggacugaagaaggugacggaagugcggggcuauaccaaagggggaccuggccaugaggagcccgucccuaugucuacauacggguggaauaucguuaagcucaugagcggaaaagauguguucuaccugcccccggaaaagugugacacccuucugugcgauauuggcgaguccagcccuucucccacaguggaagagucccgcaccaucagaguccucaaaaugguggagcccuggcugaagaacaaucaguucuguauuaagguucugaacccuuauaugcccacagugaucgaacaccucgagcggcuucaacgcaaacacggcgggaugcuggucagaaauccucugagccggaacucuacccaugaaauguacuggauuuccaauggaacgggcaacaucguggccagcguuaauauggugucuagacuccugcuuaaccgcuuuacaaugacccaccggagaccgaccaucgagaaggacgucgaucugggggcuggaacacgccaugugaacgccgaacccgagacgccuaauauggacgugauuggcgagcggaucaaaagaauuaaggaagagcacaacagcaccuggcacuaugacgaugaaaaucccuacaaaacaugggcguaucauggguccuacgaggucaaggccaccggaucugcuagcuccaugaucaacggcguugugaagcuccugacaaaaccuugggacgugguccccauggugacccagauggccaugacagauaccacgccguucggccagcaacgcguuuuuaaggaaaaaguggacacccggacaccuagaagcaugcccgggacccgccgggucauggagauuacagcugaguggcuguggagaacccucggacgcaauaagaaaccucggcugugcacgagagaagaguucacaaagaaggugcgcaccaacgccgccaugggcgcgguuuuuacagaagagaaucagugggauuccgcuaaagccgccguggaagacgaggauuucuggaagcuugucgacagagagcgggaacugcacaaacucgggaaguguggaucuugcguguauaacaugaugggcaaacgcgagaagaaacugggggaauuuggcaaggcuaagggaagcagagccaucugguacauguggcuuggcgcucgguaccuggaguucgaggcccucggguuucugaaugaagaucauugguucuccagagagaacucuuauagcggaguugaaggcgaggggcugcacaaacucggauacauccugcgggacauuuccaagauccccggcggggcgauguaugccgaugacaccgcuggcugggacacgcgcauuaccgaagaugaccuucauaaugaggagaaaaucacacagcagauggauccugaacacagacaacuggccaacgcuauuuuuaagcucaccuaccagaauaaaguggucaaggugcagcggcccacaccgaccggaacagucauggacaucaucucucgcaaggaucagagaggcagcgggcaagugggaaccuauggccugaacacguucacaaauauggaggcccagcuuauucggcagauggaaggggagggaguucuguccaaagcggaccucgaaaacagccaccugccugagaagaaaaucacccaguggcuggagaccaagggcguggaacgccucaaaagaauggccauuucuggggaugacugcgucgugaagcccaucgaugaccgguuugcuaacgcccugcuugcucugaaugauaugggcaaggugcgcaaagacauuccccaauggcagccuuccaagggauggcaugauuggcagcagguuccguucuguagccaccauuuccacgagcucaucaugaaagacggcagaaagcuggugguccccugccggccucaagacgaacuuauugggcgcgccagaaucucucagggagcuggcuggucccugcgggagacagccugucucgggaaagcguacgcccagauguggagccugauguauuuucaccgcagagaucugcggcucgcuucuaacgccaucugcuccgccgugcccguucauugggugccuaccagcagaacaacgugguccauucacgcucaucaccaauggaugaccacagaagacaugcugaccgucuggaaucgcguguggaucgaggauaaccccuggauggaggacaagacaccugucaccacgugggaaaaugugcccuaccuuggaaagcgggaggaucagugguguggcagccugauugggcucaccucuagagccacaugggcgcagaacaucccgaccgcuauucagcaaguucgcagccugaucggcaaugaagaguuccuugacuacaugccuuccaugaaacgguuuagaaaggaggaagagucugaaggagccaucugguga

SEQ ID NO: 20421 - RNA, 9873 nt, Artificial Sequence
  derived and/or modified CDS sequence (opt5) from DENV-3__GQ868546__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaagcggcgccaccacagaaaccccuacguggaaucgcaaagagcuucuggucacauuuaagaacgcucaugcgaaaaagcaagaagugguugugcucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuuguccugaagaaagagguguccgaaacccagcaugggacaauccucaucaagguugaguaccggggagaagaugcccccuguaagauuccuuucagcaccgaggacggccaagggaaagcgcacaacggaagacugaucacagcuaaucccguggucaccaagaaagaggaacccgugaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguugggggaguccucaacagccugggcaaaauggugcaucagauuuuugggucugccuacaccgcucuguucuccggcgugagcugggucaugaagaucggaauuggcauccuccugaccuggauugggcuuaauucuaaaaacacaagcauguccuuuucuugcaucgccaucggaauuaucacccuguaucucggcgcugugguucaggccgacauggggugugugauuaauuggaagggaaaagagcugaagugcggcagcgggaucuucgucacaaacgaggugcacacguggaccgaacaguacaaguuucaagcggauucccccaaacgccuggccacagcuauugccggcgcuugggagaauggaguuuguggcauccggagcaccacaagaauggaaaaccuucucuggaagcagaucgccaaugagcugaacuauauucugugggaaaauaacaucaaacucaccguggucgugggggacauuaucggaguucuggagcagggcaagcgcacgcuuaccccucagcccauggagcugaaauacucuuggaagacaugggggaaagccaagauugugaccgcugaaacacaaaacuccagcuucaucaucgauggaccuaauacccccgagugcccgucugcgucccgggccuggaacgucugggaaguggaggacuauggcuuuggcguguucacaaccaauauuuggcucaagcugagagaagucuacacgcagcugugugaccaucgccuuaugagcgcugccguuaaagaugagcgggccgugcacgcugacaugggguacuggaucgagucccagaagaacggaucuuggaaacucgaaaaggccagccugauugaggugaaaacaugcaccuggccuaagucccacacccuguggucuaauggcguccucgaaagcgauaugaucauucccaagucccuggcggggccuaucagccagcauaaccacagacccggauaucauacacaaaccgcuggcccuuggcaccuugggaaacuggagcucgacuuuaauuacugcgagggaacgacagugguuaucaccgaaaacuguggcacacgcggccccucucugcggaccacaaccguguccgggaagcugauucacgaguggugcuguagaagcugcacgcuuccgccucuccgguauaugggagaagauggcuguugguacgggauggagauccgccccauuucugaaaaagaggagaauauggucaagucccuggugagcgccggaucuggcaaaguugacaacuucaccaugggggugcugugccucgccauccuguuugaagaggucaugagaggaaaguucggcaagaaacauaugauugcuggcguguucuuuacauucguucuucugcucagcgggcagaucaccuggcgggauaugacacacacccugauuaugaucggauccaaugccagcgacagaaugggcaugggggugacguaucuggcgcuuaucgcuacauuuaagauucagcccuuccuggcccucggauuuuuccugcgcaaacucaccucucgggaaaaccugcuucugggcgucgggcucgccauggcuacaacccugcaacugccugaggauaucgaacagauggccaauggaauugcucuuggccugauggcccucaagcugaucacccaguuugagacauaccagcucuggacggcgcugauuucccuuaccuguagcaacacaauguucacccugacaguggccuggagaaccgcuacgcucauccuggccggcgugucccugcuuccggucugccaaucuagcuccaugcgcaaaacagacuggcugcccauggcuguugccgccaugggggugccuccccucccucuguuuaucuucucucucaaggauacccugaagagacggagcuggccccuuaaugagggagugauggcugucggccugguguccauucuggcgucuagccuccugcgcaacgacguuccuauggccgggccccuuguggcuggaggccugcucaucgccuguuaugucauuaccgggacauccgccgaucugaccguggaaaaagcugccgacaucacaugggaggaagaggcggaacagacgggaguuagccauaaccucaugauuaccguggacgaugacggcacaaugagaaucaaggaugacgagaccgagaauauccugacaguccuucugaaaaccgcucugcucauugugucuggcgucuuuccguacuccaucccugccacgcugcuuguguggcacaccuggcagaagcagacacaacggagcgggguucugugggaugugcccucuccucccgaaacccagaaagccgagcucgaagagggagucuaccgcauuaagcagcagggcaucuucgggaaaacacaagugggaguuggcgugcagaaggagggggucuuucauaccauguggcacgugacaagaggagcugugcugacguauaacggcaagcggcucgaaccgaauugggccuccguuaaaaaggaccugauuagcuacggcgggggauggcgccuuucugcgcaguggcaaaaaggcgaggaaguccaggugaucgcuguggagccugggaagaaccccaaaaauuuccagaccacaccuggaaccuuccagaccacaacgggcgaaauuggggccaucgcccuggauuuuaagcccggaaccuccggcagccccaucauuaacagagagggcaaggucguggggcuguauggaaauggcguugugacaaaaaacgggggauacgucuccggcaucgcucaaaccaaugccgagccugacgggccgacacccgaacucgaggaagagauguucaagaaacggaaccugaccauuauggaucuucacccuggcagcggaaagacgcgcaaauaucugcccgcuaucauuagagaagccaucaagcggagacuccgcacacugauccucgcgccuacccgggugguugccgcugagauggaggaagcccugaagggccuucccauuagauaccagaccacagcuaccaaaucugagcauacagggcgcgaaaucguggaccugaugugccacgccaccuuuacgaugcggcugcucagcccugucagagugccgaauuauaaccugauuaucauggaugaggcccauuucacagaccccgcuuccauugcggcccgcggauacaucucuacccggguuggcaugggggaagcugccgccaucuuuaugacagcuaccccucccggaacggccgaugcguucccucagagcaaugcucccauucaggacgaggagagagacaucccggaacgcuccuggaacucuggcaaugaguggauuaccgauuuugccgggaagacagugugguucgucccuagcaucaaagccggcaacgacauugcuaacugucuucggaagaauggaaaaaaggugauccaacuguccagaaagaccuuugauacagaauaccagaaaaccaagcucaacgacugggauuucguggucacaaccgacauuucugagaugggcgccaauuuuaaagcggaucggguuaucgacccccgcagaugccugaagcccgugauccugacggaugggccugagcgggugauucucgccggacccaugccugucacagcugccagcgcugcccagcgcagaggccggguggggagaaacccgcagaaagaaaaugaccaauauaucuucaccggacagccccuuaacaaugaugaggaccacgcucauuggaccgaagccaagaugcugcuggacaacauuaauacaccugagggcaucauucccgcgcucuucgaaccugagcgcgagaaguccgccgcuaucgauggggaauaccggcugaaaggcgagagcagaaagaccuuuguugaacuuaugcgccggggagaccugcccguguggcucgcccacaaagucgcuucugagggcaucaaguauacagauagaaaauggugcuucgacgggcagcgcaacaaucagauucuggaagagaacauggauguggagaucuggacgaaggaaggagagaaaaagaagcugcggccgagauggcucgacgcccgcaccuacuccgauccucuugcccugaaagaauuuaaggacuucgcugcgggcagaaaaagcauugcccuggaucucguuacagagaucgggcgggugcccucucaccuggcucaucgcaccagaaaugcccuugacaaccuggucaugcuccacacauccgaacauggaggccgggccuaucgccacgcuguggaggagcugccugaaaccauggagacgcugcuccuucugggccugaugauucuccugaccgggggagccaugcuuuuucugaucagcggcaaggggaucggaaaaacauccauuggccucaucugugucauugcgucuagcgggaugcuguggauggccgaaaucccccugcaauggauugcuuccgccaucgugcucgaguucuuuaugaugguucuucugauuccugagcccgaaaagcagagaaccccgcaggauaaucaacuggcuuacguggugaucggaauccucacacuggccgcgauuaucgccgcuaacgagaugggccuucuggaaaccacgaagcgggaccucggcaugagcaaagagccuggggucguuucucccacauccuaucuggauguggaccugcaccccgccagcgcuuggacccucuacgccguggcuacaaccgucauuaccccuaugcuuagacauacaaucgaaaauucuacggccaacgugagccuggcggccauugcuaaccaggccguugugcugaugggacucgacaagggcuggccgaucuccaaaauggaucugggggucccccuucuggcucucggaugcuacucucaggugaauccucugacccugacagccgccguccuccuucugaucacccacuaugcgauuaucggccccgggcugcaggcuaaggccacacgcgaggcucaaaaacggaccgccgccggaauuaugaagaacccuacgguggacggcaucaugacaauugaucucgaccccguuaucuacgauagcaaguucgagaaacagcugggccaggugaugcuucugguccucugugcugugcagcugcugcucaugagaaccuccugggcccuuugcgaagcgcugacccuggccacagggccuaucaccacacucugggagggaucuccgggcaaguuuuggaauacgaccauugcuguuagcauggccaacaucuuccgcggguccuaucuggcuggagccggccuugcguuuagcauuaugaaaucuguggggacaggaaagcggggcaccggcucccaaggggaaacacugggagagaaauggaagaagaaacucaaucagcugagcagaaaggaauucgaccuguacaaaaaguccggcaucaccgaggucgaucggacggaggccaaagaagggcucaagcgcggagagauuacccaucacgcugugucuagaggcagcgccaaacuucagugguuuguggaacggaacaugguuauccccgaggggcgcgucauugaccugggauguggcagaggcgggugguccuauuacugcgcuggacugaagaaggugacagaagugcggggcuauaccaaagggggaccuggccaugaggagcccgucccuaugucuacauacggguggaauaucguuaagcucaugagcggaaaagauguguucuaccugcccccggaaaagugugacacccuucugugcgauaucggcgaguccagcccuucucccacaguggaagagucccgcaccauuagaguccucaaaaugguggagcccuggcugaagaacaaucaguucuguaucaagguucugaacccuuauaugcccacggugauugaacaccucgagcggcuucaacgcaaacacggcgggaugcuggucagaaauccucugagccggaacucuacacaugaaauguacuggaucuccaauggaaccggcaacauuguggccagcguuaauauggugucuagacuccugcuuaaccgcuuuaccaugacacaccggagaccgacgaucgagaaggacgucgaucugggggcuggaacccgccaugugaacgccgaacccgagacaccuaauauggacgugaucggcgagcggauuaaaagaaucaaggaagagcacaacagcaccuggcacuaugacgaugaaaaucccuacaaaacaugggcguaucauggguccuacgaggucaaggccaccggaucugcuagcuccaugauuaacggcguugugaagcuccugacaaaaccuugggacgugguccccauggugacccagauggccaugacggauaccacaccguucggccagcaacgcguuuuuaaggaaaaaguggacacccggacaccuagaagcaugcccgggacccgccgggucauggagaucacggcugaguggcuguggagaacacucggacgcaauaagaaaccucggcugugcaccagagaagaguucacaaagaaggugcgcaccaacgccgccaugggcgcgguuuuuacggaagagaaucagugggauuccgcuaaagccgccguggaagacgaggauuucuggaagcuugucgacagagagcgggaacugcacaaacucgggaaguguggaucuugcguguauaacaugaugggcaaacgcgagaagaaacugggggaauuuggcaaggcuaagggaagcagagccauuugguacauguggcuuggcgcucgguaccuggaguucgaggcccucggguuucugaaugaagaucauugguucuccagagagaacucuuauagcggaguugaaggcgaggggcugcacaaacucggauacauccugcgggacaucuccaagauucccggcggggcgauguaugccgaugacaccgcuggcugggacacacgcaucaccgaagaugaccuucauaaugaggagaaaauuacacagcagauggauccugaacacagacaacuggccaacgcuaucuuuaagcucaccuaccagaauaaaguggucaaggugcagcggcccacaccgaccggaacggucauggacauuaucucucgcaaggaucagagaggcagcgggcaagugggaacauauggccugaacaccuucaccaauauggaggcccagcuuauccggcagauggaaggggagggaguucuguccaaagcggaccucgaaaacccucaccugcccgagaagaaaauuacacaguggcuggagaccaagggcguggaacgccucaaaagaauggccaucagcggggaugacugcgucgugaagcccauugaugaccgguuugcuaacgcccugcuugcucugaaugauaugggcaaggugcgcaaagacaucccucaauggcagccgucuaagggauggcaugauuggcagcagguucccuucuguucccaccauuuccacgagcucauuaugaaagacggcagaaagcugguggucccuugccggccccaagacgaacuuaucgggcgcgccagaauuagccagggagcuggcuggucucugcgggagacagccugucucgggaaagcguacgcccagauguggucccugauguauuuucaccgcagagaucugcggcucgcuagcaacgccaucugcucugccgugccuguucauugggugcccacguccagaaccacauggagcauccacgcucaucaccaauggaugaccacagaagacaugcugaccgucuggaaucgcguguggauugaggauaacccuuggauggaggacaagacgcccgucaccacaugggaaaaugugccguaccuuggaaagcgggaggaucagugguguggcucccugaucgggcucaccagcagagccacaugggcgcagaacauuccuaccgcuauccagcaaguucgcucucugauuggcaaugaagaguuccuugacuacaugcccagcaugaaacgguuuagaaaggaggaagaguccgaaggagccaucugguga

SEQ ID NO: 20422 - RNA, 9873 nt, Artificial Sequence
  derived and/or modified CDS sequence (opt5) from DENV-3__GU131850__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaagcggcgccaccacagaaaccccuacguggaaucgcaaagagcuucuggucacauuuaagaacgcucaugcgaaaaagcaagaagugguugugcucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuuguccugaagaaagagguguccgaaacccagcaugggacaauccucaucaagguugaguaccggggagaagaugcccccuguaagauuccuuucagcaccgaggacggccaagggaaagcgcacaacggaagacugaucacagcuaaucccguggucauuaagaaagaggaacccgugaacaucgaggccgaaccuccguucggcgaguccaauauugugaucgggaucggcgauaacgcccugaagauuaauugguauaaaaagggaucuagcaucggcaagauguuugaagcuaccgcccgcggggcucggagaauggccauucuuggagacacggcgugggauuucggcuccguugggggaguccucaacagccugggcaaaauggugcaucagaucuuugggucugccuacacagcucuguucuccggcgugagcugggucaugaagauuggaaucggcauucuccugaccuggaucgggcuuaauucuaaaaacaccagcauguccuuuucuugcaucgccauuggaaucauuacacuguaucucggcgcugugguucaggccgacaucgggugugugauuaauuggaagggaaaagagcugaagugcggcagcgggaucuucgucaccaacgaggugcacacauggacggaacaguacaaguuucaagcggauucccccaaacgccuggccaccgcuaucgccggcgcuugggagaauggaguuuguggcauucggagcacaaccagaauggaaaaccuucucuggaagcagaucgccaaugagcugaacuauauucugugggaaaauaacaucaaacucacaguggucgugggggacauuaucggaguucuggagcagggcaagcgcacccuuacgccucagcccauggagcugaaauacucuuggaagaccugggggaaagccaagaucgugacagcugaaacccaaaacuccagcuucauuaucgauggaccuaauacacccgagugcccgucugcgucccgggccuggaacgucugggaaguggaggacuauggcuuuggcguguucaccacaaauauuuggcucaagcugagagaagucuacacccagcugugugaccaucgccuuaugagcgcugccguuaaagaugagcgggccgugcacgcugacaugggguacuggaucgagucccagaagaacggaucuuggaaacucgaaaaggccagccugauugaggugaaaacgugcacauggccuaagucccacacccuguggucuaauggcguccucgaaagcgauaugaucauccccaagucccuggcggggccuauuagccagcauaaccacagacccggauaucauacccaaacagcuggcccuuggcaccuugggaaacuggagcucgacuuuaauuacugcgagggaaccacggugguuaucacagaaaacuguggcacccgcggccccucucugcggacaaccacaguguccgggaagcugauucacgaguggugcuguagaagcugcacccuuccgccucuccgguauaugggagaagauggcuguugguacgggauggagauccgccccauuucugaaaaagaggagaauauggucaagucccuggugagcgccggaucuggcaaaguugacaacuucacgaugggggugcugugccucgccauccuguuugaagaggucaugagaggaaaguucggcaagaaacauaugauugcuggcguguucuuuaccuucguucuucugcucagcgggcagaucacauggcgggauaugacccacacacugaucaugauuggauccaaugccagcgacagaaugggcaugggggugaccuaucuggcgcuuaucgcuacguuuaagauucagcccuuccuggcccucggauuuuuccugcgcaaacucacaucucgggaaaaccugcuucugggcgucgggcucgccauggcuaccacacugcaacugccugaggauaucgaacagauggccaauggaauugcucuuggccugauggcccucaagcugaucacccaguuugagaccuaccagcucuggacagcgcugaucucccuuacguguagcaacaccauguucacacugaccguggccuggagaacagcuacccucauucuggccggcgugucccugcuuccggucugccaaucuagcuccaugcgcaaaacggacuggcugcccauggcuguugccgccaugggggugccuccccucccucuguuuaucuucucucucaaggauacacugaagagacggagcuggccccuuaaugagggagugauggcugucggccugguguccauucuggcgucuagccuccugcgcaacgacguuccuauggccgggccccuuguggcuggaggccugcucaucgccuguuaugucauuaccgggaccuccgccgaucugacaguggaaaaagcugccgacaucaccugggaggaagaggcggaacagacaggaguuagccauaaccucaugaucacgguggacgaugacggcaccaugagaauuaaggaugacgagacagagaauauccugaccguccuucugaaaacagcucugcucauugugucuggcgucuuuccguacuccaucccugccacccugcuuguguggcacacguggcagaagcagacccaacggagcgggguucugugggaugugcccucuccucccgaaacacagaaagccgagcucgaagagggagucuaccgcauuaagcagcagggcaucuucgggaaaacccaagugggaguuggcgugcagaaggagggggucuuucauacaauguggcacgugaccagaggagcugugcugacauauaacggcaagcggcucgaaccgaauugggccuccguuaaaaaggaccugauuagcuacggcgggggauggcgccuuucugcgcaguggcaaaaaggcgaggaaguccaggugaucgcuguggagccugggaagaaccccaaaaauuuccagacgaugccuggaaccuuccagacaaccaccggcgaaaucggggccauugcccuggauuuuaagcccggaacauccggcagccccaucauuaacagagagggcaaggucguggggcuguauggaaauggcguugugacgaaaaacgggggauacgucuccggcaucgcucaaaccaaugccgagccugacgggccgacacccgaacucgaggaagagauguucaagaaacggaaccugaccauuauggaucuucacccuggcagcggaaagacacgcaaauaucugcccgcuaucaucagagaagccauuaagcggagacuccgcacccugauccucgcgccuacgcgggugguugccgcugagauggaggaagcccugaagggccuucccauuagauaccagacaaccgcuaccaaaucugagcauacagggcgcgaaaucguggaccugaugugccacgccaccuuuacaaugcggcugcucagcccugucagagugccgaauuauaaccugauuaucauggaugaggcccauuucaccgaccccgcuuccaucgcggcccgcggauacauuucuacgcggguuggcaugggggaagcugccgccaucuuuaugacagcuaccccucccggaacagccgaugcguucccucagagcaaugcucccauucaggacgaggagagagacaucccggaacgcuccuggaacucuggcaaugaguggauuaccgauuuuguggggaagacggucugguucgugccuagcaucaaagccggcaacgacauugccaacugucuucggaagaauggaaaaaaggugauccaacuguccagaaagaccuuugauacagaauaccagaaaaccaagcucaacgacugggauuucgucguuacaaccgacaucucugagaugggcgcuaauuuuaaagccgaucgggugauugacccccgcagaugccugaagcccgugauccugacagaugggccugagcgggucauucucgcgggacccaugccugugaccgccgcuagcgccgcucagcgcagaggccggguugggagaaacccgcagaaagaaaaugaccaauauaucuucacgggacagccccuuaacaaugaugaggaccacgcccauuggacagaagcuaagaugcugcuggacaacauuaauaccccugagggcaucauccccgcccucuucgaaccugagcgcgagaaguccgcggccauugauggggaauaccggcugaaaggcgagagcagaaagaccuuuguggaacuuaugcgccggggagaccugcccgucuggcucgcucacaaaguggccucugagggcaucaaguauacagauagaaaauggugcuucgacgggcagcgcaacaaucagauucuggaagagaacauggauguugagaucuggaccaaggaaggagagaaaaagaagcugcggccgagauggcucgacgcucgcacauacuccgauccucuugcccugaaagaauuuaaggacuucgccgcuggcagaaaaagcauugcgcuggaucucgugacggagaucgggcggguccccucucaccuggcccaucgcaccagaaaugcucuugacaaccuggugaugcuccacacauccgaacauggaggccgggccuaucgccacgccgucgaggagcugccugaaaccauggagacacugcuccuucugggccugaugauccuccugaccgggggagcuaugcuuuuucugauuagcggcaaggggaucggaaaaacguccauuggccucaucugugugauugccucuagcgggaugcuguggauggcggaaaucccccugcaauggauugccuccgcuaucguucucgaguucuuuaugauggugcuucugaucccugagcccgaaaagcagagaaccccgcaggauaaucaacuggccuacguggucauuggaauccucacacuggcugccauuaucgcggccaacgagaugggccuucuggaaaccacaaagcgggaccucggcaugagcaaagagccugggguugugucucccaauuccuaucuggauguggaccugcaccccgcuagcgccuggacccucuacgcugucgccacgacagugauuaccccuaugcuuagacauacaaucgaaaacucuaccgcuaacguuagccuggccgcgaucgccaaucaggcugugguccugaugggacucgacaagggcuggccgauuuccaaaauggaucugggggugccccuucuggcccucggaugcuacucucaggucaacccucugacccugacagcugccgugcuccuucugaucacgcacuaugccauuaucggccccgggcugcaggcgaaggcuacccgcgaggcccaaaaacggacagcugccggaauuaugaagaauccuaccguugacggcaucaugacaaucgaucucgaccccgugauuuacgauagcaaguucgagaaacagcugggccaggucaugcuucuggugcucugugccguucagcugcugcucaugagaaccuccugggcucuuugcgaagcccugacgcuggcgacagggccuaucaccacccucugggagggaucuccgggcaaguuuuggaacacaaccauugccgugagcauggcuaauaucuuccgcggguccuaucuggccggagcuggccuugccuuuagcauuaugaaaucugucgggacaggaaagcggggcacgggcucccaaggggaaacccugggagagaaauggaagaagaaacucaaccagcugagcagaaaggaauucgaccuguacaaaaaguccggcaucacagagguggaucggaccgaggcgaaagaagggcucaagaaaggagagauuacacaucacgccgugucucgcggcagcgcuaagcuucagugguuuguugaaagaaauauggucauccccgaggggcgggugaucgaccugggauguggccgcggcgggugguccuauuacugcgccggacugaagaaagugaccgaagucagaggcuauacgaaggggggaccuggccaugaggagcccguuccuaugucuaccuacggguggaacauugugaaacucaugagcggaaaggauguguucuaccugcccccggaaaaaugugacacacuucugugcgauaucggcgaguccagcccuucucccaccgucgaagagucccggacaauucgcgugcucaagaugguugagcccuggcugaagaauaaccaguucuguaucaaagugcugaauccuuauaugcccaccgucauugaacaccucgagagacuucaacggaagcacggcgggaugcuggugcgcaacccucugagcagaaauucuacacaugaaauguacuggaucuccaacggaaccggcaauaucguugcuagcgugaacauggucucucggcuccugcuuaacagauuuacgaugacacaccgccggccgaccauugagaaagacguggaucugggggccggaaccagacaugugaaugcugaacccgagacaccuaacauggacgucaucggcgagcgcauuaagcggaucaaagaagagcacaauagcacguggcacuaugacgaugaaaaccccuacaagaccugggccuaucauggguccuacgagguuaaggcgacaggaucugccagcuccaugauuaauggcguggugaaacuccugaccaagccuugggacgucgugcccaugguuacacagauggcuaugaccgauacaaccccguucggccagcaaagaguguuuaaagaaaaggucgacacgcgcaccccucggagcaugcccgggacaagacgcgugaugggaaucaccgccgaguggcuguggcggacacucggcagaaacaaaaagccucgccugugcacccgggaggaauucacgaagaaaguuagaacaaaugcugccaugggggccguguuuaccgaggaaaaccagugggauuccgcgaaggcugccgucgaggacgaagauuucuggaaacuuguggaccgcgagagagagcugcacaagcucggaaaauguggcucuugcguuuauaauaugauggggaagcgggaaaaaaagcugggcgaguuuggaaaggccaaaggcagccgcgcuaucugguacauguggcuuggggccagauaccuggaauucgaggcucucggauuucugaacgaggaucauugguucucccgggaaaauucuuauagcggcguggagggggaaggacugcacaagcucggcuacauucugagagacaucuccaaaauucccgggggcgccauguaugcggaugacacagccggaugggacacccggaucacggaggaugaccuucauaacgaagagaagauuacccagcagauggauccugagcaccgccaacuggcuaaugccaucuuuaaacucacauaccagaacaaggucgugaagguccagagacccaccccgacaggcaccgugauggacaucauuucucggaaagaucagcgcgggagcggacaaguuggcacauaugggcugaauaccuucacgaacauggaagcucagcuuaucagacagauggagggagaaggcgugcuguccaaggccgaccucgagaacccucaccugcccgaaaaaaagauuacacaguggcuggagaccaaaggggucgagcggcucaagcgcauggcgaucagcggcgaugacugcguggugaagcccauugaugacagauuugccaaugcucugcuugcccugaacgauaugggaaaaguucggaaggacaucccucaauggcagccgucuaaaggcuggcaugauuggcagcaggugcccuucuguucccaccauuuccacgaacucauuaugaaggacgggcgcaaacuggucgugccuugcagaccccaagacgagcuuaucggacgggcucgcaucagccagggcgccggguggucucugagagaaaccgcuugucucggaaaggccuacgcgcagauguggucccugauguauuuucaccggcgcgaucugagacucgccagcaaugcuauuugcucugccguuccugugcauuggguccccacaucccggaccacauggagcauccacgcccaucaccaauggaugacgaccgaggacaugcugacaguguggaacagagucuggauugaagauaauccuuggauggaggacaagacccccgugacaaccugggagaacguuccguaccuuggcaaacgcgaagaucaguggugugggucccugaucggccucacgagccgggcuaccugggcccagaauauuccuacagcgauccagcaagugagaucucugaucggaaacgaggaauuccuugacuacaugcccagcaugaagcgcuuucggaaagaggaggaauccgagggcgcuauuugguga

SEQ ID NO: 20423 - RNA, 9873 nt, Artificial Sequence
  derived and/or modified CDS sequence (opt5) from DENV-3__GU131851__SS-prME
accagccugugccucgugaugauccugcccgccgcucuugccuuccaccugacauccagagacggcgagccucauaugauugucgggaagaacgaacggggaaaaucucuccuguuuaagacggcgagcggcaucaauauguguacccuuauugcuauggaucugggggagaugugcgacgauacaguuaccuacaaauguccgcacaucacagaaguggagcccgaagacauugauugcugguguaaccucaccuccacaugggugaccuauggaacgugcaaucaggccggcgagcgcagacgggacaagcgcucugucgcccuggcuccucauguggggaugggacuggauaccagaacacaaaccuggaugagcgccgagggcgcuuggcggcagguugaaaaaguggagacaugggcccuccgccaccccggcuucaccauccuggcgcuuuuucuggcccauuacaucgggacgucccucacacagaaggucgugauuuucauccugcuuaugcugguuaccccuucuaugacaaugagaugugugggagucggcaaccgggacuuuguggaagggcucagcggagcuaccuggguggaugucguucuggagcacggcgggugcgugaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuaugucuguaaacacaccuacguggaucggggcugggggaacggaugcggccuguucgggaagggaagccuuguuaccugcgccaaguuucaaugucuggagcccauugagggcaaagugguccaguaugaaaaucucaaguacacagugaucaucaccguucauacaggggaccagcaccaggugggaaacgagacgcaaggcgucaccgcugaaauuacaccucaggccucuaccacagaggcuauccugcccgaauauggcacccuggggcucgagugcuccccucgcacgggacuggacuucaaugagaugauucuucugaccaugaaaaacaaggccuggauggugcauagacaguggcucuuugaucugccccuuccguggacaagcggcgccaccacagaaaccccuacguggaaucggaaagagcugcucgucacauucaagaacgcucacgcgaaaaagcaagaagugguugugcuggggucucaggagggagccaugcacaccgcucugacaggcgccaccgaaauccagaauuccgggggcaccagcauuuuugccggacaucucaagugucgccugaaaauggacaagcuugagcugaaaggcaugucuuacgcuaugugcacaaacacguucguccucaagaaagagguguccgaaacccagcacgggacaauccugaucaagguugaguacagaggagaagaugcccccuguaagauuccuuuuagcaccgaggacggccaagggaaagcgcauaacggacggcugaucacagcuaaucccguggucaccaagaaagaggaacccgugaacauugaggccgaaccuccguucggcgaguccaauaucgugauugggaucggcgauaacgcccuuaagaucaauugguauaaaaagggaucuagcauuggcaagauguucgaagcuacggccagaggggcucgccggauggccauccucggagacacagcgugggauuuuggcuccguugggggaguccugaacagccugggcaaaauggugcaccagauuuucgggucugccuacaccgcucucuuuuccggcgugagcugggucaugaagaucggaauuggcauccugcuuaccuggauugggcugaauucuaaaaacacaagcauguccuucucuugcaucgccaucggaauuaucacccucuaucugggcgcugugguucaggccgacauggggugugugauuaauuggaagggaaaagagcugaagugcggcagcgggaucuuugucacaaacgaggugcauacguggaccgaacaguacaaguuccaagcggauucccccaaaagacuugccacagcuauugccggcgcuugggagaauggaguuuguggcauccgcagcaccacacggauggaaaaccuccuguggaagcagaucgccaaugagcugaacuauauucucugggaaaauaacaucaaacugaccguggucgugggggacauuaucggaguucuugagcagggcaagagaacgcugaccccucagcccauggagcucaaauacucuuggaagacaugggggaaagccaagauugugaccgcugaaacacaaaacuccagcuuuaucaucgauggaccuaauacccccgagugcccgucugcgucccgcgccuggaacgucugggaaguggaggacuauggcuucggcguguuuacaaccaauauuuggcugaagcugcgggaagucuacacgcagcuuugugaccacagacucaugagcgcugccguuaaagaugagcgcgccgugcacgcugacaugggguacuggaucgagucccagaagaacggaucuuggaaacuggaaaaggccagccugauugaggugaaaacaugcaccuggccuaagucccauacccucuggucuaauggcguccuggaaagcgauaugaucauucccaagucccuugcggggccuaucagccagcacaaccaucggcccggauaucacacacaaaccgcuggcccuuggcaccuggggaaacucgagcuggacuucaauuacugcgagggaacgacagugguuaucaccgaaaacuguggcacaagaggccccucucugcgcaccacaaccguguccgggaagcuuauucaugaguggugcugucggagcugcacgcucccgccucugagauauaugggagaagauggcuguugguacgggauggagauccggcccauuucugaaaaagaggagaauauggucaagucccuggugagcgccggaucuggcaaaguugacaacuuuaccaugggggugcucugccuggccauccuuuucgaagaggucaugcgcggaaaguuuggcaagaaacacaugauugcuggcguguucuucacauuuguucugcuccugagcgggcagaucaccuggagagauaugacacauacccugauuaugaucggauccaaugccagcgaccggaugggcaugggggugacguaucuugcgcugaucgcuacauucaagauucagcccuuucucgcccugggauucuuucucagaaaacugaccucucgcgaaaaccuucugcucggcgucgggcuggccauggcuacaacccugcaacuuccugaggauaucgaacagauggccaauggaauugcucugggccucauggcccugaagcucaucacccaguucgagacauaccagcuguggacggcgcuuauuucccugaccuguagcaacacaauguuuacccucacaguggccuggcggaccgcuacgcugauccuggccggcgugucccuucugccggucugccaaucuagcuccaugagaaaaacagacuggcuccccauggcuguugccgccaugggggugccuccccugccucucuucaucuuuucucugaaggauacccuuaagcgcagaagcuggccccugaaugagggagugauggcugucggccugguguccauucucgcgucuagccugcuucggaacgacguuccuauggccgggccccugguggcuggaggccuccugaucgccuguuaugucauuaccgggacauccgccgaucucaccguggaaaaagcugccgacaucacaugggaggaagaggcggaacagacgggaguuagccacaaccugaugauuaccguggacgaugacggcacaaugcgcaucaaggaugacgagaccgagaauauccuuacaguccugcugaaaaccgcucuccugauugugucuggcgucuucccguacuccaucccugccacgcuucugguguggcauaccuggcagaagcagacacaaagaagcgggguucucugggaugugcccucuccucccgaaacccagaaagccgagcuggaagagggagucuaccggauuaagcagcagggcaucuuugggaaaacacaagugggaguuggcgugcagaaggagggggucuuccacaccauguggcacgugacacgcggagcugugcucacguauaacggcaagagacuggaaccgaauugggccuccguuaaaaaggaccuuauuagcuacggcgggggauggcggcugucugcgcaguggcaaaaaggcgaggaaguccaggugaucgcuguggagccugggaagaaccccaaaaauuuucagaccacaccuggaaccuuccagaccacaacgggcgaaauuggggccaucgcccuggauuucaagcccggaaccuccggcagccccaucauuaaccgcgagggcaaggucguggggcucuauggaaauggcguugugacaaaaaacgggggauacgucuccggcaucgcucaaaccaaugccgagccugacgggccgacacccgaacuggaggaagagauguuuaagaaaagaaaccuuaccauuauggaucugcauccuggcagcggaaagacgcggaaauaucuccccgcuaucauucgcgaagccaucaagagacggcugagaacacucauccuggcgccuacccgcgugguugccgcugagauggaggaagcccuuaagggccugcccauucgguaccagaccacagcuaccaaaucugagcacacagggagagaaaucguggaccugaugugccaugccaccuucacgaugcgccuccugagcccuguccgggugccgaauuauaaccuuauuaucauggaugaggcccacuuuacagaccccgcuuccauugcggccagaggauacaucucuacccgcguuggcaugggggaagcugccgccaucuucaugacagcuaccccucccggaacggccgaugcguuuccucagagcaaugcucccauucaggacgaggagcgggacaucccggaaagauccuggaacucuggcaaugaguggauuaccgauuucgccgggaagacagugugguuugucccuagcaucaaagccggcaacgacauugcuaacugucugcgcaagaauggaaaaaaggugauccaacucucccggaagaccuucgauacagaauaccagaaaaccaagcugaacgacugggauuuuguggucacaaccgacauuucugagaugggcgccaauuucaaagcggauagaguuaucgacccccggcgcugccugaagcccgugauccucacggaugggccugagagagugauucuugccggacccaugccugucacagcugccagcgcugcccagcggcgcggcagaguggggcggaacccgcagaaagaaaaugaccaauauaucuuuaccggacagccccugaacaaugaugaggaccaugcucacuggaccgaagccaagaugcugcucgacaacauuaauacaccugagggcaucauucccgcgcuguucgaaccugagagagagaaguccgccgcuaucgauggggaauaccgccuuaaaggcgagagccggaagaccuucguugaacugaugagacgcggagaccuccccguguggcuggcccacaaagucgcuucugagggcaucaaguauacagaucggaaauggugcuuugacgggcagagaaacaaucagauucuggaagagaacauggauguggagaucuggacgaaggaaggagagaaaaagaagcuccgcccgcgguggcuugacgccagaaccuacuccgauccucuggcccugaaagaauucaaggacuuugcugcgggccgcaaaagcauugcccucgaucugguuacagagaucgggagagugcccucucaucuugcucaccggacccgcaaugcccuggacaaccucgucaugcugcauacauccgaacacggaggcagagccuaucggcacgcuguggaggagcugccugaaaccauggagacgcuccuucugcugggccucaugauucugcuuaccgggggagccaugcuguuccucaucagcggcaaggggaucggaaaaacauccauuggccugaucugugucauugcgucuagcgggaugcuguggauggccgaaaucccccuccaauggauugcuuccgccaucgugcuugaguuuuucaugaugguucugcugauuccugagcccgaaaagcagcgcaccccgcaggauaaucaacucgcuuacguggugaucggaauccugacacuugccgcgauuaucgccgcuaacgagaugggccugcucgaaaccacgaagagagaccugggcaugagcaaagagccuggggucguuucucccacauccuaucuggauguggaccuccaucccgccagcgcuuggacccuuuacgccguggcuacaaccgucauuaccccuaugcugcggcacacaaucgaaaauucuacggccaacgugagccuggcggccauugcuaaccaggccguugugcucaugggacuggacaagggcuggccgaucuccaaaauggaucuuggggucccccugcucgcucugggaugcuacucucaggugaauccucugacccucacagccgccguccuucugcugaucacccauuaugcgauuaucggccccgggcuccaggcuaaggccacaagagaggcucaaaaacgcaccgccgccggaauuaugaagaacccuacgguggacggcaucaugacaauugaucuggaccccguuaucuacgauagcaaguuugagaaacagcuuggccaggugaugcugcucguccugugugcugugcagcugcuccuuaugcggaccuccugggcccugugcgaagcgcugacccucgccacagggccuaucaccacacugugggagggaucuccgggcaaguucuggaauacgaccauugcuguuagcauggccaacaucuuuagaggguccuaucuugcuggagccggccuggcguucagcauuaugaaaucuguggggacaggaaagcgcggcaccggcucccaaggggaaacacucggagagaaauggaagaagaaacugaaucagcugagccggaaggaauuugaccucuacaaaaaguccggcaucaccgaggucgauagaacggaggccaaagaagggcuuaagcggggagagauuacccaccaugcugugucucgcggcagcgccaaacugcagugguucguggaaagaaacaugguuauccccgaggggcgggucauugaccugggauguggccgcggcgggugguccuauuacugcgcuggacucaagaaggugacagaagugagaggcuauaccaaagggggaccuggccacgaggagcccgucccuaugucuacauacggguggaauaucguuaagcugaugagcggaaaagauguguuuuaccuucccccggaaaagugugacacccugcucugcgauaucggcgaguccagcccuucucccacaguggaagagucccggaccauucgcguccugaaaaugguggagcccuggcugaagaacaaucaguucuguaucaagguucucaacccuuauaugcccacggugauugaacaccuugagagacugcaacggaaacauggcgggaugcugguccgcaauccucucagcagaaacucuacacacgaaauguacuggaucuccaauggaaccggcaacauuguggccagcguuaauauggugucucggcugcuucugaacagauucaccaugacacaucgccggccgacgaucgagaaggacgucgaucucggggcuggaaccagacacgugaacgccgaacccgagacaccuaauauggacgugaucggcgagcgcauuaaacggaucaaggaagagcacaacagcaccuggcauuaugacgaugaaaaucccuacaaaacaugggcguaucacggguccuacgaggucaaggccaccggaucugcuagcuccaugauuaacggcguugugaagcugcugacaaaaccuugggacgugguccccauggugacccagauggccaugacggauaccacaccguuuggccagcaaagaguuuucaaggaaaaaguggacacccgcacaccucggagcaugcccgggaccagacgcgucauggagaucacggcugaguggcucuggcggacacugggaagaaauaagaaaccucgccuuugcacccgggaagaguuuacaaagaaggugagaaccaacgccgccaugggcgcgguuuucacggaagagaaucagugggauuccgcuaaagccgccguggaagacgaggauuuuuggaagcuggucgaccgcgagagagaacuccauaaacuggggaaguguggaucuugcguguauaacaugaugggcaaacgggagaagaaacuuggggaauucggcaaggcuaagggaagccgcgccauuugguacauguggcugggcgcuagauaccucgaguuugaggcccugggguuccugaaugaagaucacugguuuucccgggagaacucuuauagcggaguugaaggcgaggggcuccauaaacugggauacauccuuagagacaucuccaagauucccggcggggcgauguaugccgaugacaccgcuggcugggacacacggaucaccgaagaugaccugcacaaugaggagaaaauuacacagcagauggauccugaacaccgccaacucgccaacgcuaucuucaagcugaccuaccagaauaaaguggucaaggugcagagacccacaccgaccggaacggucauggacauuaucucucggaaggaucagcgcggcagcgggcaagugggaacauauggccuuaacaccuuuaccaauauggaggcccagcugaucagacagauggaaggggagggaguucucuccaaagcggaccuggaaaacccucaucugcccgagaagaaaauuacacaguggcucgagaccaagggcguggaacggcugaaacgcauggccaucagcggggaugacugcgucgugaagcccauugaugacagauucgcuaacgcccuucuggcucucaaugauaugggcaaggugcggaaagacaucccucaauggcagccgucuaagggauggcacgauuggcagcagguucccuuuuguucccaucacuuccacgagcugauuaugaaagacggccgcaagcuuguggucccuugcagaccccaagacgaacugaucgggcgggcccgcauuagccagggagcuggcuggucucucagagagacagccugucuggggaaagcguacgcccagauguggucccugauguauuuccaucggcgcgaucucagacuggcuagcaacgccaucugcucugccgugccuguucacugggugcccacgucccggaccacauggagcauccaugcucaccaucaauggaugaccacagaagacaugcuuaccgucuggaauagaguguggauugaggauaacccuuggauggaggacaagacgcccgucaccacaugggaaaaugugccguaccugggaaagcgcgaggaucagugguguggcucccucaucgggcugaccagccgggccacaugggcgcagaacauuccuaccgcuauccagcaaguuagaucucuuauuggcaaugaagaguuucuggacuacaugcccagcaugaaacgcuuccggaaggaggaagaguccgaaggagccaucugguga

SEQ ID NO: 20424 - RNA, 9873 nt, Artificial Sequence
  derived and/or modified CDS sequence (opt5) from DENV-3__GQ868547__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaagcggcgccaccacagaaaccccuacguggaaucgcaaagagcuucuggucacauuuaagaacgcucaugcgaaaaagcaagaagugguugugcucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuuguccugaagaaagagguguccgaaacccagcaugggacaauccucaucaagguugaguaccggggagaagaugcccccuguaagauuccuuucagcaccgaggacggccaagggaaagcgcacaacggaagacugaucacagcuaaucccguggucaccaagaaagaggaacccgugaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguugggggaguccucaacagccugggcaaaauggugcaucagauuuuugggucugccuacaccgcucuguucuccggcgugagcugggucaugaagaucggaauuggcauccuccugaccuggauugggcuuaauucuaaaaacacaagcauguccuuuucuugcaucgccaucggaauuaucacccuguaucucggcgcugugguucaggccgacauggggugugugauuaauuggaagggaaaagagcugaagugcggcagcgggaucuucgucacaaacgaggugcacacguggaccgaacaguacaaguuucaagcggauucccccaaacgccuggccacagcuauugccggcgcuugggagaauggaguuuguggcauccggagcaccacaagaauggaaaaccuucucuggaagcagaucgccaaugagcugaacuauauucugugggaaaauaacaucaaacucaccguggucgugggggacauuaucggaguucuggagcagggcaagcgcacgcuuaccccucagcccauggagcugaaauacucuuggaagacaugggggaaagccaagauggugaccgcugaaacacaaaacuccagcuucauuaucgauggaccuaauacccccgagugcccgucugcgucccgggccuggaacgucugggaaguggaggacuauggcuuuggcguguucacaaccaauaucuggcucaagcugagagaaguccauacgcagcugugugaccaccgccuuaugagcgcugccguuaaagaugagcgggccgugcacgcugacaugggguacuggauugagucccagaagaacggaucuuggaaacucgaaaaggccagccugaucgaggugaaaacaugcaccuggccuaagucccauacccuguggucuaauggcguccucgaaagcgauaugauuauccccaagucccuggcggggccuauuagccagcacaaccauagacccggauaccacacacaaaccgcuggcccuuggcaccuugggaaacuggagcucgacuuuaauuauugcgagggaacgacagugguuaucaccgaaaacuguggcacacgcggccccucucugcggaccacaaccguguccgggaagcugauccaugaguggugcuguagaagcugcacgcuuccgccucuccgguacaugggagaagauggcuguugguaugggauggagauucgccccaucucugaaaaagaggagaauauggucaagucccuggugagcgccggaucuggcaaaguugacaacuucaccaugggggugcugugccucgccauucuguuugaagaggucaugagaggaaaguucggcaagaaacacaugaucgcuggcguguucuuuacauucguucuucugcucagcgggcagauuaccuggcgggauaugacacauacccugaucaugauuggauccaaugccagcgacagaaugggcaugggggugacguaccuggcgcuuaucgcuacauuuaagauccagcccuuccuggcccucggauuuuuccugcgcaaacucaccucucgggaaaaccugcuucugggcgucgggcucgccauggcuacaacccugcaacugccugaggauauugaacagauggccaauggaaucgcucuuggccugauggcccucaagcugauuacccaguuugagacauaucagcucuggacggcgcugaucucccuuaccuguagcaacacaauguucacccugacaguggccuggagaaccgcuacgcucauucuggccggcgugucccugcuuccggucugccaaucuagcuccaugcgcaaaacagacuggcugcccauggcuguugccgccaugggggugccuccccucccucuguuuaucuucucucucaaggauacccugaagagacggagcuggccccuuaaugagggagugauggcugucggccugguguccauccuggcgucuagccuccugcgcaacgacguuccuauggccgggccccuuguggcuggaggccugcucauugccuguuacgucaucaccgggacauccgccgaucugaccguggaaaaagcugccgacauuacaugggaggaagaggcggaacagacgggaguuagccacaaccucaugaucaccguggacgaugacggcacaaugagaauuaaggaugacgagaccgagaauauccugacaguccuucugaaaaccgcucugcucaucgugucuggcgucuuuccguauuccauuccugccacgcugcuuguguggcauaccuggcagaagcagacacaacggagcgggguucugugggaugugcccucuccucccgaaacccagaaagccgagcucgaagagggagucuaccgcaucaagcagcagggcauuuucgggaaaacacaagugggaguuggcgugcagaaggagggggucuuucacaccauguggcacgugacaagaggagcugugcugacguacaacggcaagcggcucgaaccgaauugggccuccguuaaaaaggaccugaucagcuauggcgggggauggcgccuuucugcgcaguggcaaaaaggcgaggaaguccaggugauugcuguggagccugggaagaaccccaaaaauuuccagaccacaccuggaaccuuccagaccacaacgggcgaaaucggggccauugcccuggauuuuaagcccggaaccuccggcagccccaucaucaacagagagggcaaggucguggggcuguacggaaauggcguugugacaaaaaacgggggauaugucuccggcauugcucaaaccaaugccgagccugacgggccgacacccgaacucgaggaagagauguucaagaaacggaaccugaccaucauggaucuucauccuggcagcggaaagacgcgcaaauaccugcccgcuauuaucagagaagccauuaagcggagacuccgcacacugauccucgcgccuacccgggugguugccgcugagauggaggaagcccugaagggccuucccaucagauaucagaccacagcuaccaaaucugagcacacagggcgcgaaauuguggaccugaugugccaugccaccuuuacgaugcggcugcucagcccugucagagugccgaauuacaaccugaucauuauggaugaggcccacuucacagaccccgcuuccaucgcggcccgcggauauauuucuacccggguuggcaugggggaagcugccgccaucuuuaugacagcuaccccucccggaacggccgaugcguucccucagagcaaugcucccauccaggacgaggagagagacauuccggaacgcuccuggaacucuggcaaugaguggaucaccgauuuugccgggaagacagugugguucgucccuagcauuaaagccggcaacgacaucgcuaacugucuucggaagaauggaaaaaaggugauucaacuguccagaaagaccuuugauacagaauaccagaaaaccaagcucaacgacugggauuucguggucacaaccgacaucucugagaugggcgccaauuuuaaagcggaucggguuauugacccccgcagaugccugaagcccgugauccugacggaugggccugagcgggugauccucgccggacccaugccugucacagcugccagcgcugcccagcgcagaggccggguggggagaaacccgcagaaagaaaaugaccaauacauuuucaccggacagccccuuaacaaugaugaggaccaugcucacuggaccgaagccaagaugcugcuggacaacaucaauacaccugagggcauuauccccgcgcucuucgaaccugagcgcgagaaguccgccgcuauugauggggaauaucggcugaaaggcgagagcagaaagaccuuuguugaacuuaugcgccggggagaccugcccguguggcucgcccacaaagucgcuucugagggcaucaaguacacagauagaaaauggugcuucgacgggcagcgcaacaaucagauccuggaagagaacauggauguggagauuuggacgaaggaaggagagaaaaagaagcugcggccgagauggcucgacgcccgcaccuauuccgauccucuugcccugaaagaauuuaaggacuucgcugcgggcagaaaaagcaucgcccuggaucucguuacagagauugggcgggugcccucucaucuggcucaccgcaccagaaaugcccuugacaaccuggucaugcuccauacauccgaacacggaggccgggccuaccgccacgcuguggaggagcugccugaaaccauggagacgcugcuccuucugggccugaugauccuccugaccgggggagccaugcuuuuucugauuagcggcaaggggaucggaaaaacauccaucggccucauuugugucaucgcgucuagcgggaugcuguggauggccgaaauuccccugcaauggaucgcuuccgccauugugcucgaguucuuuaugaugguucuucugaucccugagcccgaaaagcagagaaccccgcaggauaaucaacuggcuuauguggugauuggaauccucacacuggccgcgaucauugccgcuaacgagaugggccuucuggaaaccacgaagcgggaccucggcaugagcaaagagccuggggucguuucucccacauccuaccuggauguggaccugcaucccgccagcgcuuggacccucuaugccguggcuacaaccgucaucaccccuaugcuuagacacacaauugaaaauucuacggccaacgugagccuggcggccaucgcuaaccaggccguugugcugaugggacucgacaagggcuggccgauuuccaaaauggaucugggggucccccuucuggcucucggaugcuacucucaggugaauccucugacccugacagccgccguccuccuucugaucacccauuacgcgaucauuggccccgggcugcaggcuaaggccacacgcgaggcucaaaaacggaccgccgccggaaucaugaagaacccuacgguggacggcauuaugacaaucgaucucgaccccguuauuuaugauagcaaguucgagaaacagcugggccaggugaugcuucugguccucugugcugugcagcugcugcucaugagaaccuccugggcccuuugcgaagcgcugacccuggccacagggccuaucaccacacucugggagggaucuccgggcaaguuuuggaauacgaccaucgcuguuagcauggccaacauuuuccgcggguccuaccuggcuggagccggccuugcguuuagcaucaugaaaucuguggggacaggaaagcggggcaccggcucccaaggggaaacacugggagagaaauggaagaagaaacucaaucagcugagcagaaaggaauucgaccuguauaaaaaguccggcauuaccgaggucgaucggacggaggccaaagaagggcucaagcgcggagagaucacccaccaugcugugucuagaggcagcgccaaacuucagugguuuguggaacggaacaugguuauucccgaggggcgcgucaucgaccugggauguggcagaggcgggugguccuacuauugcgcuggacugaagaaggugacagaagugcggggcuacaccaaagggggaccuggccacgaggagcccgucccuaugucuacauauggguggaauauuguuaagcucaugagcggaaaagauguguucuaccugcccccggaaaagugugacacccuucugugcgauaucggcgaguccagcccuucucccacaguggaagagucccgcaccaucagaguccucaaaaugguggagcccuggcugaagaacaaucaguucuguauuaagguucugaacccuuacaugcccacggugaucgaacaccucgagcggcuucaacgcaaacauggcgggaugcuggucagaaauccucugagccggaacucuacacacgaaauguauuggauuuccaauggaaccggcaacaucguggccagcguuaauauggugucuagacuccugcuuaaccgcuuuaccaugacacaucggagaccgacgauugagaaggacgucgaucugggggcuggaacccgccacgugaacgccgaacccgagacaccuaauauggacgugaucggcgagcggaucaaaagaauuaaggaagagcacaacagcaccuggcauuacgacgaugaaaaucccuauaaaacaugggcguaccacggguccuaugaggucaaggccaccggaucugcuagcuccaugaucaacggcguugugaagcuccugacaaaaccuugggacgugguccccauggugacccagauggccaugacggauaccacaccguucggccagcaacgcguuuuuaaggaaaaaguggacacccggacaccuagaagcaugcccgggacccgccgggucauggagauuacggcugaguggcuguggagaacacucggacgcaauaagaaaccucggcugugcaccagagaagaguucacaaagaaggugcgcaccaacgccgccaugggcgcgguuuuuacggaagagaaucagugggauuccgcuaaagccgccguggaagacgaggauuucuggaagcuugucgacagagagcgggaacugcauaaacucgggaaguguggaucuugcguguacaacaugaugggcaaacgcgagaagaaacugggggaauuuggcaaggcuaagggaagcagagccaucugguauauguggcuuggcgcucgguaccuggaguucgaggcccucggguuucugaaugaagaucacugguucuccagagagaacucuuacagcggaguugaaggcgaggggcugcauaaacucggauauauucugcgggacaucuccaagauccccggcggggcgauguacgccgaugacaccgcuggcugggacacacgcauuaccgaagaugaccuucacaaugaggagaaaaucacacagcagauggauccugaacacagacaacuggccaacgcuauuuuuaagcucaccuaucagaauaaaguggucaaggugcagcggcccacaccgaccggaacggucauggacaucauuucucgcaaggaucagagaggcagcgggcaagugggaacauacggccugaacaccuucaccaauauggaggcccagcuuauccggcagauggaaggggagggaguucuguccaaagcggaccucgaaaacccucaucugcccgagaagaaaaucacacaguggcuggagaccaagggcguggaacgccucaaaagaauggccauuagcggggaugacugcgucgugaagcccaucgaugaccgguuugcuaacgcccugcuugcucugaaugauaugggcaaggugcgcaaagacauuccucaauggcagccgucuaagggauggcacgauuggcagcagguucccuucuguucccaucacuuccacgagcucaucaugaaagacggcagaaagcugguggucccuugccggccccaagacgaacuuauugggcgcgccagaaucagccagggagcuggcuggucucugcgggagacagccugucucgggaaagcguaugcccagauguggucccugauguacuuucaucgcagagaucugcggcucgcuagcaacgccauuugcucugccgugccuguucacugggugcccacguccagaaccacauggagcauccaugcucaccaucaauggaugaccacagaagacaugcugaccgucuggaaucgcguguggaucgaggauaacccuuggauggaggacaagacgcccgucaccacaugggaaaaugugccguaucuuggaaagcgggaggaucagugguguggcucccugauugggcucaccagcagagccacaugggcgcagaacaucccuaccgcuauucagcaaguucgcucucugaucggcaaugaagaguuccuugacuacaugcccagcaugaaacgguuuagaaaggaggaagaguccgaaggagccauuugguga

SEQ ID NO: 20425 - RNA, 9873 nt, Artificial Sequence
  derived and/or modified CDS sequence (opt5) from DENV-3__GU131857__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaagcggcgccaccacagaaaccccuacguggaaucgcaaagagcuucuggucacauuuaagaacgcucaugcgaaaaagcaagaagugguugugcucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuuguccugaagaaagagguguccgaaacccagcaugggacaauccucaucaagguugaguaccggggagaagaugcccccuguaagauuccuuucagcaccgaggacggccaagggaaagcgcacaacggaagacugaucacagcuaaucccguggucaccaagaaagaggaacccgugaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguugggggaguccucaacagccugggcaaaauggugcaucagauuuuugggucugccuacaccgcucuguucuccggcgugagcugggucaugaagaucggaauuggcauccuccugaccuggauugggcuuaauucuaaaaacacaagcauguccuuuucuugcaucgccaucggaauuaucacccuguaucucggcgcugugguucaggccgacauggggugugugauuaauuggaagggaaaagagcugaagugcggcagcgggaucuucgucacaaacgaggugcacacguggaccgaacaguacaaguuucaagcggauucccccaaacgccuggccacagcuauugccggcgcuugggagaauggaguuuguggcauccggagcaccacaagaauggaaaaccuucucuggaagcagaucgccaaugagcugaacuauauucugugggaaaauaacaucaaacucaccguggucgugggggacauuaucggaguucuggagcagggcaagcgcacgcuuaccccucagcccauggagcugaaauacucuuggaagacaugggggaaagccaagauugugaccgcugaaacacaaaacuccagcuucaucaucgauggaccuaauacccccgagugcccgucugcgucccgggccuggaacgucugggaaguggaggacuauggcuuuggcguguucacaaccaauauuuggcucaagcugagagaagucuacacgcagcugugugaccaucgccuuaugagcgcugccguuaaagaugagcgggccgugcacgcugacaugggguacuggaucgagucccagaagaacggaucuuggaaacucgaaaaggccagccugauugaggugaaaacaugcaccuggccuaagucccacacccuguggucuaauggcguccucgaaagcgauaugaucauucccaagucccuggcggggccuaucagccagcauaaccacagacccggauaucauacacaaaccgcuggcccuuggcaccuugggaaacuggagcucgacuuuaauuacugcgagggaacgacagugguuaucaccgaaaacuguggcacacgcggccccucucugcggaccacaaccguguccgggaagcugauucacgaguggugcuguagaagcugcacgcuuccgccucuccgguauaugggagaagauggcuguugguacgggauggagauccgccccauuucugaaaaagaggagaauauggucaagucccuggugagcgccggaucuggcaaaguugacaacuucaccaugggggugcugugccucgccauccuguuugaagaggucaugagaggaaaguucggcaagaaacauaugauugcuggcguguucuuuacauucguucuucugcucagcgggcagaucaccuggcgggauaugacacacacccugauuaugaucggauccaaugccagcgacagaaugggcaugggggugacguaucuggcgcuuaucgcuacauuuaagauucagcccuuccuggcccucggauuuuuccugcgcaaacucaccucucgggaaaaccugcuucugggcgucgggcucgccauggcuacaacccugcaacugccugaggauaucgaacagauggccaauggaauugcucuuggccugauggcccucaagcugaucacccaguuugagacauaccagcucuggacggcgcugauuucccuuaccuguagcaacacaauguucacccugacaguggccuggagaaccgcuacgcucauccuggccggcgugucccugcuuccggucugccaaucuagcuccaugcgcaaaacagacuggcugcccauggcuguugccgccaugggggugccuccccucccucuguuuaucuucucucucaaggauacccugaagagacggagcuggccccuuaaugagggagugauggcugucggccugguguccauucuggcgucuagccuccugcgcaacgacguuccuauggccgggccccuuguggcuggaggccugcucaucgccuguuaugucauuaccgggacauccgccgaucugaccguggaaaaagcugccgacaucacaugggaggaagaggcggaacagacgggaguuagccauaaccucaugauuaccguggacgaugacggcacaaugagaaucaaggaugacgagaccgagaauauccugacaguccuucugaaaaccgcucugcucauugugucuggcgucuuuccguacuccaucccugccacgcugcuuguguggcacaccuggcagaagcagacacaacggagcgggguucugugggaugugcccucuccucccgaaacccagaaagccgagcucgaagagggagucuaccgcauuaagcagcagggcaucuucgggaaaacacaagugggaguuggcgugcagaaggagggggucuuucauaccauguggcacgugacaagaggagcugugcugacguauaacggcaagcggcucgaaccgaauugggccuccguuaaaaaggaccugauuagcuacggcgggggauggcgccuuucugcgcaguggcaaaaaggcgaggaaguccaggugaucgcuguggagccugggaagaaccccaaaaauuuccagaccacaccuggaaccuuccagaccacaacgggcgaaauuggggccaucgcccuggauuuuaagcccggaaccuccggcagccccaucauuaacagagagggcaaggucguggggcuguauggaaauggcguugugacaaaaaacgggggauacgucuccggcaucgcucaaaccaaugccgagccugacgggccgacacccgaacucgaggaagagauguucaagaaacggaaccugaccauuauggaucuucacccuggcagcggaaagacgcgcaaauaucugcccgcuaucauuagagaagccaucaagcggagacuccgcacacugauccucgcgccuacccgggugguugccgcugagauggaggaagcccugaagggccuucccauuagauaccagaccacagcuaccaaaucugagcauacagggcgcgaaaucguggaccugaugugccacgccaccuuuacgaugcggcugcucagcccugucagagugccgaauuauaaccugauuaucauggaugaggcccauuucacagaccccgcuuccauugcggcccgcggauacaucucuacccggguuggcaugggggaagcugccgccaucuuuaugacagcuaccccucccggaacggccgaugcguucccucagagcaaugcucccauucaggacgaggagagagacaucccggaacgcuccuggaacucuggcaaugaguggauuaccgauuuuguggggaagacagucugguucgugccuagcaucaaagccggcaacgacauugccaacugucuucggaagaauggaaaaaaggugauccaacuguccagaaagaccuuugauacagaauaccagaaaaccaagcucaacgacugggauuucgucguuacaaccgacauuucugagaugggcgcuaauuuuaaagccgaucgggugaucgacccccgcagaugccugaagcccgugauccugacggaugggccugagcgggucauucucgcgggacccaugccugugacagccgcuagcgccgcucagcgcagaggccggguugggagaaacccgcagaaagaaaaugaccaauauaucuucaccggacagccccuuaacaaugaugaggaccacgcccauuggaccgaagcuaagaugcugcuggacaacauuaauacaccugagggcaucauucccgcccucuucgaaccugagcgcgagaaguccgcggccaucgauggggaauaccggcugaaaggcgagagcagaaagaccuuuguggaacuuaugcgccggggagaccugcccgucuggcucgcucacaaaguggccucugagggcaucaaguauacagauagaaaauggugcuucgacgggcagcgcaacaaucagauucuggaagagaacauggauguugagaucuggacgaaggaaggagagaaaaagaagcugcggccgagauggcucgacgcucgcaccuacuccgauccucuugcccugaaagaauuuaaggacuucgccgcuggcagaaaaagcauugcgcuggaucucgugacagagaucgggcggguccccucucaccuggcccaucgcaccagaaaugcucuugacaaccuggugaugcuccacacauccgaacauggaggccgggccuaucgccacgccgucgaggagcugccugaaaccauggagacgcugcuccuucugggccugaugauucuccugaccgggggagcuaugcuuuuucugaucagcggcaaggggaucggaaaaacauccauuggccucaucugugugauugccucuagcgggaugcuguggauggcggaaaucccccugcaauggauugccuccgcuaucguucucgaguucuuuaugauggugcuucugauuccugagcccgaaaagcagagaaccccgcaggauaaucaacuggccuacguggucaucggaauccucacacuggcugccauuaucgcggccaacgagaugggccuucuggaaaccacgaagcgggaccucggcaugagcaaagagccugggguugugucucccacauccuaucuggauguggaccugcaccccgcuagcgccuggacccucuacgcugucgccacaaccgugauuaccccuaugcuuagacauacaaucgaaaauucuacggcuaacguuagccuggccgcgauugccaaccaggcugugguccugaugggacucgacaagggcuggccgaucuccaaaauggaucugggggugccccuucuggcccucggaugcuacucucaggucaauccucugacccugacagcugccgugcuccuucugaucacccacuaugccauuaucggccccgggcugcaggcgaaggcuacacgcgaggcccaaaaacggaccgcugccggaauuaugaagaacccuacgguugacggcaucaugacaauugaucucgaccccgugaucuacgauagcaaguucgagaaacagcugggccaggucaugcuucuggugcucugugccguucagcugcugcucaugagaaccuccugggcucuuugcgaagcccugacccuggcgacagggccuaucaccacacucugggagggaucuccgggcaaguuuuggaauacgaccauugccgugagcauggcuaacaucuuccgcggguccuaucuggccggagcuggccuugccuuuagcauuaugaaaucugucgggacaggaaagcggggcaccggcucccaaggggaaacacugggagagaaauggaagaagaaacucaaucagcugagcagaaaggaauucgaccuguacaaaaaguccggcaucaccgagguggaucggacggaggcgaaagaagggcucaagcgcggagagauuacccaucacgccgugucuagaggcagcgcuaaacuucagugguuuguugaacggaacauggucauccccgaggggcgcgugauugaccugggauguggcagaggcgggugguccuauuacugcgccggacugaagaaggugacagaaguccggggcuauaccaaagggggaccuggccaugaggagcccguuccuaugucuacauacggguggaauaucgugaagcucaugagcggaaaagauguguucuaccugcccccggaaaagugugacacccuucugugcgauaucggcgaguccagcccuucucccacagucgaagagucccgcaccauuagagugcucaaaaugguugagcccuggcugaagaacaaucaguucuguaucaaggugcugaacccuuauaugcccacggucauugaacaccucgagcggcuucaacgcaaacacggcgggaugcuggugagaaauccucugagccggaacucuacacaugaaauguacuggaucuccaauggaaccggcaacauuguugcuagcgugaauauggucucuagacuccugcuuaaccgcuuuaccaugacacaccggagaccgacgaucgagaaggacguggaucugggggccggaacccgccaugugaacgcugaacccgagacaccuaauauggacgucaucggcgagcggauuaaaagaaucaaggaagagcacaacagcaccuggcacuaugacgaugaaaaucccuacaaaacaugggccuaucauggguccuacgagguuaaggcgaccggaucugccagcuccaugauuaacggcguggugaagcuccugacaaaaccuugggacgucgugcccaugguuacccagauggcuaugacggauaccacaccguucggccagcaacgcguguuuaaggaaaaagucgacacccggacaccuagaagcaugcccgggacccgccgggugauggagaucacggccgaguggcuguggagaacacucggacgcaauaagaaaccucggcugugcaccagagaagaguucacaaagaagguucgcaccaacgcugccaugggcgccguguuuacggaagagaaucagugggauuccgcgaaagcugccgucgaagacgaggauuucuggaagcuuguggacagagagcgggaacugcacaaacucgggaaguguggaucuugcguuuauaacaugaugggcaaacgcgagaagaaacugggggaauuuggcaaggccaagggaagcagagcuauuugguacauguggcuuggcgcccgguaccuggaguucgaggcucucggguuucugaaugaagaucauugguucuccagagagaacucuuauagcggaguggaaggcgaggggcugcacaaacucggauacauccugcgggacaucuccaagauucccggcggggccauguaugcggaugacaccgccggcugggacacacgcaucaccgaagaugaccuucauaaugaggagaaaauuacacagcagauggauccugaacacagacaacuggcuaacgccaucuuuaagcucaccuaccagaauaaagucgugaagguccagcggcccacaccgaccggaacggugauggacauuaucucucgcaaggaucagagaggcagcgggcaaguuggaacauauggccugaacaccuucaccaauauggaggcucagcuuauccggcagauggaaggggagggagugcuguccaaagccgaccucgaaaacccucaccugcccgagaagaaaauuacacaguggcuggagaccaagggcgucgaacgccucaaaagaauggcgaucagcggggaugacugcguggugaagcccauugaugaccgguuugccaacgcucugcuugcccugaaugauaugggcaagguucgcaaagacaucccucaauggcagccgucuaagggauggcaugauuggcagcaggugcccuucuguucccaccauuuccacgagcucauuaugaaagacggcagaaagcuggucgugccuugccggccccaagacgaacuuaucgggcgcgcuagaauuagccagggagccggcuggucucugcgggagacagcuugucucgggaaagccuacgcgcagauguggucccugauguauuuucaccgcagagaucugcggcucgccagcaacgcuaucugcucugccguuccugugcauuggguccccacguccagaaccacauggagcauccacgcccaucaccaauggaugaccacagaagacaugcugaccguguggaaucgcgucuggauugaggauaacccuuggauggaggacaagacgcccgugaccacaugggaaaauguuccguaccuuggaaagcgggaggaucagugguguggcucccugaucgggcucaccagcagagcuacaugggcccagaacauuccuaccgcgauccagcaagugcgcucucugauuggcaaugaagaguuccuugacuacaugcccagcaugaaacgguuuagaaaggaggaagaguccgaaggagcuaucugguga

SEQ ID NO: 20426 - RNA, 9873 nt, Artificial Sequence
  derived and/or modified CDS sequence (opt5) from DENV-3__GU131858__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaagcggcgccaccacagaaaccccuacguggaaucgcaaagagcuucuggucacauuuaagaacgcucaugcgaaaaagcaagaagugguugugcucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuuguccugaagaaagagguguccgaaacccagcaugggacaauccucaucaagguugaguaccggggagaagaugcccccuguaagauuccuuucagcaccgaggacggccaagggaaagcgcacaacggaagacugaucacagcuaaucccguggucauuaagaaagaggaacccgugaacaucgaggccgaaccuccguucggcgaguccaauauugugaucgggaucggcgauaacgcccugaagauuaauugguauaaaaagggaucuagcaucggcaagauguuugaagcuaccgcccgcggggcucggagaauggccauucuuggagacacggcgugggauuucggcuccguugggggaguccucaacagccugggcaaaauggugcaucagaucuuugggucugccuacacagcucuguucuccggcgugagcugggucaugaagauuggaaucggcauucuccugaccuggaucgggcuuaauucuaaaaacaccagcauguccuuuucuugcaucgccauuggaaucauuacacuguaucucggcgcugugguucaggccgacaucgggugugugauuaauuggaagggaaaagagcugaagugcggcagcgggaucuucgucaccaacgaggugcacacauggacggaacaguacaaguuucaagcggauucccccaaacgccuggccaccgcuaucgccggcgcuugggagaauggaguuuguggcauucggagcacaaccagaauggaaaaccuucucuggaagcagaucgccaaugagcugaacuauauucugugggaaaauaacaucaaacucacaguggucgugggggacauuaucggaguucuggagcagggcaagcgcacccuuacgccucagcccauggagcugaaauacucuuggaagaccugggggaaagccaagaucgugacagcugaaacccaaaacuccagcuucauuaucgauggaccuaauacacccgagugcccgucugcgucccgggccuggaacgucugggaaguggaggacuauggcuuuggcguguucaccacaaauauuuggcucaagcugagagaagucuacacccagcugugugaccaucgccuuaugagcgcugccguuaaagaugagcgggccgugcacgcugacaugggguacuggaucgagucccagaagaacggaucuuggaaacucgaaaaggccagccugauugaggugaaaacgugcacauggccuaagucccacacccuguggucuaauggcguccucgaaagcgauaugaucauccccaagucccuggcggggccuauuagccagcauaaccacagacccggauaucauacccaaacagcuggcccuuggcaccuugggaaacuggagcucgacuuuaauuacugcgagggaaccacggugguuaucacagaaaacuguggcaccucuggccccucccugacaaccacaaccgugagcgggaagcugauucacgaguggugcugucgcucuugcacgcuuccgccucuccgguauaugggagaagauggcuguugguacgggauggagaucagacccauuuccgaaaaagaggagaauauggucaagagccuggugucugccggaagcggcaaaguugacaacuucaccaugggggugcugugccucgccauccuguuugaagaggucaugcggggaaaguucggcaagaaacauaugauugcuggcguguucuuuacauucguucuucugcucuccgggcagaucaccuggcgcgauaugacacacacccugaucaugauuggaagcaaugccucugacagaaugggcaugggggugacguaucuggcgcuuaucgcuacauuuaagauucagcccuuccuggcccucggauuuuuccugcggaaacucaccuccagagaaaaccugcuucugggcgucgggcucgccauggcuacaacccugcaacugccugaggauaucgaacagauggccaauggaauugcucuuggccugauggcccucaagcugaucacccaguuugagacauaccagcucuggacggcgcugaucagccuuaccuguuccaacacaauguucacccugacaguggccuggcgcaccgcuacgcucauucuggccggcgugucucugcuuccggucugccaaagcuccucuaugcggaaaacagacuggcugcccauggcuguugccgccaugggggugccuccccucccucuguuuaucuucagccucaaggauacccugaagagacgcuccuggccccuuaaugagggagugauggcugucggccuggugucuauucuggcgagcucccuccugagaaacgacguuccuauggccgggccccuuguggcuggaggccugcucaucgccuguuaugucauuaccgggacaagcgccgaucugaccguggaaaaagcugccgacaucacaugggaggaagaggcggaacagacgggaguuucucauaaccucaugaucaccguggacgaugacggcacaaugcggauuaaggaugacgagaccgagaauauccugacaguccuucugaaaaccgcucugcucauuguguccggcgucuuuccguacagcaucccugccacgcugcuuguguggcacaccuggcagaagcagacacaacgcucugggguucugugggaugugcccuccccucccgaaacccagaaagccgagcucgaagagggagucuacagaauuaagcagcagggcaucuucgggaaaacacaagugggaguuggcgugcagaaggagggggucuuucauaccauguggcacgugacacggggagcugugcugacguauaacggcaagcgccucgaaccgaauugggccagcguuaaaaaggaccugauuucuuacggcgggggauggagacuuuccgcgcaguggcaaaaaggcgaggaaguccaggugaucgcuguggagccugggaagaaccccaaaaauuuccagaccaugccuggaacauuccagaccaccacaggcgaaaucggggccauugcccuggauuuuaagcccggaacgagcggcucccccaucauuaaccgggagggcaaggucguggggcuguauggaaauggcguugugaccaaaaacgggggauacgucagcggcaucgcucaaacaaaugccgagccugacgggccgacccccgaacucgaggaagagauguucaagaaacgcaaccugacaauuauggaucuucacccuggcucuggaaagaccagaaaauaucugcccgcuaucauccgggaagccauuaagcgcagacuccggacgcugauccucgcgccuacaagagugguugccgcugagauggaggaagcccugaagggccuucccauucgcuaccagaccaccgcuacaaaaagcgagcauaccgggcgggaaaucguggaccugaugugccacgccacauuuaccaugagacugcucuccccuguccgcgugccgaauuauaaccugauuaucauggaugaggcccauuucacggaccccgcuucuaucgcggcccggggauacauuagcacaagaguuggcaugggggaagcugccgccaucuuuaugaccgcuacaccucccggaaccgccgaugcguucccucaguccaaugcucccauucaggacgaggagcgcgacaucccggaacggucuuggaacagcggcaaugaguggauuacggauuuuguggggaagaccgucugguucgugccuuccaucaaagccggcaacgacauugccaacugucuuagaaagaauggaaaaaaggugauccaacugucucgcaagacauuugauaccgaauaccagaaaacaaagcucaacgacugggauuucgucguuaccacagacaucagcgagaugggcgcuaauuuuaaagccgaucgggugauugaccccagacggugccugaagcccgugauccugaccgaugggccugagcgcgucauucucgcgggacccaugccugugacggccgcuuccgccgcucagagacggggccgcguugggagaaacccgcagaaagaaaaugaccaauauaucuucacaggacagccccuuaacaaugaugaggaccacgcccauuggaccgaagcuaagaugcugcuggacaacauuaauaccccugagggcaucauccccgcccucuucgaaccugagcgggagaagagcgcggccauugauggggaauacagacugaaaggcgagucucgcaagacauuuguggaacuuaugcggagaggagaccugcccgucuggcucgcucacaaaguggccuccgagggcaucaaguauaccgaucgcaaauggugcuucgacgggcagcggaacaaucagauucuggaagagaacauggauguugagaucuggacaaaggaaggagagaaaaagaagcugagaccgcgcuggcucgacgcucggacguacagcgauccucuugcccugaaagaauuuaaggacuucgccgcuggcagaaaaucuauugcgcuggaucucgugaccgagaucgggcgcguccccucccaccuggcccauagaacacggaaugcucuugacaaccuggugaugcuccacaccagcgaacauggaggccgcgccuauagacacgccgucgaggagcugccugaaacaauggagacccugcuccuucugggccugaugauccuccugacggggggagcuaugcuuuuucugauuuccggcaaggggaucggaaaaaccucuauuggccucaucugugugauugccagcuccgggaugcuguggauggcggaaaucccccugcaauggauugccagcgcuaucguucucgaguucuuuaugauggugcuucugaucccugagcccgaaaagcagcggacaccgcaggauaaucaacuggccuacguggucauuggaauccucacccuggcugccauuaucgcggccaacgagaugggccuucuggaaacaaccaagcgcgaccucggcaugucuaaagagccugggguugugucccccaauagcuaucuggauguggaccugcaccccgcuucugccuggacgcucuacgcugucgccacaaccgugauuacaccuaugcuuagacauaccaucgaaaacagcaccgcuaacguuucccuggccgcgaucgccaaucaggcugugguccugaugggacucgacaagggcuggccgauuucuaaaauggaucugggggugccccuucuggcccucggaugcuacagccaggucaacccucugacacugacggcugccgugcuccuucugaucacccacuaugccauuaucggccccgggcugcaggcgaaggcuacacgggaggcccaaaaaagaaccgcugccggaauuaugaagaauccuacaguugacggcaucaugaccaucgaucucgaccccgugauuuacgauuccaaguucgagaaacagcugggccaggucaugcuucuggugcucugugccguucagcugcugcucaugcgcacgucuugggcucuuugcgaagcccugacacuggcgaccgggccuaucaccacacucugggagggaagcccgggcaaguuuuggaacaccacaauugccguguccauggcuaauaucuuccgggggagcuaucuggccggagcuggccuugccuuuucuauuaugaaauccgucgggacgggaaagagaggcaccggcagccaaggggaaacacugggagagaaauggaagaagaaacucaaccagcugucccgcaaggaauucgaccuguacaaaaagucuggcaucaccgagguggaucggacagaggcgaaagaagggcucaagagaggagagauuacccaucacgccgugagccggggcuccgcuaaacuucagugguuuguugaacgcaauauggucauccccgaggggagagugaucgaccugggauguggccggggcggguggucuuauuacugcgccggacugaagaaggugacggaaguccgcggcuauaccaaagggggaccuggccaugaggagcccguuccuaugagcacauacggguggaacauugugaagcucauguccggaaaagauguguucuaccugcccccggaaaagugugacacccuucugugcgauaucggcgagagcucuccuucccccacagucgaagagagcagaaccauucgggugcucaaaaugguugagcccuggcugaagaauaaccaguucuguaucaaggugcugaauccuuauaugcccacagucauugaacaccucgagcgccuucaaagaaaacacggcgggaugcuggugcggaacccucugucucgcaauuccacccaugaaauguacuggaucagcaacggaacgggcaauaucguugcuucugugaacauggucagcagacuccugcuuaaccgguuuacaaugacccacagacgcccgaccauugagaaggacguggaucugggggccggaacacggcaugugaaugcugaacccgagacgccuaacauggacgucaucggcgagagaauuaaacgcaucaaggaagagcacaauuccaccuggcacuaugacgaugaaaaccccuacaaaacaugggccuaucaugggucuuacgagguuaaggcgaccggaagcgccuccagcaugauuaauggcguggugaagcuccugacaaaaccuugggacgucgugcccaugguuacccagauggcuaugacagauaccacgccguucggccagcaacggguguuuaaggaaaaagucgacaccagaacaccucgcuccaugcccgggacccggagagugaugggaaucacagccgaguggcuguggcgcacccucggccggaacaagaaaccuagacugugcacgcgcgaggaauucacaaagaagguucggaccaaugcugccaugggggccguguuuacagaggaaaaccagugggauucugcgaaagcugccgucgaggacgaagauuucuggaagcuuguggacagagagcgcgagcugcacaaacucggaaaguguggcagcugcguuuauaauaugauggggaaaagagaaaagaaacugggcgaguuuggaaaggccaagggcucccgggcuaucugguacauguggcuuggggcccgcuaccuggaauucgaggcucucggauuucugaacgaggaucauugguucucuagagaaaauagcuauuccggcguggagggggaaggacugcacaaacucggcuacauucugcgggacaucucuaagauucccgggggcgccauguaugcggaugacaccgccggaugggacacgagaaucaccgaggaugaccuucauaacgaagagaaaauuacacagcagauggauccugagcaccggcaacuggcuaaugccaucuuuaagcucaccuaccagaacaaagucgugaagguccagcgccccacaccgaccggcacagugauggacaucauuagcagaaaggaucagcggggguccggacaaguuggcaccuaugggcugaauacguucacaaacauggaagcucagcuuauccgccagauggagggagaaggcgugcugagcaaagccgaccucgagaacccucaccugcccgaaaagaaaauuacccaguggcuggagaccaagggggucgagagacucaaacggauggcgaucucuggcgaugacugcguggugaagcccauugaugaccgcuuugccaaugcucugcuugcccugaacgauaugggaaagguuagaaaagacaucccucaauggcagccguccaagggcuggcaugauuggcagcaggugcccuucuguagccaccauuuccacgaacucauuaugaaagacgggcggaagcuggucgugccuugccgcccccaagacgagcuuaucggaagagcucggaucucucagggcgccggguggucccugcgcgaaacagcuugucucggaaaagccuacgcgcagauguggagccugauguauuuucacagacgggaucugcgccucgccucuaaugcuauuugcuccgccguuccugugcauuggguccccaccagcagaacaacgugguccauccacgcccaucaccaauggaugaccacagaggacaugcugaccguguggaaccgggucuggauugaagauaauccuuggauggaggacaagacacccgugaccacgugggagaacguuccguaccuuggcaagagagaagaucaguggugugggagccugaucggccucaccucucgcgcuacaugggcccagaauauuccuaccgcgauccagcaagugcggagccugaucggaaacgaggaauuccuugacuacaugcccuccaugaaaagauuucgcaaggaggaggaaucugagggcgcuauuugguga

SEQ ID NO: 20427 - RNA, 9873 nt, Artificial Sequence
  derived and/or modified CDS sequence (opt5) from DENV-3__GQ868548__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccagcacgaaaaucucaaguauacagugaucaucaccguucauacaggggaccagcaccaggugggaaacgagacgcaaggcgucaccgcugaaauuacaccucaggccucuaccacagaggcuauccugcccgaauacggcacccuggggcucgagugcuccccuagaacgggacuggacuucaaugagaugauucuucugaccaugaaaaacaaggccuggauggugcaucggcagugguuuuucgaucucccccugccguggacaagcggcgccaccacagaaaccccuacguggaaucgcaaagagcuucuggucacauuuaagaacgcucacgcgaaaaagcaagaagugguugugcucgggucucaggagggagccaugcacaccgcucugacaggcgccaccgaaauccagaauuccgggggcaccagcauuuucgccggacaucugaaguguagacucaaaauggacaagcuggagcuuaaaggcaugucuuaugcuaugugcacaaacacguuuguccugaagaaagagguguccgaaacccagcacgggacaauccucaucaagguugaguaccggggagaagaugcccccuguaagauuccuuucagcaccgaggacggccaagggaaagcgcauaacggaagacugaucacagcuaaucccguggucaccaagaaagaggaacccgugaacauugaggccgaaccuccguucggcgaguccaauaucgugauugggaucggcgauaacgcccugaagaucaauugguacaaaaagggaucuagcauuggcaagauguuugaagcuacggcccgcggggcucggagaauggccauccuuggagacacagcgugggauuucggcuccguugggggaguccucaacagccugggcaaaauggugcaccagauuuuugggucugccuauaccgcucuguucuccggcgugagcugggucaugaagaucggaauuggcauccuccugaccuggauugggcuuaauucuaaaaacacaagcauguccuuuucuugcaucgccaucggaauuaucacccuguaccucggcgcugugguucaggccgacauggggugugugauuaauuggaagggaaaagagcugaagugcggcagcgggaucuucgucacaaacgaggugcauacguggaccgaacaguauaaguuucaagcggauucccccaaacgccuggccacagcuauugccggcgcuugggagaauggaguuuguggcauccggagcaccacaagaauggaaaaccuucucuggaagcagaucgccaaugagcugaacuacauucugugggaaaauaacaucaaacucaccguggucgugggggacauuaucggaguucuggagcagggcaagcgcacgcuuaccccucagcccauggagcugaaauauucuuggaagacaugggggaaagccaagauugugaccgcugaaacacaaaacuccagcuucaucaucgauggaccuaauacccccgagugcccgucugcgucccgggccuggaacgucugggaaguggaggacuacggcuuuggcguguucacaaccaauauuuggcucaagcugagagaagucuauacgcagcugugugaccaccgccuuaugagcgcugccguuaaagaugagcgggccgugcacgcugacaugggguacuggaucgagucccagaagaacggaucuuggaaacucgaaaaggccagccugauugaggugaaaacaugcaccuggccuaagucccauacccuguggucuaauggcguccucgaaagcgauaugaucauucccaagucccuggcggggccuaucagccagcacaaccauagacccggauaccacacacaaaccgcuggcccuuggcaccuugggaaacuggagcucgacuuuaauuauugcgagggaacgacagugguuaucaccgaaaacuguggcacacgcggccccucucugcggaccacaaccguguccgggaagcugauucaugaguggugcuguagaagcugcacgcuuccgccucuccgguacaugggagaagauggcuguugguaugggauggagauccgccccauuucugaaaaagaggagaauauggucaagucccuggugagcgccggaucuggcaaaguugacaacuucaccaugggggugcugugccucgccauccuguuugaagaggucaugagaggaaaguucggcaagaaacacaugauugcuggcguguucuuuacauucguucuucugcucagcgggcagaucaccuggcgggauaugacacauacccugauuaugaucggauccaaugccagcgacagaaugggcaugggggugacguaccuggcgcuuaucgcuacauuuaagauucagcccuuccuggcccucggauuuuuccugcgcaaacucaccucucgggaaaaccugcuucugggcgucgggcucgccauggcuacaacccugcaacugccugaggauaucgaacagauggccaauggaauugcucuuggccugauggcccucaagcugaucacccaguuugagacauaucagcucuggacggcgcugauuucccuuaccuguagcaacacaauguucacccugacaguggccuggagaaccgcuacgcucauccuggccggcgugucccugcuuccggucugccaaucuagcuccaugcgcaaaacagacuggcugcccauggcuguugccgccaugggggugccuccccucccucuguuuaucuucucucucaaggauacccugaagagacggagcuggccccuuaaugagggagugauggcugucggccugguguccauucuggcgucuagccuccugcgcaacgacguuccuauggccgggccccuuguggcuggaggccugcucaucgccuguuacgucauuaccgggacauccgccgaucugaccguggaaaaagcugccgacaucacaugggaggaagaggcggaacagacgggaguuagccacaaccucaugauuaccguggacgaugacggcacaaugagaaucaaggaugacgagaccgagaauauccugacaguccuucugaaaaccgcucugcucauugugucuggcgucuuuccguauuccaucccugccacgcugcuuguguggcauaccuggcagaagcagacacaacggagcgggguucugugggaugugcccucuccucccgaaacccagaaagccgagcucgaagagggagucuaccgcauuaagcagcagggcaucuucgggaaaacacaagugggaguuggcgugcagaaggagggggucuuucacaccauguggcacgugacaagaggagcugugcugacguacaacggcaagcggcucgaaccgaauugggccuccguuaaaaaggaccugauuagcuauggcgggggauggcgccuuucugcgcaguggcaaaaaggcgaggaaguccaggugaucgcuguggagccugggaagaaccccaaaaauuuccagaccacaccuggaaccuuccagaccacaacgggcgaaauuggggccaucgcccuggauuuuaagcccggaaccuccggcagccccaucauuaacagagagggcaaggucguggggcuguacggaaauggcguugugacaaaaaacgggggauaugucuccggcaucgcucaaaccaaugccgagccugacgggccgacacccgaacucgaggaagagauguucaagaaacggaaccugaccauuauggaucuucauccuggcagcggaaagacgcgcaaauaccugcccgcuaucauuagagaagccaucaagcggagacuccgcacacugauccucgcgccuacccgggugguugccgcugagauggaggaagcccugaagggccuucccauuagauaucagaccacagcuaccaaaucugagcacacagggcgcgaaaucguggaccugaugugccaugccaccuuuacgaugcggcugcucagcccugucagagugccgaauuacaaccugauuaucauggaugaggcccacuucacagaccccgcuuccauugcggcccgcggauauaucucuacccggguuggcaugggggaagcugccgccaucuuuaugacagcuaccccucccggaacggccgaugcguucccucagagcaaugcucccauucaggacgaggagagagacaucccggaacgcuccuggaacucuggcaaugaguggauuaccgauuuuguggggaagacagucugguucgugccuagcaucaaagccggcaacgacauugccaacugucuucggaagaauggaaaaaaggugauccaacuguccagaaagaccuuugauacagaauaccagaaaaccaagcucaacgacugggauuucgucguuacaaccgacauuucugagaugggcgcuaauuuuaaagccgaucgggugaucgacccccgcagaugccugaagcccgugauccugacggaugggccugagcgggucauucucgcgggacccaugccugugacagccgcuagcgccgcucagcgcagaggccggguugggagaaacccgcagaaagaaaaugaccaauacaucuucaccggacagccccuuaacaaugaugaggaccaugcccacuggaccgaagcuaagaugcugcuggacaacauuaauacaccugagggcaucauucccgcccucuucgaaccugagcgcgagaaguccgcggccaucgauggggaauaucggcugaaaggcgagagcagaaagaccuuuguggaacuuaugcgccggggagaccugcccgucuggcucgcucacaaaguggccucugagggcaucaaguacacagauagaaaauggugcuucgacgggcagcgcaacaaucagauucuggaagagaacauggauguugagaucuggacgaaggaaggagagaaaaagaagcugcggccgagauggcucgacgcucgcaccuauuccgauccucuugcccugaaagaauuuaaggacuucgccgcuggcagaaaaagcauugcgcuggaucucgugacagagaucgggcggguccccucucaucuggcccaccgcaccagaaaugcucuugacaaccuggugaugcuccauacauccgaacacggaggccgggccuaccgccacgccgucgaggagcugccugaaaccauggagacgcugcuccuucugggccugaugauucuccugaccgggggagcuaugcuuuuucugaucagcggcaaggggaucggaaaaacauccauuggccucaucugugugauugccucuagcgggaugcuguggauggcggaaaucccccugcaauggauugccuccgcuaucguucucgaguucuuuaugauggugcuucugauuccugagcccgaaaagcagagaaccccgcaggauaaucaacuggccuauguggucaucggaauccucacacuggcugccauuaucgcggccaacgagaugggccuucuggaaaccacgaagcgggaccucggcaugagcaaagagccugggguugugucucccacauccuaccuggauguggaccugcaucccgcuagcgccuggacccucuaugcugucgccacaaccgugauuaccccuaugcuuagacacacaaucgaaaauucuacggcuaacguuagccuggccgcgauugccaaccaggcugugguccugaugggacucgacaagggcuggccgaucuccaaaauggaucugggggugccccuucuggcccucggaugcuacucucaggucaauccucugacccugacagcugccgugcuccuucugaucacccauuacgccauuaucggccccgggcugcaggcgaaggcuacacgcgaggcccaaaaacggaccgcugccggaauuaugaagaacccuacgguugacggcaucaugacaauugaucucgaccccgugaucuaugauagcaaguucgagaaacagcugggccaggucaugcuucuggugcucugugccguucagcugcugcucaugagaaccuccugggcucuuugcgaagcccugacccuggcgacagggccuaucaccacacucugggagggaucuccgggcaaguuuuggaauacgaccauugccgugagcauggcuaacaucuuccgcggguccuaccuggccggagcuggccuugccuuuagcauuaugaaaucugucgggacaggaaagcggggcaccggcucccaaggggaaacacugggagagaaauggaagaagaaacucaaucagcugagcagaaaggaauucgaccuguauaaaaaguccggcaucaccgagguggaucggacggaggcgaaagaagggcucaagcgcggagagauuacccaccaugccgugucuagaggcagcgcuaaacuucagugguuuguugaacggaacauggucauccccgaggggcgcgugauugaccugggauguggcagaggcgggugguccuacuauugcgccggacugaagaaggugacagaaguccggggcuacaccaaagggggaccuggccacgaggagcccguuccuaugucuacauauggguggaauaucgugaagcucaugagcggaaaagauguguucuaccugcccccggaaaagugugacacccuucugugcgauaucggcgaguccagcccuucucccacagucgaagagucccgcaccauuagagugcucaaaaugguugagcccuggcugaagaacaaucaguucuguaucaaggugcugaacccuuacaugcccacggucauugaacaccucgagcggcuucaacgcaaacauggcgggaugcuggugagaaauccucugagccggaacucuacacacgaaauguauuggaucuccaauggaaccggcaacauuguugcuagcgugaauauggucucuagacuccugcuuaaccgcuuuaccaugacacaucggagaccgacgaucgagaaggacguggaucugggggccggaacccgccacgugaacgcugaacccgagacaccuaauauggacgucaucggcgagcggauuaaaagaaucaaggaagagcacaacagcaccuggcauuacgacgaugaaaaucccuauaaaacaugggccuaccacggguccuaugagguuaaggcgaccggaucugccagcuccaugauuaacggcguggugaagcuccugacaaaaccuugggacgucgugcccaugguuacccagauggcuaugacggauaccacaccguucggccagcaacgcguguuuaaggaaaaagucgacacccggacaccuagaagcaugcccgggacccgccgggugauggagaucacggccgaguggcuguggagaacacucggacgcaauaagaaaccucggcugugcaccagagaagaguucacaaagaagguucgcaccaacgcugccaugggcgccguguuuacggaagagaaucagugggauuccgcgaaagcugccgucgaagacgaggauuucuggaagcuuguggacagagagcgggaacugcauaaacucgggaaguguggaucuugcguuuacaacaugaugggcaaacgcgagaagaaacugggggaauuuggcaaggccaagggaagcagagcuauuugguauauguggcuuggcgcccgguaccuggaguucgaggcucucggguuucugaaugaagaucacugguucuccagagagaacucuuacagcggaguggaaggcgaggggcugcauaaacucggauauauccugcgggacaucuccaagauucccggcggggccauguacgcggaugacaccgccggcugggacacacgcaucaccgaagaugaccuucacaaugaggagaaaauuacacagcagauggauccugaacacagacaacuggcuaacgccaucuuuaagcucaccuaucagaauaaagucgugaagguccagcggcccacaccgaccggaacggugauggacauuaucucucgcaaggaucagagaggcagcgggcaaguuggaacauacggccugaacaccuucaccaauauggaggcucagcuuauccggcagauggaaggggagggagugcuguccaaagccgaccucgaaaacccucaucugcccgagaagaaaauuacacaguggcuggagaccaagggcgucgaacgccucaaaagaauggcgaucagcggggaugacugcguggugaagcccauugaugaccgguuugccaacgcucugcuugcccugaaugauaugggcaagguucgcaaagacaucccucaauggcagccgucuaagggauggcacgauuggcagcaggugcccuucuguucccaucacuuccacgagcucauuaugaaagacggcagaaagcuggucgugccuugccggccccaagacgaacuuaucgggcgcgcuagaauuagccagggagccggcuggucucugcgggagacagcuugucucgggaaagccuaugcgcagauguggucccugauguacuuucaucgcagagaucugcggcucgccagcaacgcuaucugcucugccguuccugugcacuggguccccacguccagaaccacauggagcauccaugcccaccaucaauggaugaccacagaagacaugcugaccguguggaaucgcgucuggauugaggauaacccuuggauggaggacaagacgcccgugaccacaugggaaaauguuccguaucuuggaaagcgggaggaucagugguguggcucccugaucgggcucaccagcagagcuacaugggcccagaacauuccuaccgcgauccagcaagugcgcucucugauuggcaaugaagaguuccuugacuacaugcccagcaugaaacgguuuagaaaggaggaagaguccgaaggagcuaucugguga

SEQ ID NO: 20428 - RNA, 9873 nt, Artificial Sequence
  derived and/or modified CDS sequence (opt5) from DENV-3__GU131861__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaagcggcgccaccacagaaaccccuacguggaaucgcaaagagcuucuggucacauuuaagaacgcucaugcgaaaaagcaagaagugguugugcucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuuguccugaagaaagagguguccgaaacccagcaugggacaauccucaucaagguugaguaccggggagaagaugcccccuguaagauuccuuucagcaccgaggacggccaagggaaagcgcacaacggaagacugaucacagcuaaucccguggucaccaagaaagaggaacccgugaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguugggggaguccucaacagccugggcaaaauggugcaucagauuuuugggucugccuacaccgcucuguucuccggcgugagcugggucaugaagaucggaauuggcauccuccugaccuggauugggcuuaauucuaaaaacacaagcauguccuuuucuugcaucgccaucggaauuaucacccuguaucucggcgcugugguucaggccgacauggggugugugauuaauuggaagggaaaagagcugaagugcggcagcgggaucuucgucacaaacgaggugcacacguggaccgaacaguacaaguuucaagcggauucccccaaacgccuggccacagcuauugccggcgcuugggagaauggaguuuguggcauccggagcaccacaagaauggaaaaccuucucuggaagcagaucgccaaugagcugaacuauauucugugggaaaauaacaucaaacucaccguggucgugggggacauuaucggaguucuggagcagggcaagcgcacgcuuaccccucagcccauggagcugaaauacucuuggaagacaugggggaaagccaagauugugaccgcugaaacacaaaacuccagcuucaucaucgauggaccuaauacccccgagugcccgucugcgucccgggccuggaacgucugggaaguggaggacuauggcuuuggcguguucacaaccaauauuuggcucaagcugagagaagucuacacgcagcugugugaccaucgccuuaugagcgcugccguuaaagaugagcgggccgugcacgcugacaugggguacuggaucgagucccagaagaacggaucuuggaaacucgaaaaggccagccugauugaggugaaaacaugcaccuggccuaagucccacacccuguggucuaauggcguccucgaaagcgauaugaucauucccaagucccuggcggggccuaucagccagcauaaccacagacccggauaucauacacaaaccgcuggcccuuggcaccuugggaaacuggagcucgacuuuaauuacugcgagggaacgacagugguuaucaccgaaaacuguggcacacgcggccccucucugcggaccacaaccguguccgggaagcugauucacgaguggugcuguagaagcugcacgcuuccgccucuccgguauaugggagaagauggcuguugguacgggauggagauccgccccauuucugaaaaagaggagaauauggucaagucccuggugagcgccggaucuggcaaaguugacaacuucaccaugggggugcugugccucgccauccuguuugaagaggucaugagaggaaaguucggcaagaaacauaugauugcuggcguguucuuuacauucguucuucugcucagcgggcagaucaccuggcgggauaugacacacacccugauuaugaucggauccaaugccagcgacagaaugggcaugggggugacguaucuggcgcuuaucgcuacauuuaagauucagcccuuccuggcccucggauuuuuccugcgcaaacucaccucucgggaaaaccugcuucugggcgucgggcucgccauggcuacaacccugcaacugccugaggauaucgaacagauggccaauggaauugcucuuggccugauggcccucaagcugaucacccaguuugagacauaccagcucuggacggcgcugauuucccuuaccuguagcaacacaauguucacccugacaguggccuggagaaccgcuacgcucauccuggccggcgugucccugcuuccggucugccaaucuagcuccaugcgcaaaacagacuggcugcccauggcuguugccgccaugggggugccuccccucccucuguuuaucuucucucucaaggauacccugaagagacggagcuggccccuuaaugagggagugauggcugucggccugguguccauucuggcgucuagccuccugcgcaacgacguuccuauggccgggccccuuguggcuggaggccugcucaucgccuguuaugucauuaccgggacauccgccgaucugaccguggaaaaagcugccgacaucacaugggaggaagaggcggaacagacgggaguuagccauaaccucaugauuaccguggacgaugacggcacaaugagaaucaaggaugacgagaccgagaauauccugacaguccuucugaaaaccgcucugcucauugugucuggcgucuuuccguacuccaucccugccacgcugcuuguguggcacaccuggcagaagcagacacaacggagcgggguucugugggaugugcccucuccucccgaaacccagaaagccgagcucgaagagggagucuaccgcauuaagcagcagggcaucuucgggaaaacacaagugggaguuggcgugcagaaggagggggucuuucauaccauguggcacgugacaagaggagcugugcugacguauaacggcaagcggcucgaaccgaauugggccuccguuaaaaaggaccugauuagcuacggcgggggauggcgccuuucugcgcaguggcaaaaaggcgaggaaguccaggugaucgcuguggagccugggaagaaccccaaaaauuuccagaccacaccuggaaccuuccagaccacaacgggcgaaauuggggccaucgcccuggauuuuaagcccggaaccuccggcagccccaucauuaacagagagggcaaggucguggggcuguauggaaauggcguugugacaaaaaacgggggauacgucuccggcaucgcucaaaccaaugccgagccugacgggccgacacccgaacucgaggaagagauguucaagaaacggaaccugaccauuauggaucuucacccuggcagcggaaagacgcgcaaauaucugcccgcuaucauuagagaagccaucaagcggagacuccgcacacugauccucgcgccuacccgggugguugccgcugagauggaggaagcccugaagggccuucccauuagauaccagaccacagugaccaaaucugagcauacagggcgcgaaaucgucgaccugaugugccacgcuaccuuuacgaugcggcugcucagcccugugagaguuccgaauuauaaccugauuaucauggaugaggcccauuucacagaccccgccuccauugcugcgcgcggauacaucucuacccgggugggcaugggggaagccgcugccaucuuuaugacagccaccccucccggaacggcugaugccuucccucagagcaaugcgcccauucaggacgaggagagagacaucccggaacgcuccuggaacucuggcaaugaguggauuaccgauuuugcugggaagacagucugguucgugccuagcaucaaagccggcaacgacauugccaacugucuucggaagaauggaaaaaaggugauccaacuguccagaaagaccuuugauacagaauaccagaaaaccaagcucaacgacugggauuucgucguuacaaccgacauuucugagaugggcgcuaauuuuaaagccgaucgggugaucgacccccgcagaugccugaagcccgugauccugacggaugggccugagcgggucauucucgcgggacccaugccugugacagccgcuagcgccgcucagcgcagaggccggguugggagaaacccgcagaaagaaaaugaccaauauaucuucaccggacagccccuuaacaaugaugaggaccacgcccauuggaccgaagcuaagaugcugcuggacaacauuaauacaccugagggcaucauucccgcccucuucgaaccugagcgcgagaaguccgcggccaucgauggggaauaccggcugaaaggcgagagcagaaagaccuuuguggaacuuaugcgccggggagaccugcccgucuggcucgcucacaaaguggccucugagggcaucaaguauacagauagaaaauggugcuucgacgggcagcgcaacaaucagauucuggaagagaacauggauguugagaucuggacgaaggaaggagagaaaaagaagcugcggccgagauggcucgacgcucgcaccuacuccgauccucuugcccugaaagaauuuaaggacuucgccgcuggcagaaaaagcauugcgcuggaucucgugacagagaucgggcggguccccucucaccuggcccaucgcaccagaaaugcucuugacaaccuggugaugcuccacacauccgaacauggaggccgggccuaucgccacgccgucgaggagcugccugaaaccauggagacgcugcuccuucugggccugaugauucuccugaccgggggagcuaugcuuuuucugaucagcggcaaggggaucggaaaaacauccauuggccucaucugugugauugccucuagcgggaugcuguggauggcggaaaucccccugcaauggauugccuccgcuguugugcucgaguucuuuaugauggugcuucugaucccugagcccgaaaagcagagaaccccgcaggauaaucaacuggccuacgucguuauuggaauccucacacuggcugccaucauugcggccaacgagaugggccuucuggaaaccacgaagcgggaccucggcaugagcaaagagccugggguggugucucccacauccuaucuggaugucgaccugcaccccgcuagcgccuggacccucuacgcuguggccacaaccguuaucaccccuaugcuuagacauacaauugaaaauucuacggcuaacgugagccuggccgcgaucgccaaccaggcugucgugcugaugggacucgacaagggcuggccgauuuccaaaauggaucugggggucccccuucuggcccucggaugcuacucucaggugaauccucugacccugacagcugccguucuccuucugaucacccacuaugccaucauuggccccgggcugcaggcgaaggcuacacgcgaggcccaaaaacggaccgcugccggaaucaugaagaacccuacgguggacggcauuaugacaaucgaucucgaccccgucauuuacgauagcaaguucgagaaacagcugggccaggugaugcuucugguucucugugccgugcagcugcugcucaugagaaccuccugggcucuuugcgaagcccugacccuggcgacagggccuaucaccacacucugggagggaucuccgggcaaguuuuggaauacgaccaucgccgucagcauggcuaacauuuuccgcggguccuaucuggccggagcuggccuugccuuuagcaucaugaaaucuguggggacaggaaagcggggcaccggcucccaaggggaaacacugggagagaaauggaagagaaagcucaaucagcugagccggaaagaauucgaccuguacaagaaauccggcauuaccgagguggaucgcacggaggcgaaggaagggcucaaaagaggagagaucacccaucacgccguuucucggggcagcgcuaagcuucagugguuugucgaacgcaacauggugauucccgaggggagagugaucgaccugggauguggccggggcgggugguccuauuacugcgccggacugaaaaaggucacagaaguucgcggcuauaccaaggggggaccuggccaugaggagcccgugccuaugucuacauacggguggaauauugugaaacucaugagcggaaaggaugucuucuaccugcccccggaaaaaugugacacccuucugugcgauaucggcgaguccagcccuucucccacaguggaagaguccagaaccauccggguucucaagaugguggagcccuggcugaaaaacaaucaguucuguauuaagguccugaacccuuauaugcccacggugaucgaacaccucgagcgccuucaaagaaagcacggcgggaugcugguucggaauccucugagcagaaacucuacacaugaaauguacuggauuuccaauggaaccggcaacaucguggcuagcgucaauauggugucucgccuccugcuuaaccgguuuaccaugacacacagacgcccgacgauugagaaagacguggaucugggggccggaacccggcaugucaacgcugaacccgagacaccuaauauggacguuaucggcgagagaaucaagaaaauuaaggaagagcacaacagcaccuggcacuaugacgaugaaaaucccuacaaaacaugggccuaucauggguccuacgaggugaaggcgaccggaucugccagcuccaugaucaacggcguggucaagcuccugacaaaaccuugggacgugguucccauggugacccagauggcuaugacggauaccacaccguucggccagcaacgcgucuuuaaggaaaaaguggacacccggacaccuagaagcaugcccgggacccgccggguuauggagauuacggccgaguggcuguggagaacacucggacgcaauaagaaaccucggcugugcaccagagaagaguucacaaagaaggugcgcaccaacgcugccaugggcgccgucuuuacggaagagaaucagugggauuccgcgaaagcugccguggaagacgaggauuucuggaagcuuguugacagagagcgggaacugcacaaacucgggaaguguggaucuugcguguauaacaugaugggcaaacgcgagaagaaacugggggaauuuggcaaggccaagggaagcagagcuaucugguacauguggcuuggcgcccgguaccuggaguucgaggcucucggguuucugaaugaagaucauugguucuccagagagaacucuuauagcggagucgaaggcgaggggcugcacaaacucggauacauucugcgggacaucuccaagauccccggcggggccauguaugcggaugacaccgccggcugggacacacgcauuaccgaagaugaccuucauaaugaggagaaaaucacacagcagauggauccugaacacagacaacuggcuaacgccauuuuuaagcucaccuaccagaauaaaguggucaaggugcagcggcccacaccgaccggaacgguuauggacaucauuucucgcaaggaucagagaggcagcgggcaagugggaacauauggccugaacaccuucaccaauauggaggcucagcuuauccggcagauggaaggggagggaguccuguccaaagccgaccucgaaaacccucaccugcccgagaagaaaaucacacaguggcuggagaccaagggcguggaacgccucaaaagaauggcgauuagcggggaugacugcgugguuaagcccaucgaugaccgguuugccaacgcucugcuugcccugaaugauaugggcaaggugcgcaaagacauuccucaauggcagccgucuaagggauggcaugauuggcagcagguccccuucuguucccaccauuuccacgagcucaucaugaaagacggcagaaagcuggugguuccuugccggccccaagacgaacuuauugggcgcgcuagaaucagccagggagccggcuggucucugcgggagacagcuugucucgggaaagccuacgcgcagauguggucccugauguauuuucaccgcagagaucugcggcucgccagcaacgcuauuugcucugccgugccuguccauugggugcccacguccagaaccacauggagcauccacgcccaucaccaauggaugaccacagaagacaugcugaccgucuggaaucgcguguggaucgaggauaacccuuggauggaggacaagacgcccguuaccacaugggaaaaugugccguaccuuggaaagcgggaggaucagugguguggcucccugauugggcucaccagcagagcuacaugggcccagaacaucccuaccgcgauucagcaaguccgcucucugaucggcaaugaagaguuccuugacuacaugcccagcaugaaacgguuuagaaaggaggaagaguccgaaggagcuauuugguga

SEQ ID NO: 20429 - RNA, 9873 nt, Artificial Sequence
  derived and/or modified CDS sequence (opt5) from DENV-3__GU131862__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaagcggcgccaccacagaaaccccuacguggaaucgcaaagagcuucuggucacauuuaagaacgcucaugcgaaaaagcaagaagugguugugcucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuuguccugaagaaagagguguccgaaacccagcaugggacaauccucaucaagguugaguaccggggagaagaugcccccuguaagauuccuuucagcaccgaggacggccaagggaaagcgcacaacggaagacugaucacagcuaaucccguggucauuaagaaagaggaacccgugaacaucgaggccgaaccuccguucggcgaguccaauauugugaucgggaucggcgauaacgcccugaagauuaauugguauaaaaagggaucuagcaucggcaagauguuugaagcuaccgcccgcggggcucggagaauggccauucuuggagacacggcgugggauuucggcuccguugggggaguccucaacagccugggcaaaauggugcaucagaucuuugggucugccuacacagcucuguucuccggcgugagcugggucaugaagauuggaaucggcauucuccugaccuggaucgggcuuaauucuaaaaacaccagcauguccuuuucuugcaucgccauuggaaucauuacacuguaucucggcgcugugguucaggccgacaucgggugugugauuaauuggaagggaaaagagcugaagugcggcagcgggaucuucgucaccaacgaggugcacacauggacggaacaguacaaguuucaagcggauucccccaaacgccuggccaccgcuaucgccggcgcuugggagaauggaguuuguggcauucggagcacaaccagaauggaaaaccuucucuggaagcagaucgccaaugagcugaacuauauucugugggaaaauaacaucaaacucacaguggucgugggggacauuaucggaguucuggagcagggcaagcgcacccuuacgccucagcccauggagcugaaauacucuuggaagaccugggggaaagccaagaucgugacagcugaaacccaaaacuccagcuucauuaucgauggaccuaauacacccgagugcccgucugcgucccgggccuggaacgucugggaaguggaggacuauggcuuuggcguguucaccacaaauauuuggcucaagcugagagaagucuacacccagcugugugaccaucgccuuaugagcgcugccguuaaagaugagcgggccgugcacgcugacaugggguacuggaucgagucccagaagaacggaucuuggaaacucgaaaaggccagccugauugaggugaaaacgugcacauggccuaagucccacacccuguggucuaauggcguccucgaaagcgauaugaucauccccaagucccuggcggggccuauuagccagcauaaccacagacccggauaucauacccaaacagcuggcccuuggcaccuugggaaacuggagcucgacuuuaauuacugcgagggaaccacggugguuaucacagaaaacuguggcacccgcggccccucucugcggacaaccacaguguccgggaagcugauucacgaguggugcuguagaagcugcacccuuccgccucuccgguauaugggagaagauggcuguugguacgggauggagauccgccccauuucugaaaaagaggagaauauggucaagucccuggugagcgccggaucuggcaaaguugacaacuucacgaugggggugcugugccucgccauccuguuugaagaggucaugagaggaaaguucggcaagaaacauaugauugcuggcguguucuuuaccuucguucuucugcucagcgggcagaucacauggcgggauaugacccacacacugaucaugauuggauccaaugccagcgacagaaugggcaugggggugaccuaucuggcgcuuaucgcuacguuuaagauucagcccuuccuggcccucggauuuuuccugcgcaaacucacaucucgggaaaaccugcuucugggcgucgggcucgccauggcuaccacacugcaacugccugaggauaucgaacagauggccaauggaauugcucuuggccugauggcccucaagcugaucacccaguuugagaccuaccagcucuggacagcgcugaucucccuuacguguagcaacaccauguucacacugaccguggccuggagaacagcuacccucauucuggccggcgugucccugcuuccggucugccaaucuagcuccaugcgcaaaacggacuggcugcccauggcuguugccgccaugggggugccuccccucccucuguuuaucuucucucucaaggauacacugaagagacggagcuggccccuuaaugagggagugauggcugucggccugguguccauucuggcgucuagccuccugcgcaacgacguuccuauggccgggccccuuguggcuggaggccugcucaucgccuguuaugucauuaccgggaccuccgccgaucugacaguggaaaaagcugccgacaucaccugggaggaagaggcggaacagacaggaguuagccauaaccucaugaucacgguggacgaugacggcaccaugagaauuaaggaugacgagacagagaauauccugaccguccuucugaaaacagcucugcucauugugucuggcgucuuuccguacuccaucccugccacccugcuuguguggcacacguggcagaagcagacccaacggagcgggguucugugggaugugcccucuccucccgaaacacagaaagccgagcucgaagagggagucuaccgcauuaagcagcagggcaucuucgggaaaacccaagugggaguuggcgugcagaaggagggggucuuucauacaauguggcacgugaccagaggagcugugcugacauauaacggcaagcggcucgaaccgaauugggccuccguuaaaaaggaccugauuagcuacggcgggggauggcgccuuucugcgcaguggcaaaaaggcgaggaaguccaggugaucgcuguggagccugggaagaaccccaaaaauuuccagacgaugccuggaaccuuccagacaaccaccggcgaaaucggggccauugcccuggauuuuaagcccggaacauccggcagccccaucauuaacagagagggcaaggucguggggcuguauggaaauggcguugugacgaaaaacgggggauacgucuccggcaucgcucaaaccaaugccgagccugacgggccgacacccgaacucgaggaagagauguucaagaaacggaaccugaccauuauggaucuucacccuggcagcggaaagacacgcaaauaucugcccgcuaucaucagagaagccauuaagcggagacuccgcacccugauccucgcgccuacgcgggugguugccgcugagauggaggaagcccugaagggccuucccauuagauaccagacaaccgcuaccaaaucugagcauacagggcgcgaaaucguggaccugaugugccacgccaccuuuacaaugcggcugcucagcccugucagagugccgaauuauaaccugauuaucauggaugaggcccauuucaccgaccccgcuuccaucgcggcccgcggauacauuucuacgcggguuggcaugggggaagcugccgccaucuuuaugacagcuaccccucccggaacagccgaugcguucccucagagcaaugcucccauucaggacgaggagagagacaucccggaacgcuccuggaacucuggcaaugaguggauuaccgauuuuguggggaagacggucugguucgugccuagcaucaaagccggcaacgacauugccaacugucuucggaagaauggaaaaaaggugauccaacuguccagaaagaccuuugauacagaauaccagaaaaccaagcucaacgacugggauuucgucguuacaaccgacaucucugagaugggcgcuaauuuuaaagccgaucgggugauugacccccgcagaugccugaagcccgugauccugacagaugggccugagcgggucauucucgcgggacccaugccugugaccgccgcuagcgccgcucagcgcagaggccggguugggagaaacccgcagaaagaaaaugaccaauauaucuucacgggacagccccuuaacaaugaugaggaccacgcccauuggacagaagcuaagaugcugcuggacaacauuaauaccccugagggcaucauccccgcccucuucgaaccugagcgcgagaaguccgcggccauugauggggaauaccggcugaaaggcgagagcagaaagaccuuuguggaacuuaugcgccggggagaccugcccgucuggcucgcucacaaaguggccucugagggcaucaaguauacagauagaaaauggugcuucgacgggcagcgcaacaaucagauucuggaagagaacauggauguugagaucuggaccaaggaaggagagaaaaagaagcugcggccgagauggcucgacgcucgcacauacuccgauccucuugcccugaaagaauuuaaggacuucgccgcuggcagaaaaagcauuacgcuggaucucgugaccgagaucgggcggguccccucucaccuggcgcaucgcacaagaaaugcccuugacaaccuggugaugcuccacaccuccgaacauggaggccgggcuuaucgccacgccgucgaggagcugccugaaacaauggagacccugcuccuucugggccugaugauccuccugacggggggagccaugcuuuuucugauuagcggcaaggggaucggaaaaaccuccauuggccucaucugugugauugcuucuagcgggaugcuguggauggccgaaaucccccugcaauggauugcguccgccaucguucucgaguucuuuaugauggugcuucugaucccugagcccgaaaagcagagaacaccgcaggauaaucaacuggcuuacguggucauuggaauccucacccuggccgcuauuaucgccgcgaacgagaugggccuucuggaaacaaccaagcgggaccucggcaugagcaaagagccugggguugugucucccaauuccuaucuggauguggaccugcaccccgccagcgcuuggacgcucuacgccgucgcuacaaccgugauuacaccuaugcuuagacauaccaucgaaaacucuaccgccaacguuagccuggcugccaucgcgaaucaggccgugguccugaugggacucgacaagggcuggccgauuuccaaaauggaucugggggugccccuucuggcucucggaugcuacucucaggucaacccucugacacugacggccgcugugcuccuucugaucacccacuaugccauuaucggccccgggcugcaggccaaggcgacacgcgaggcucaaaaacggaccgccgcuggaauuaugaagaauccuacaguugacggcaucaugaccaucgaucucgaccccgugauuuacgauagcaaguucgagaaacagcugggccaggucaugcuucuggugcucugugccguucagcugcugcucaugagaacguccugggcccuuugcgaagcucugacacuggccaccgggccuaucaccacacucugggagggaucuccgggcaaguuuuggaacaccacaauugcggugagcauggccaauaucuuccgcggguccuaucuggcuggagccggccuugcuuuuagcauuaugaaaucugucgggacgggaaagcggggcaccggcucccaaggggaaacacugggagagaaauggaagaagaaacucaaccagcugagcagaaaggaauucgaccuguacaaaaaguccggcaucaccgagguggaucggacagaggccaaagaagggcucaagcgcggagagauuacccaucacgcggugucuagaggcagcgccaaacuucagugguuuguugaacggaauauggucauccccgaggggcgcgugaucgaccugggauguggcagaggcgggugguccuauuacugcgcuggacugaagaaggugacggaaguccggggcuauaccaaagggggaccuggccaugaggagcccguuccuaugucuacauacggguggaacauugugaagcucaugagcggaaaagauguguucuaccugcccccggaaaagugugacacccuucugugcgauaucggcgaguccagcccuucucccacagucgaagagucccgcaccauuagagugcucaaaaugguugagcccuggcugaagaauaaccaguucuguaucaaggugcugaauccuuauaugcccacagucauugaacaccucgagcggcuucaacgcaaacacggcgggaugcuggugagaaacccucugagccggaauucuacccaugaaauguacuggaucuccaacggaacgggcaauaucguugccagcgugaacauggucucuagacuccugcuuaaccgcuuuacaaugacccaccggagaccgaccauugagaaggacguggaucugggggcuggaacacgccaugugaaugccgaacccgagacgccuaacauggacgucaucggcgagcggauuaaaagaaucaaggaagagcacaauagcaccuggcacuaugacgaugaaaaccccuacaaaacaugggcuuaucauggguccuacgagguuaaggccaccggaucugcgagcuccaugauuaauggcguggugaagcuccugacaaaaccuugggacgucgugcccaugguuacccagauggccaugacagauaccacgccguucggccagcaacgcguguuuaaggaaaaagucgacacccggacaccuagaagcaugcccgggacccgccgggugaugggaaucacagcugaguggcuguggaagacccucggcagaaacaaaaagccucgccugugcacgcgggaggaauucacaaagaaaguuagaaccaaugccgcuaugggggccguguuuacagaggaaaaccagugggauuccgccaaggcggcugucgaggacgaagauuucuggaaacuuguggaccgcgagagagagcugcacaagcucggaaaauguggcucuugcguuuauaauaugauggggaagcgggaaaaaaagcugggcgaguuuggaaaggccaaaggcagccgcgccaucugguacauguggcuuggggcuagauaccuggaauucgaggcccucggauuucugaacgaggaucauugguucucccgggaaaauucuuauagcggcguggagggggaaggacugcacaagcucggcuacauucugagagacaucuccaaaauucccgggggcgcuauguaugccgaugacaccgcgggaugggacacgcggaucaccgaggaugaccuucauaacgaagagaagauuacacagcagauggauccugagcaccgccaacuggccaaugcuaucuuuaaacucaccuaccagaacaaggucgugaagguccagagacccacaccgaccggcacagugauggacaucauuucucggaaagaucagcgcgggagcggacaaguuggcaccuaugggcugaauacguucacaaacauggaagcccagcuuaucagacagauggagggagaaggcgugcuguccaaggcugaccucgagaacccucaccugcccgaaaaaaagauuacccaguggcuggagaccaaaggggucgagcggcucaagcgcauggccaucagcggcgaugacugcguggugaagcccauugaugacagauuugcgaaugcccugcuugcucugaacgauaugggaaaaguucggaaggacaucccucaauggcagccgucuaaaggcuggcaugauuggcagcaggugcccuucuguucccaccauuuccacgaacucauuaugaaggacgggcgcaaacuggucgugccuugcagaccccaagacgagcuuaucggacgggcccgcaucagccagggcgcuggguggucucugagagaaacagccugucucggaaaggcuuacgcccagauguggucccugauguauuuucaccggcgcgaucugagacucgcgagcaaugccauuugcucugcuguuccugugcauuggguccccaccucccggacaacguggagcauccacgcccaucaccaauggaugaccacagaggacaugcugaccguguggaacagagucuggauugaagauaauccuuggauggaggacaagacacccgugaccacgugggagaacguuccguaccuuggcaaacgcgaagaucaguggugugggucccugaucggccucaccagccgggccacaugggcucagaauauuccuaccgccauccagcaagugagaucucugaucggaaacgaggaauuccuugacuacaugcccagcaugaagcgcuuucggaaagaggaggaauccgagggcgcgauuugguga

SEQ ID NO: 20430 - RNA, 9873 nt, Artificial Sequence
  derived and/or modified CDS sequence (opt5) from DENV-3__GU131865__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaagcggcgccaccacagaaaccccuacguggaaucgcaaagagcuucuggucacauuuaagaacgcucaugcgaaaaagcaagaagugguugugcucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuuguccugaagaaagagguguccgaaacccagcaugggacaauccucaucaagguugaguaccggggagaagaugcccccuguaagauuccuuucagcaccgaggacggccaagggaaagcgcacaacggaagacugaucacagcuaaucccguggucaccaagaaagaggaacccgugaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguugggggaguccucaacagccugggcaaaauggugcaucagauuuuugggucugccuacaccgcucuguucuccggcgugagcugggucaugaagaucggaauuggcauccuccugaccuggauugggcuuaauucuaaaaacacaagcauguccuuuucuugcaucgccaucggaauuaucacccuguaucucggcgcugugguucaggccgacauggggugugugauuaauuggaagggaaaagagcugaagugcggcagcgggaucuucgucacaaacgaggugcacacguggaccgaacaguacaaguuucaagcggauucccccaaacgccuggccacagcuauugccggcgcuugggagaauggaguuuguggcauccggagcaccacaagaauggaaaaccuucucuggaagcagaucgccaaugagcugaacuauauucugugggaaaauaacaucaaacucaccguggucgugggggacauuaucggaguucuggagcagggcaagcgcacgcuuaccccucagcccauggagcugaaauacucuuggaagacaugggggaaagccaagauugugaccgcugaaacacaaaacuccagcuucaucaucgauggaccuaauacccccgagugcccgucugcgucccgggccuggaacgucugggaaguggaggacuauggcuuuggcguguucacaaccaauauuuggcucaagcugagagaagucuacacgcagcugugugaccaucgccuuaugagcgcugccguuaaagaugagcgggccgugcacgcugacaugggguacuggaucgagucccagaagaacggaucuuggaaacucgaaaaggccagccugauugaggugaaaacaugcaccuggccuaagucccacacccuguggucuaauggcguccucgaaagcgauaugaucauucccaagucccuggcggggccuaucagccagcauaaccacagacccggauaucauacacaaaccgcuggcccuuggcaccuugggaaacuggagcucgacuuuaauuacugcgagggaacgacagugguuaucaccgaaaacuguggcacacgcggccccucucugcggaccacaaccguguccgggaagcugauucacgaguggugcuguagaagcugcacgcuuccgccucuccgguauaugggagaagauggcuguugguacgggauggagauccgccccauuucugaaaaagaggagaauauggucaagucccuggugagcgccggaucuggcaaaguugacaacuucaccaugggggugcugugccucgccauccuguuugaagaggucaugagaggaaaguucggcaagaaacauaugauugcuggcguguucuuuacauucguucuucugcucagcgggcagaucaccuggcgggauaugacacacacccugauuaugaucggauccaaugccagcgacagaaugggcaugggggugacguaucuggcgcuuaucgcuacauuuaagauucagcccuuccuggcccucggauuuuuccugcgcaaacucaccucucgggaaaaccugcuucugggcgucgggcucgccauggcuacaacccugcaacugccugaggauaucgaacagauggccaauggaauugcucuuggccugauggcccucaagcugaucacccaguuugagacauaccagcucuggacggcgcugauuucccuuaccuguagcaacacaauguucacccugacaguggccuggagaaccgcuacgcucauccuggccggcgugucccugcuuccggucugccaaucuagcuccaugcgcaaaacagacuggcugcccauggcuguugccgccaugggggugccuccccucccucuguuuaucuucucucucaaggauacccugaagagacggagcuggccccuuaaugagggagugauggcugucggccugguguccauucuggcgucuagccuccugcgcaacgacguuccuauggccgggccccuuguggcuggaggccugcucaucgccuguuaugucauuaccgggacauccgccgaucugaccguggaaaaagcugccgacaucacaugggaggaagaggcggaacagacgggaguuagccauaaccucaugauuaccguggacgaugacggcacaaugagaaucaaggaugacgagaccgagaauauccugacaguccuucugaaaaccgcucugcucauugugucuggcgucuuuccguacuccaucccugccacgcugcuuguguggcacaccuggcagaagcagacacaacggagcgggguucugugggaugugcccucuccucccgaaacccagaaagccgagcucgaagagggagucuaccgcauuaagcagcagggcaucuucgggaaaacacaagugggaguuggcgugcagaaggagggggucuuucauaccauguggcacgugacaagaggagcugugcugacguauaacggcaagcggcucgaaccgaauugggccuccguuaaaaaggaccugauuagcuacggcgggggauggcgccuuucugcgcaguggcaaaaaggcgaggaaguccaggugaucgcuguggagccugggaagaaccccaaaaauuuccagaccacaccuggaaccuuccagaccacaacgggcgaaauuggggccaucgcccuggauuuuaagcccggaaccuccggcagccccaucauuaacagagagggcaaggucguggggcuguauggaaauggcguugugacaaaaaacgggggauacgucuccggcaucgcucaaaccaaugccgagccugacgggccgacacccgaacucgaggaagagauguucaagaaacggaaccugaccauuauggaucuucacccuggcagcggaaagacgcgcaaauaucugcccgcuaucauuagagaagccaucaagcggagacuccgcacacugauccucgcgccuacccgggugguugccgcugagauggaggaagcccugaagggccuucccauuagauaccagaccacagugaccaaaucugagcauacagggcgcgaaaucgucgaccugaugugccacgcuaccuuuacgaugcggcugcucagcccugugagaguuccgaauuauaaccugauuaucauggaugaggcccauuucacagaccccgccuccauugcugcgcgcggauacaucucuacccgggugggcaugggggaagccgcugccaucuuuaugacagccaccccucccggaacggcugaugccuucccucagagcaaugcgcccauucaggacgaggagagagacaucccggaacgcuccuggaacucuggcaaugaguggauuaccgauuuugcugggaagacagucugguucgugccuagcaucaaagccggcaacgacauugccaacugucuucggaagaauggaaaaaaggugauccaacuguccagaaagaccuuugauacagaauaccagaaaaccaagcucaacgacugggauuucgucguuacaaccgacauuucugagaugggcgcuaauuuuaaagccgaucgggugaucgacccccgcagaugccugaagcccgugauccugacggaugggccugagcgggucauucucgcgggacccaugccugugacagccgcuagcgccgcucagcgcagaggccggguugggagaaacccgcagaaagaaaaugaccaauauaucuucaccggacagccccuuaacaaugaugaggaccacgcccauuggaccgaagcuaagaugcugcuggacaacauuaauacaccugagggcaucauucccgcccucuucgaaccugagcgcgagaaguccgcggccaucgauggggaauaccggcugaaaggcgagagcagaaagaccuuuguggaacuuaugcgccggggagaccugcccgucuggcucgcucacaaaguggccucugagggcaucaaguauacagauagaaaauggugcuucgacgggcagcgcaacaaucagauucuggaagagaacauggauguugagaucuggacgaaggaaggagagaaaaagaagcugcggccgagauggcucgacgcucgcaccuacuccgauccucuugcccugaaagaauuuaaggacuucgccgcuggcagaaaaagcauugcgcuggaucucgugacagagaucgggcggguccccucucaccuggcccaucgcaccagaaaugcucuugacaaccuggugaugcuccacacauccgaacauggaggccgggccuaucgccacgccgucgaggagcugccugaaaccauggagacgcugcuccuucugggccugaugauucuccugaccgggggagcuaugcuuuuucugaucagcggcaaggggaucggaaaaacauccauuggccucaucugugugauugccucuagcgggaugcuguggauggcggaaaucccccugcaauggauugccuccgcuguugugcucgaguucuuuaugauggugcuucugaucccugagcccgaaaagcagagaaccccgcaggauaaucaacuggccuacgucguuauuggaauccucacacuggcugccaucauugcggccaacgagaugggccuucuggaaaccacgaagcgggaccucggcaugagcaaagagccugggguggugucucccacauccuaucuggaugucgaccugcaccccgcuagcgccuggacccucuacgcuguggccacaaccguuaucaccccuaugcuuagacauacaauugaaaauucuacggcuaacgugagccuggccgcgaucgccaaccaggcugucgugcugaugggacucgacaagggcuggccgauuuccaaaauggaucugggggucccccuucuggcccucggaugcuacucucaggugaauccucugacccugacagcugccguucuccuucugaucacccacuaugccaucauuggccccgggcugcaggcgaaggcuacacgcgaggcccaaaaacggaccgcugccggaaucaugaagaacccuacgguggacggcauuaugacaaucgaucucgaccccgucauuuacgauagcaaguucgagaaacagcugggccaggugaugcuucugguucucugugccgugcagcugcugcucaugagaaccuccugggcucuuugcgaagcccugacccuggcgacagggccuaucaccacacucugggagggaucuccgggcaaguuuuggaauacgaccaucgccgucagcauggcuaacauuuuccgcggguccuaucuggccggagcuggccuugccuuuagcaucaugaaaucuguggggacaggaaagcggggcaccggcucccaaggggaaacacugggagagaaauggaagagaaagcucaaucagcugagccggaaagaauucgaccuguacaagaaauccggcauuaccgagguggaucgcacggaggcgaaggaagggcucaaaagaggagagaucacccaucacgccguuucucggggcagcgcuaagcuucagugguuugucgaacgcaacauggugauucccgaggggagagugaucgaccugggauguggccggggcgggugguccuauuacugcgccggacugaaaaaggucacagaaguucgcggcuauaccaaggggggaccuggccaugaggagcccgugccuaugucuacauacggguggaauauugugaaacucaugaccggaaaggaugucuucuaccugcccccggaaaaaugugacacacuucugugcgauaucggcgagagcuccccuagccccaccguggaagagucuagaacgauccggguucucaagaugguggagcccuggcugaaaaacaaucaguucuguauuaagguccugaacccuuauaugcccacagugaucgaacaccucgagcgccuucaaagaaagcacggcgggaugcugguucggaauccucuguccagaaacagcacccaugaaauguacuggauuucuaauggaaccggcaacaucguggcuuccgucaauauggugagccgccuccugcuuaaccgguuuacaaugacgcacagacgcccgaccauugagaaagacguggaucugggggccggaacacggcaugucaacgcugaacccgagaccccuaauauggacguuaucggcgagagaaucaagcgcauuaaagaagagcacaacucuacauggcacuaugacgaugaaaaucccuacaagaccugggccuaucaugggagcuacgaggugaaagcgacaggauccgccucuagcaugaucaacggcguggucaagcuccugaccaagccuugggacgugguucccauggugacgcagauggcuaugaccgauacaaccccguucggccagcaacgggucuuuaaagaaaagguggacacaagaaccccucgcuccaugcccgggacgcggagaguuauggagauuacagccgaguggcuguggcgcacccucggacggaauaaaaagccuagacugugcacacgcgaagaguucaccaaaaaggugagaacgaacgcugccaugggcgccgucuuuaccgaagagaaucagugggauagcgcgaaggcugccguggaagacgaggauuucuggaaacuuguugaccgggagcgcgaacugcacaagcucgggaaauguggauccugcguguauaacaugaugggcaagagagagaaaaagcugggggaauuuggcaaagccaagggaucucgggcuaucugguacauguggcuuggcgccagauaccuggaguucgaggcucucggguuucugaaugaagaucauugguucagccgggagaacuccuauucuggagucgaaggcgaggggcugcacaagcucggauacauucugcgcgacaucagcaaaauccccggcggggccauguaugcggaugacacagccggcugggacaccagaauuacagaagaugaccuucauaaugaggagaagaucacccagcagauggauccugaacaccggcaacuggcuaacgccauuuuuaaacucacauaccagaauaagguggucaaagugcagcgccccaccccgacgggaacaguuauggacaucauuuccagaaaggaucagcggggcucugggcaagugggaaccuauggccugaacaccuucacaaauauggagguccagcuuauccgccagauggaaggggagggagugcugagcaaggcugaccucgaaaacccucaccugcccgagaaaaagaucacccaguggcuggagacaaaaggcguggaaagacucaagcggauggccauuuccggggaugacugcguugugaaacccaucgaugaccgcuuugcgaacgcccugcuugcucugaaugauaugggcaaggucagaaaggacauuccucaauggcagccgagcaaaggauggcaugauuggcagcaggugcccuucuguucucaccauuuccacgagcucaucaugaaggacggccggaaacugguugugccuugccgcccccaagacgaacuuauugggagagcccggaucucccagggagcuggcuggagccugcgcgagacggccugucucgggaaggcuuacgcccagauguggucucugauguauuuucacagacgggaucugagacucgcguccaacgccauuugcagcgcugucccugugcauuggguccccaccucucgcacaaccugguccauccacgcccaucaccaauggaugacaaccgaagacaugcugacgguguggaaucggguuuggaucgaggauaacccuuggauggaggacaaaacccccgugacaaccugggaaaaugucccguaccuuggaaagagagaggaucagugguguggcagccugauugggcucacaucccgcgccaccugggcucagaacaucccuacggccauucagcaagugcggagccugaucggcaaugaagaguuccuugacuacaugcccucuaugaagagauuucgcaaagaggaagagagcgaaggagcgauuugguga

SEQ ID NO: 20431 - RNA, 9873 nt, Artificial Sequence
  derived and/or modified CDS sequence (opt5) from DENV-3__GU131866__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacagacggucuguggcccuggcuccucacgucgggaugggacuggauacccgcacacaaaccuggaugagcgccgagggcgcuuggagacagguggaaaagguugagacaugggcccuccggcaucccggcuucaccauccuggcgcuuuuucuggcccacuacaucgggacgucccucacacagaaaguggucauuuucauccugcuuaugcuggugaccccuucuaugacaaugcgcuguguuggagugggcaacagagacuuugucgaagggcucagcggagcuaccuggguggaugugguccuggagcauggcgggugcguuaccacaauggccaagaauaagcccacgcuggacauugagcuccagaaaaccgaagcuacacaacuggccacccuucggaagcuguguaucgagggaaaaauuacaaacaucaccacggauucccgcugcccuacacagggcgaagcggugcucccggaggaacaggaccagaauuauguguguaagcacaccuacgucgauagaggcugggggaacggaugcggccuguucgggaaaggaagccuugugaccugcgccaaguuucaaugucuggagcucauugagggcaagguugugcaguaugaaaaucugaaauacacagucaucaucaccgugcacacaggggaccagcaucagguuggaaacgagacgcaaggcgugaccgcugaaauuacaccccaggccucuaccacagaggcuauccugccugaauauggcacccucgggcuggagugcuccccccggacgggacuugacuucaaugagaugauucugcucaccaugaagaacaaagccuggaugguccaccgccagugguuuuucgaucugccucuucccuggacaagcggcgccaccacagaaaccccgacguggaauagaaaggagcugcucgugacauuuaaaaacgcucaugcgaagaaacaagaagucgugguucuggggucucaggagggagccaugcacaccgcucugacaggcgccaccgaaauccagaauuccgggggcaccagcauuuucgccggacaccucaagugucggcugaagauggacaaacuugagcugaagggcaugucuuacgcuaugugcacaaacacguuugugcucaaaaaggaggucuccgaaacccagcaugggacaauccugaucaaaguggaguacaagggagaagaugccccuuguaagauucccuucagcaccgaggacggccaagggaaagcgcacaacggaagacugaucacagcuaauccuguugugaccaagaaagaggaacccgucaacauugaggccgaacccccuuucggcgaguccaauaucgugauugggaucggcgauaacgcccuuaagaucaauugguauaaaaagggaucuagcauuggcaagauguuugaagcuacggcccgcggggcucggagaauggccauccucggagacacagcgugggauuucggcuccguggggggaguucugaacagccugggcaaaaugguccaucagauuuuugggucugccuacaccgcucucuucuccggcgugagcugggugaugaagaucggaauuggcguccugcuuaccuggaucgggcugaauucuaaaaacacaagcauguccuuuucuugcauugccaucggaaucauuacccucuaucugggcgcugugguucaggccgacauggggugugugaucaauuggaagggaaaagagcugaagugcggcagcgggauuuucgucacaaacgaggugcacgcguggacggaacaguacaaguuucaagccgauuccccgaaacgccuugcuaccgccaucgcuggcgccugggagaauggaguuuguggcauucggagcacaaccagaauggaaaaccuccuguggaagcagaucgccaaugagcugaacuauauccucugggaaaauaacauuaaacugacaguggucgugggggacaucauuggaguucuugagcagggcaagcgcacccugacgccccagccuauggagcucaaauacucuuggaagaccugggggaaagcuaagaucgugacagcggaaacccaaaacuccagcuucauuaucgauggacccaauacaccugagugccccucugccucccgggcuuggaacgucugggaaguggaggacuauggcuuuggcguguucaccacaaauaucuggcugaagcugagagaagucuacacccagcuuugugaccaucgccucaugagcgccgccguuaaagaugagcgggcugugcacgccgacaugggguacuggauugagucccagaagaacggaucuuggaaacuggaaaaggcgagccugaucgaggugaaaacgugcacauggccgaagucccacacccucuggucuaauggcguccuggaaagcgauaugauuaucccuaagucccuugcugggcccauuagccagcauaaccacagaccuggauaucauacccaaacagccggccccuggcaccuggggaaacucgagcuggacuuuaauuacugcgagggaaccacggugguuaucacagaaaacuguggcacccgcggcccuucucugcggacaaccacaguguccgggaagcuuauccacgaguggugcuguagaagcugcacccuccccccgcugcgguauaugggagaagauggcuguugguacgggauggagauucgcccuaucucugaaaaagaggagaauauggucaagucccuggugagcgccggaucuggcaaaguugacaacuucacgaugggggugcucugccuggcuauucuuuuugaagaggucaugagaggaaaguucggcaagaaacauaugaucgccggcguguucuuuaccuucguucugcuccugagcgggcagauuacauggcgggauauggcgcacacccugaucaugauuggauccaaugcuagcgacagaaugggcaugggggugacauaucuugcccugaucgccaccuuuaagauccagcccuuccucgcucugggauuuuuccuccgcaaacugacgucucgggaaaaccuucugcucggcgucgggcuggccauggcuacaacccugcaacuucccgaggauauugaacagauggccaauggaaucgcgcugggccucauggcccugaagcucauuacacaguuugagaccuaccagcuguggaccgcucuuaucucccugacauguagcaacacgauguucacccucacaguggccuggagaaccgcuacacugauucuggccggcgugucccuucugccugucugccaaucuagcuccaugcgcaaaaccgacuggcucccgauggccguugcugcgaugggggugcccccucugccccucuuuaucuucucucugaaggauacgcuuaagagacggagcuggccucugaaugagggagugauggccgucggccugguguccauccucgcuucuagccugcuucgcaacgacguucccauggccgggccucugguggccggaggccuccugauugcuuguuaugucaucacagggaccuccgccgaucucaccguggaaaaagcggcugacauuacaugggaggaagaggccgaacagaccggaguuagccauaaccugaugaucacaguggacgaugacggcacgaugagaauuaaggaugacgagaccgagaauauccuuacaguccugcugaaaaccgcccuccugaucgugucuggcgucuuucccuacuccauuccggcuacacuucugguguggcacaccuggcagaagcagacgcaacggagcgggguucucugggaugugccuucucccccugaaacccagaaagccgagcuggaagagggagucuaccgcaucaagcagcagggcauuuucgggaaaacacaagugggaguuggcgugcagaaggagggggucuuucauaccauguggcacgugacaagaggagcggugcucaccuauaacggcaagcggcuggaacccaauugggcuuccguuaaaaaggaccuuaucagcuacggcgggggauggcgccugucugcccaguggcaaaaaggcgaggaaguccaggugauugccguggagccggggaagaacccuaaaaauuuccagacaaugcccggaacguuccagaccacaaccggcgaaaucggggcuauugcccuggauuuuaagccuggaaccuccggcagccccaucaucaacagagagggcaaggucguggggcucuauggaaauggcguugugacaaaaaacgggggauacgucuccggcauugcucaaacgaaugccgagcccgacgggccuaccccggaacuggaggaagagauguucaagaaacggaaccuuacaaucauggaucugcaccccggcagcggaaagacccgcaaauaucucccugcgauugugagagaagccaucaagcggagacugcgcacacucauucuggcucccacccggguuguggccgcugagauggaggaagcccuuaagggccugccuaucagauaccagacgacagccaccaaaucugagcauaccgggcgcgaaaucgucgaccugaugugccacgcuacauuuaccaugcggcuccugagccccgugagaguuccuaauuauaaccuuauuaucauggaugaggcgcauuucacagacccggccuccauugcugcccgcggauacaucucuacccgggugggcaugggggaagccgcugccauuuuuaugacggcgacacccccuggaaccgcugaugccuucccccagagcaaugccccuauccaggacgaggagagagacauccccgaacgcuccuggaacucuggcaaugaguggauuacagauuuugcugggaagaccgucugguucgugccgagcaucaaagccggcaacgacauugcgaacugucugcggaagaauggaaaaaaggugauccaacucuccagaaagacguuugauaccgaauaccagaaaacaaagcugaacgacugggauuucgucguuaccacagacauuucugagaugggcgccaauuuuaaagcugaucgggugaucgacccucgcagaugccugaagcccgugauucucaccgaugggcccgagcgggucauccuugccggaccuaugcccgugacagcugccagcgcugcccagcgcagaggccggguugggagaaacccucagaaagaaaaugaccaauauaucuucaccggacagccgcugaacaaugaugaggaccacgcgcauuggacggaagccaagaugcugcucgacaacauuaauacacccgagggcaucauuccugcucuguucgaacccgagcgcgagaaguccgccgcuaucgauggggaauaccggcuuaaaggcgagagcagaaagaccuuuguggaacugaugcgccggggagaccucccugucuggcuggcccacaaaguggccucugagggcauuaaguauaccgauagaaaauggugcuucgacgggcagcgcaacaaucagauccuggaagagaacauggauguugagaucuggacaaaggaaggagagaaaaagaagcuccggcccagauggcuugacgcucgcaccuacuccgauccgcuggcgcugaaagaauuuaaggacuucgccgcuggcagaaaaagcauugcccucgaucuggugacagagaucgggcgggucccuucucaccuugcccaucgcacgagaaaugcucuggacaaccucgugaugcugcacaccuccgaacauggaggccgggccuaucgccacgcggucgaggagcugcccgaaacaauggagacccuccuucugcugggccucaugauucugcuuacagggggagccaugcuguuucucaucagcggcaaggggauuggaaaaaccuccaucggccugaucugugugauugcuucuagcgggaugcuguggauggccgaaaucccucuccaauggauugcuuccgccaucguucuugaguucuuuaugauggugcugcugauucccgagccugaaaagcagagaacgccccaggauaaucaacucgcguacguggucaucggaauucugacccuugccgcuaucaucgccgcuaacgagaugggccugcucgaaacaaccaagcgggaccugggcaugagcaaagagccggggguugugucuccuacauccuaucuggauguggaccuccaccccgccagcgcuuggacccuuuacgccgucgcgacgacagugauuacccccaugcugagacauacaaucgaaaauucuaccgccaacguuagccuggcugccauugcuaaccaggccgugguccucaugggacuggacaagggcuggccuaucuccaaaauggaucuuggggugccgcugcucgcccugggaugcuacucucaggucaauccccugacccucacagcggcugugcuucugcugauuacgcacuaugccaucaucggcccugggcuccaggcuaaggccacccgcgaggcccaaaaacggacagcugccggaauuaugaagaaccccaccguugacggcaucaugacaauugaucuggacccugugaucuacgauagcaaguucgagaaacagcuuggccaggucaugcugcucgugcugugugcgguucagcugcuccuuaugagaaccuccugggcccugugcgaagcucugacgcucgccacagggcccauuaccacccugugggagggaucuccuggcaaguuuuggaauacaaccaucgcugugagcauggccaacaucuuccgcggguccuaucuugcgggagccggccuggcuuuuagcauuaugaaaucugucgggacaggaaagcggggcacgggcucccaaggggaaacccucggagagaaauggaagaagaaacugaaucagcugagcagaaaggaauucgaccucuacaaaaaguccggcaucacagagguggaucggaccgaggccaaagaagggcuuaagcgcggagagauuacacaucacgcugugucuagaggcagcgccaaacugcagugguuuguugaacggaacauggucaucccggaggggcgcgugauugaccugggauguggcagaggcgggugguccuauuacugcgcuggacucaagaaggugaccgaaguccggggcuauacgaaagggggacccggccaugaggagccuguucccaugucuaccuacggguggaauaucgugaagcugaugagcggaaaagauguguucuaccuuccucccgaaaagugugacacacugcucugcgauauuggcgaguccagcccgucuccuaccgucgaagagucccgcacaaucagagugcugaaaaugguugagcccuggcugaagaacaaucaguucuguaucaaggugcucaaccccuauaugccuaccgucauugaacaccuugagcggcugcaacgcaaacacggcgggaugcuggugagaaauccccucagccggaacucuacacaugaaauguacuggaucuccaauggaaccggcaacauuguugccagcgugaauauggucucuagacugcuucugaaccgcuuuacgaugacacaccggagaccuaccaucgagaaggacguggaucucggggcgggaacccgccaugugaacgccgaaccggagacacccaauauggacgucauuggcgagcggaucaaaagaaucaaggaagagcacaacagcacguggcacuaugacgaugaaaauccuuacaaaaccugggcuuaucauggguccuacgagguuaaggccacaggaucugcuagcuccaugauuaacggcguggugaagcugcugaccaaacccugggacgucgugccuaugguuacacagauggccaugaccgauacaacccccuucggccagcaacgcguguuuaaggaaaaagucgacacgcggaccccgagaagcaugccugggacacgccgggugaugggaaucaccgccgaguggcucuggagaacacugggccgcaauaagaaaccccggcuuugcaccagagaggaauucacgaagaagguucgcacaaacgcggcuaugggggccguguuuaccgaggaaaaucagugggauuccgccaaagcugccgucgaggacgaagauuucuggaagcugguggacagagagcgggagcuccacaaacugggaaaguguggcucuugcguuuauaacaugauggggaaacgcgaaaagaaacuuggcgaguuuggaaaggcuaagggcagcagagccauuugguacauguggcugggggcgcgguaccucgaauucgaggcccugggauuucugaaugaggaucauugguucuccagagaaaacucuuauagcggcguggagggggaaggacuccacaaacugggcuacauccuucgggacauuuccaagaucccugggggcgcuauguaugccgaugacacagcuggaugggacacccgcaucacggaggaugaccugcauaaugaagagaaaauuacccagcagauggaucccgagcacagaaagcucgccaacgcgaucuuuaaacugacauaccaaaauaaggucgugaagguccagcggccuacccccacaggcaccgugauggacauuaucucucgcaaagaucagagagggagcggacagguuggcacauaugggcuuaacaccuucacgaauauggaagcccaacugauucggcagauggagggagaaggcgugcucuccaaggcugaccuggagaacccgcaccugccugaaaaaaagaucacacaguggcucgagaccaaaggggucgagcgccugaagagaauggccaucagcggcgaugacugcguggugaagcccauugaugaccgguuugcuaacgcccuucuggcucucaaugauaugggaaaaguucgcaaggacaucccccaguggcaaccuucuaaaggcuggcaugauuggcagcaggugccguucuguucccaccauuuccacgaacugauuaugaaggacgggagaaaacuugucgugcccugccggccucaggacgagcugaucggacgcgccagaauuagccaaggcgcgggguggucucuccgggaaaccgccugucugggaaaggcuuacgcccagauguggucccugauguauuuucaccgcagagaucuccggcuggccagcaacgcuaucugcucugccguucccgugcauugggucccuacauccagaaccacauggagcauucacgcgcaucaccaguggaugacgaccgaggacaugcuuacaguguggaaucgcgucuggaucgaagauaaccccuggauggaggacaagaccccugugacaaccugggagaauguucccuaccugggcaaacgggaagaucaauggugugggucccucaucggccugacgagcagagcuaccugggcccagaacauuccgacagccauccagcaggugcgcucucuuauuggaaaugaggaauuccuggacuacaugccuagcaugaagcgguuuagaaaagaggaggaauccgagggcgcuaucugguga

SEQ ID NO: 20432 - RNA, 9873 nt, Artificial Sequence
  derived and/or modified CDS sequence (opt5) from DENV-3__GU131868__SS-prME
acaccccugugccucaugaugauccugccugccgcucuugccuuccaccugaccagcagagacggagaaccgcggaugauuguggggaagaacgaacgcggaaaaucccugcuguuuaagacggcgucuggcaucaauauguguacccuuauugcuauggaucugggggagaugugcgacgauacagugaccuacaaauguccccacaucacagaaguugagccugaagacauugauugcugguguaaccucaccagcacaugggugaccuauggaacgugcaaucaggccggcgagagacggcgcgacaagagauccguggcccuggcuccccacgucgggaugggacuggauacccggacacagaccuggaugucugccgagggcgcuuggcgccagguggaaaaaguugagacaugggcccucagacauccuggcuucaccauccuggcgcuuuuucuggcccacuacaucgggacgagccucacacagaagguggucauuuucauccugcuuaugcuggugacccccuccaugacaaugcgguguguuggagugggcaaccgcgacuuugucgaagggcucucuggagcuaccuggguggaugugguccuggagcauggcgggugcguuaccacaauggccaagaauaaaccuacgcuggacauugagcuccagaagaccgaagcuacacaacuggccacccuuagaaaacuguguaucgagggaaagauuacaaacaucaccacggauagccggugcccgacacagggcgaagcggugcuccccgaggaacaggaccagaauuauguguguaaacacaccuacgucgaucgcggcugggggaacggaugcggccuguucgggaagggaucccuugugaccugcgccaaguuucaaugucuggagcucauugagggcaaaguugugcaguaugaaaaucugaaguacacagucaucaucaccgugcacacaggggaccagcaucagguuggaaacgagacgcaaggcgugaccgcugaaauuacaccucaggccagcaccacagaggcuauccugcccgaauauggcacccucgggcuggagugcucuccuagaacgggacuugacuucaaugagaugauucugcucaccaugaaaaacaaggccuggaugguccaccggcagugguuuuucgaucugccccuuccguggacauccggcgccaccacagaaaccccuacguggaaucgcaaagagcugcucgugacauuuaacaaugcucaugcgaagaaacaagaagucgugguucuggggagccaggagggagccaugcacaccgcucugacaggcgccaccgaaauccagaacucugggggcaccuccauuuucgccggacaccucaaguguagacugaagauggacaaacuugagcugaagggcaugagcuacgcuaugugcacaaacacguuugugcucaaaaaggaggucucugaaacccagcaugggacaauccugaucaaaguggaguacaagggagaagaugcccccuguaagauuccuuucuccaccgaggacggccaagggaaagcgcacaauggacggcugaucacagcuaaccccguugugaccaagaaagaggaacccgucaauauugaggccgaaccuccguucggcgagagcaacaucgugauugggaucggcgauaaugcccuuaagaucaacugguauaaaaagggauccucuauuggcaagauguuugaagcuacggccagaggggcucgccggauggccauccucggagacacagcgugggauuucggcagcgucgggggaguucucaauucccugggcaaaaugguccaucagauuuuugggagcgccuacaccgcucucuucucuggcguguccugggugaugaagaucggaauuggcguccugcuuaccuggaucgggcugaacagcaaaaauacaucuaugagcuuuuccugcauugccaucggaaucauuacccucuaucugggcgcugugguucaggccgacauggggugugugaucaacuggaagggaaaagagcugaagugcggcucugggauuuucgucacaaaugaggugcacacguggaccgaacaguacaaguuucaagcggauagccccaaaagacuugccacagcuaucgccggcgcuugggagaacggaguuuguggcauucgcuccaccacacggauggaaaaucuccuguggaagcagaucgccaacgagcugaauuauauccucugggaaaacaacauuaaacugaccguggucgugggggacaucauuggaguucuugagcagggcaagagaacgcugaccccucagcccauggagcucaaauacagcuggaagacaugggggaaagccaagaucgugaccgcugaaacacaaaauucuuccuucauuaucgauggaccuaacacccccgagugcccgagcgcgucucgcgccuggaaugucugggaaguggaggacuauggcuuuggcguguucacaaccaacaucuggcugaagcugcgggaagucuacacgcagcuuugugaccauagacucauguccgcugccguuaaagaugagcgcgccgugcacgcugacaugggguacuggauugagagccagaagaauggauccuggaaacuggaaaaggccucucugaucgaggugaaaacaugcaccuggccuaagagccacacccucugguccaacggcguccuggaaucugauaugauuauccccaagagccuugcggggccuauuucccagcauaaucaccggcccggauaucauacacaaaccgcuggcccuuggcaccuggggaaacucgagcuggacuuuaacuacugcgagggaacgacagugguuaucaccgaaaauuguggcacaagaggccccagccugcgcaccacaaccgugucugggaaacuuauccacgaguggugcugucgguccugcacgcucccgccucugagauauaugggagaagauggcuguugguacgggauggagauucggcccaucagcgaaaaagaggagaacauggucaagucucugguguccgccggaagcggcaaaguugacaauuucaccaugggggugcucugccuggccauucuuuuugaagaggucaugcgcggaaaguucggcaagaaacauaugaucgcuggcguguucuuuacauucguucugcuccugucugggcagauuaccuggagagauauggcccacacacugaucaugauuggaagcaacgcguccgaccggaugggcaugggggugaccuaucuugcucugaucgccacguuuaagauccagcccuuccucgcccugggauuuuuccucagaaaacugacaagccgcgaaaaucuucugcucggcgucgggcuggcuauggccaccacacugcaacuuccugaggauauugaacagauggcuaacggaaucgcccugggccucauggcgcugaagcucauuacccaguuugagaccuaccagcuguggacagcccuuaucucucugacguguuccaauaccauguucacacucaccguggcuuggcggacagccacccugauucuggcuggcgugagccuucugccggucugccaauccucuagcaugagaaaaacggacuggcuccccauggccguugccgcuaugggggugccuccccugccucucuuuaucuucucccugaaggauacacuuaagcgcagaucuuggccccugaacgagggagugauggcggucggccuggugagcauccucgccuccucucugcuucggaacgacguuccuauggcugggccccugguggccggaggccuccugauugccuguuaugucaucaccgggaccagcgcugaucucacaguggaaaaagccgcggacauuaccugggaggaagaggcugaacagacaggaguuucccauaaucugaugaucacgguggacgaugacggcaccaugcgcauuaaggaugacgagacagagaacauccuuaccguccugcugaaaacagcccuccugaucgugagcggcgucuuuccguacucuauuccugccacccuucugguguggcacacguggcagaagcagacccaaagauccgggguucucugggaugugcccagcccucccgaaacacagaaagcugagcuggaagagggagucuaccggaucaagcagcagggcauuuucgggaaaacccaagugggaguuggcgugcagaaggagggggucuuucauacaauguggcacgugacccgcggagccgugcucacauauaauggcaagagacuggaaccgaacugggcgucuguuaaaaaggaccuuaucuccuacggcgggggauggcggcugagcgcucaguggcaaaaaggcgaggaaguccaggugauugccguggagccugggaagaaucccaaaaacuuccagacgaugccuggaaccuuccagacaaccaccggcgaaaucggggccauugcucuggauuuuaagcccggaacaucuggcucccccaucaucaaucgcgagggcaaggucguggggcucuauggaaacggcguugugacgaaaaaugggggauacgucagcggcauugcccaaaccaaggcugagccugacgggccgacacccgaacuggaggaagagauguucaaaaagagaaaccuuaccaucauggaucugcacccuggcuccggaaaaacacggaaguaucuccccgccauugugcgcgaagcgaucaagagacggcugagaacccucauucuggccccuacgcgcguuguggcugccgagauggaggaagcucuuaaaggccugcccauccgguaccagacaaccgccaccaagagcgagcauacagggagagaaaucgucgaccugaugugccacgccaccuuuacaaugcgccuccugucuccugugcggguuccgaauuauaaccuuauuaucauggaugaggcucauuucaccgaccccgcgagcauugccgcuagaggauacaucuccacgcgcgugggcaugggggaagccucugccauuuuuaugacagcuaccccucccggaacagccgaugcguucccucagagcaaugcucccauccaggacgaggagcgggacaucccggaaagauccuggaacucuggcaaugaguggauuaccgauuuugccgggaaaacggucugguucgugccuagcaucaaggccggcaacgacauugcuaacugucugcgcaaaaauggaaagaaggugauccaacucucccggaaaaccuuugauacagaauaccagaagaccaaacugaacgacugggauuucgucguuacaaccgacauuucugagaugggcgccaauuuuaaggcggauagagugaucgacccccggcgcugccugaaacccgugauucucacagaugggccugagagagucauccuugccggacccaugccugugaccgcugccagcgcugcccagcggcgcggcagaguugggcggaacccgcagaaggaaaaugaccaauauaucuucacgggacagccccugaacaaugaugaggaccacgcucauuggacagaagccaagaugcugcucgacaacauuaauaccccugagggcaucauucccgcgcuguucgaaccugagagagagaaauccgccgcuaucgauggggaauaccgccuuaagggcgagagccggaaaaccuuuguggaacugaugagacgcggagaccuccccgucuggcuggcccacaagguggcuucugagggcauuaaauauacagaucggaaguggugcuucgacgggcagagaaacaaucagauccuggaagagaacauggauguugagaucuggaccaaagaaggagagaagaagaaacuccgcccgcgguggcuugacgccagaacauacuccgauccucuggcccugaaggaauuuaaagacuucgcugcgggccgcaagagcauugcccucgaucuggugacggagaucgggagaguccccucucaccuugcucaucggacccgcaaugcccuggacaaccucgugaugcugcacacauccgaacauggaggcagagccuaucggcacgcugucgaggagcugccugaaaccauggagacacuccuucugcugggccucaugauucugcuuaccgggggagccaugcuguuucucaucagcggcaaagggauuggaaagacguccaucggccugaucugugugauugcgucuagcgggaugcuguggauggccgaaaucccccuccaauggauugcuuccgccaucguucuugaguucuuuaugauggugcugcugauuccugagcccgaaaagcagcgcaccccgcaggauaaucaacucgcuuacguggucaucggcauucugacacuugccgcgaucaucgccgcuaacgagaugggccugcucgaaaccacaaaaagagaccugggcaugagcaaggagccuucuguugugucccccaccagcuaucuggauguggaccuccaccccgccucugcuuggacgcuuuacgccgucgcuacaaccgugauuacaccuaugcugcggcauaccaucgaaaauagcaccgccaacguuucccuggcggccauugcuaaccaggccgugguccucauggggcuggacaaaggauggccgaucucuaagauggaucuuggcgugccccugcucgcucuggggugcuacagccaggucaauccucugacacucacggccgccguguuccuucugauuacccacuaugcgaucaucggacccggccugcaggcuaaagccacaagagaggcucaaaagcgcaccgccgccgggauuaugaagaacccuacaguugacggaaucaugaccauugaucucgaccccgugaucuacgauuccaaauuugagaagcagcugggccaggucaugcuucuggugcucugugcuguucagcugcugcucaugcggacgucuugggcccuuugcgaagcgcugacacuggccaccggcccuauuaccacacucugggaggggagcccgggaaaauucuggaauaccacaaucgcuguguccauggccaacaucuuuagaggcagcuaucuggcuggggccggacuugcguucucuauuaugaaguccgucggcacggggaaacgcggaaccggcagccaaggcgaaacacugggggagaaguggaagaaaaagcucaaucagcugucccggaaagaauuugaccuguacaagaaaucuggaaucaccgagguggauagaacagaggccaaggaaggccucaaacgcggggagauuacccaucacgcugugagccggggauccgccaaacuucagugguucguugaaagaaacauggucauccccgagggccgggugauugaccugggguguggacgcggcggcuggucuuauuacugcgcugggcugaagaaagugacggaagucagaggauauaccaagggcgggccuggacaugaggagcccguuccuaugagcacauacggcuggaauaucgugaaacucauguccgggaaggauguguucuaccugcccccggaaaaaugugacacccuucugugcgauauuggagagagcucuccuucccccacagucgaagagagccggaccauccgcgugcucaagaugguugagcccuggcugaagaacaaucaguuuuguaucaaagugcugaacccuuauaugcccacagucauugaacaccucgagagacuucaacggaagcacggcggcaugcuggugcgcaauccucugucuagaaacuccacccaugaaauguacuggaucagcaaugggacgggaaacauuguugccucugugaauauggucagccggcuccugcuuaacagauucacaaugacccaccgccggccgaccaucgagaaagacguggaucugggcgcugggacaagacaugugaacgccgaacccgagacgccuaauauggacgucauuggagagcgcaucaagcggaucaaagaagaacacaacuccaccuggcacuaugacgaugaaaaucccuacaagacaugggcguaucauggcucuuacgagguuaaggccaccgggagcgcuuccagcaugauuaacggaguggugaaacuccugacaaagccuugggacgucgugcccaugguuacccagauggccaugacagauaccacgccguuuggccagcaaagaguguucaaagaaaaggucgacacccgcacaccucgguccaugcccggcaccagacgcgugauggggaucacagcugaguggcuguggcggacccucggaagaaauaaaaagccucgccugugcacgcgggaggaauuuacaaagaaaguuagaaccaacgccgccaugggcgcgguguucacagaggaaaaucagugggauucugcuaaggccgccgucgaggacgaagauuuuuggaaacuuguggaccgcgagagagagcugcacaagcucgggaaauguggaagcugcguuuauaacaugaugggcaagcgggagaagaagcugggggaguucggcaaggcuaaaggaucccgcgccauuugguacauguggcuuggcgcuagauaccuggaauuugaggcccucggguuccugaaugaggaucauugguuuucucgggaaaacagcuauuccggaguggagggcgaagggcugcacaagcucggauacauccugagagacauuucuaaaauccccggcggggcgauguaugccgaugacaccgcuggcugggacacgcggaucaccgaggaugaccuucauaaugaagagaagauuacacagcagauggauccugagcaccgccaacuggccaacgcuaucuucaaacucaccuaccagaauaaggucgugaagguccagagacccacaccgaccggaacagugauggacauuaucagccggaaagaucagcgcggcuccgggcaaguuggaaccuauggccugaacacguuuacaaauauggaagcccagcuuauuagacagauggagggggaaggagugcugagcaaggcggaccucgagaacccucaucugcccgagaagaagaucacccaguggcuggagaccaaaggcgucgagcggcucaagcgcauggccaucucuggggaugacugcguggugaagcccauugaugacagauucgcuaacgcccugcuugcucugaaugauaugggcaaaguucggaaggacaucccucaauggcagccguccaaaggauggcaugauuggcaacaggugcccuucuguagccaccauuuucacgaacucauuaugaaggacggccgcaaacuggucgugccuugcagaccccaagacgagcuuaucgggcgggcccgcauuucucagggagcuggcuggucccugagagaaacagccugucucgggaaggcguacgcccagauguggagccugauguauuuccaccggcgcgaucugagacucgcuucuaacgccaucugcuccgccguuccugugcauuggguccccaccagccggacaacgugguccauucacgcucaucaccaauggaugaccacagaggacaugcugaccguguggaauagagucuggaucgaagauaacccuuggauggaggacaagacacccgugaccacgugggagaauguuccguaccuuggaaaacgcgaagaucagugguguggcagccugaucgggcucaccucucgggccacaugggcgcagaacauuccuaccgcuauccagcaagugagaagccugauuggcaaugaggaauuucuugacuacaugcccuccaugaagcgcuuccggaaagaggaggaaucugagggagccaucugguga

SEQ ID NO: 20433 - RNA, 9873 nt, Artificial Sequence
  derived and/or modified CDS sequence (opt5) from DENV-3__GU131869__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaagcggcgccaccacagaaaccccuacguggaaucgcaaagagcuucuggucacauuuaagaacgcucaugcgaaaaagcaagaagugguugugcucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuuguccugaagaaagagguguccgaaacccagcaugggacaauccucaucaagguugaguaccggggagaagaugcccccuguaagauuccuuucagcaccgaggacggccaagggaaagcgcacaacggaagacugaucacagcuaaucccguggucaccaagaaagaggaacccgugaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacauugcgugggauuucggcuccguugggggaguccucaacagccugggcaaaauggugcaucagaucuuugggucugccuacacagcucuguucuccggcgugagcugggucaugaagauuggaaucggcauucuccugaccuggaucgggcuuaauucuaaaaacaccagcauguccuuuucuugcaucgccauuggaaucauuacacuguaucucggcgcugugguucaggccgacauggggugugugaucaauuggaagggaaaagagcugaagugcggcagcgggauuuucgucaccaacgaggugcacacauggacggaacaguacaaguuucaagcggauucccccaaacgccuggccaccgcuaucgccggcgcuugggagaauggaguuuguggcauccggagcacaaccagaauggaaaaccuucucuggaagcagauugccaaugagcugaacuauauccugugggaaaauaacauuaaacucacaguggucgugggggacaucauuggaguucuggagcagggcaagcgcacccuuacgccucagcccauggagcugaaauacucuuggaagaccugggggaaagccaagaucgugacagcugaaacccaaaacuccagcuucaucauugauggaccuaauacacccgagugcccgucugcgucccgggccuggaacgucugggaaguggaggacuauggcuuuggcguguucaccacaaauaucuggcucaagcugagagaagucuacacccagcugugugaccaucgccuuaugagcgcugccguuaaagaugagcgggccgugcacgcugacaugggguacuggauugagucccagaagaacggaucuuggaaacucgaaaaggccagccugaucgaggugaaaacgugcacauggccuaagucccacacccuguggucuaauggcguccucgaaagcgauaugauuauccccaagucccuggcggggccuaucagccagcauaaccacagacccggauaucauacccaaacagcuggcccuuggcaccuugggaaacuggagcucgacuuuaauuacugcgagggaaccacggugguuauuacagaaaacuguggcacccgcggccccucucugcggacaaccacaguguccgggaagcugauccacgaguggugcuguagaagcugcacccuuccgccucuccgguauaugggagaagauggcuguugguacgggauggagauucgccccaucucugaaaaagaggagaauauggucaagucccuggugagcgccggaucuggcaaaguugacaacuucacgaugggggugcugugccucgccauucuguuugaagaggucaugagaggaaaguucggcaagaaacauaugaucgcuggcguguucuuuaccuucguucuucugcucagcgggcagauuacauggcgggauaugacccacacacugaucaugaucggauccaaugccagcgacagaaugggcaugggggugaccuaucuggcgcuuauugcuacguuuaagauccagcccuuccuggcccucggauuuuuccugcgcaaacucacaucucgggaaaaccugcuucugggcgucgggcucgccauggcuaccacacugcaacugccugaggauauugaacagauggccaauggaaucgcucuuggccugauggcccucaagcugauuacccaguuugagaccuaccagcucuggacagcgcugaucucccuuacguguagcaacaccauguucacacugaccguggccuggagaacagcuacccucauccuggccggcgugucccugcuuccggucugccaaucuagcuccaugcgcaaaacggacuggcugcccauggcuguugccgccaugggggugccuccccucccucuguuuauuuucucucucaaggauacacugaagagacggagcuggccccuuaaugagggagugauggcugucggccugguguccauccuggcgucuagccuccugcgcaacgacguuccuauggccgggccccuuguggcuggaggccugcucauugccuguuaugucaucaccgggaccuccgccgaucugacaguggaaaaagcugccgacauuaccugggaggaagaggcggaacagacaggaguuagccauaaccucaugaucacgguggacgaugacggcaccaugagaaucaaggaugacgagacagagaauauucugaccguccuucugaaaacagcucugcucaucgugucuggcgucuuuccguacuccauuccugccacccugcuuguguggcacacguggcagaagcagacccaacggagcgggguucugugggaugugcccucuccucccgaaacacagaaagccgagcucgaagagggagucuaccgcaucaagcagcagggcauuuucgggaaaacccaagugggaguuggcgugcagaaggagggggucuuucauacaauguggcacgugaccagaggagcugugcugacauauaacggcaagcggcucgaaccgaauugggccuccguuaaaaaggaccugaucagcuacggcgggggauggcgccuuucugcgcaguggcaaaaaggcgaggaaguccaggugauugcuguggagccugggaagaaccccaaaaauuuccagacgaccccuggaacauuccagaccaccacaggcgaaaucggggccaucgcccuggauuuuaagcccggaacguccggcagccccauuaucaacagagagggcaaggucguggggcuguauggaaauggcguugugaccaaaaacgggggauacgucuccggcauugcucaaacaaaugccgagccugacgggccgacccccgaacucgaggaagagauguucaagaaacggaaccugacaaucauggaucuucacccuggcagcggaaagacccgcaaauaucugcccgcuauuaucagagaagccaucaagcggagacuccgcacgcugauucucgcgccuacacgggugguugccgcugagauggaggaagcccugaagggccuucccaucagauaccagaccaccgcuacacgcucugagcauaccgggcgggaaauuguggaccugaugugccacgccacauuuaccaugagacugcucagcccuguccgcgugccgaauuauaaccugaucauuauggaugaggcccauuucacggaccccgcuuccaucgcggcccggggauacaucucuacaagaguuggcaugggggaagcugccgccauuuuuaugaccgcuacaccucccggaaccgccgaugcguucccucagagcaaugcucccauccaggacgaggagcgcgacauuccggaacgguccuggaacucuggcaaugaguggaucacggauuuugccgggaaaaccgugugguucgucccuagcauuaaggccggcaacgacaucgcuaacugucuuagaaaaaauggaaagaaagugauucaacugucccggaagacauuugauaccgaauaccagaagacaaaacucaacgacugggauuucguggucaccacagacaucucugagaugggcgccaauuuuaaggcggaucgcguuaucgaccccagacggugccugaaacccgugauucugaccgaugggccugagcgcgugauccucgccggacccaugccugucacggcugccagcgcugcccagagacggggcagaguggggcgcaacccgcagaaggaaaaugaccaauauauuuucacaggacagccccuuaacaaugaugaggaccacgcucauuggaccgaagccaaaaugcugcuggacaacaucaauaccccugagggcauuauccccgcgcucuucgaaccugagcgggagaaguccgccgcuaucgauggggaauacagacugaagggcgagagccgcaaaacauuuguugaacuuaugcggagaggagaccugcccguguggcucgcccacaaggucgcuucugagggcauuaaauauaccgaucgcaaguggugcuucgacgggcagcggaacaaucagauccuggaagagaacauggauguggagauuuggacaaaagaaggagagaagaaaaagcugagaccgcgcuggcucgacgccagaacguacuccgauccucuugcccugaaggaauuuaaagacuucgcugcgggccggaagagcaucgcccuggaucucguuaccgagauugggcgcgugcccucucaccuggcucauagaacacggaaugcccuugacaaccuggucaugcuccacaccuccgaacauggaggccgcgccuauagacacgcuguggaggagcugccugaaacaauggagacccugcuccuucugggccugaugauccuccugacggggggagccaugcuuuuucugaucagcggcaaagggauuggaaagaccuccaucggccucauuugugucaucgcgucuagcgggaugcuguggauggccgaaauuccccugcaauggaucgcuuccgccauugugcucgaguucuuuaugaugguucuucugaucccugagcccgaaaaacagcggacaccgcaggauaaucaacuggcuuacguggugaucggaauucucacccuggccgcgaucauugccgcuaacgagaugggccuucuggaaacaaccaagagagaccucggcaugagcaaggagccuggggucguuucucccacguccuaucuggauguggaccugcaccccgccagcgcuuggacacucuacgccguggcuaccacagucaucaccccuaugcuucgccauaccauugaaaauucuacagccaacgugagccuggcggccaucgcuaaccaggccguugugcugaugggacucgacaaaggcuggccgaucuccaagauggaucugggggucccccuucuggcucucggaugcuacucucaggugaauccucugacgcugaccgccgccguccuccuucugauuacacacuaugcgaucauuggccccgggcugcaggcuaaagccacccgggaggcucaaaagagaacagccgccggaaucaugaaaaacccuaccguggacggcauuaugacgaucgaucucgaccccguuaucuacgauagcaaguucgagaagcagcugggccaggugaugcuucugguccucugugcugugcagcugcugcucaugcgcacauccugggcccuuugcgaagcgcugacccuggccaccgggccuauuacaacccucugggagggaucuccgggcaaauuuuggaauacaacgaucgcuguuagcauggccaacauuuuccggggguccuaucuggcuggagccggccuugcguuuagcaucaugaagucuguggggaccggaaaaagaggcacaggcucccaaggggaaacccugggagagaaguggaaaaagaagcucaaucagcugagccggaaagaauucgaccuguacaagaaauccggcauuacagaggucgaucgcaccgaggccaaggaagggcucaaaagaggagagaucacgcaucacgcugugucucggggcagcgccaagcuucagugguuuguggaacgcaacaugguuauucccgaggggagagucaucgaccugggauguggccggggcgggugguccuauuacugcgcuggacugaaaaaggugaccgaagugcgcggcuauacaaaggggggaccuggccaugaggagcccgucccuaugucuaccuacggguggaauaucguuaaacucaugagcggaaaggauguguucuaccugcccccggaaaaaugugacacacuucugugcgauauuggcgaguccagcccuucucccaccguggaagaguccagaacaauccggguccucaagaugguggagcccuggcugaaaaacaaucaguucuguauuaagguucugaacccuuauaugcccaccgugaucgaacaccucgagcgccuucaaagaaagcacggcgggaugcugguccggaauccucugagcagaaacucuacgcaugaaauguacuggauuuccaauggaacaggcaacaucguggccagcguuaauauggugucucgccuccugcuuaaccgguuuaccaugacccacagacgcccgacaaucgagaaagacgucgaucugggggcuggaacgcggcaugugaacgccgaacccgagaccccuaauauggacgugauuggcgagagaaucaagcgcauuaaagaagagcacaacagcacauggcacuaugacgaugaaaaucccuacaagaccugggcguaucauggguccuacgaggucaaagccacaggaucugcuagcuccaugaucaacggcguugugaagcuccugaccaagccuugggacgugguccccauggugacacagauggccaugaccgauacgaccccguucggccagcaacggguuuuuaaagaaaagguggacacaagaaccccucgcagcaugcccgggacacggagagucauggagauuaccgcugaguggcuguggcgcacgcucggacggaauaaaaagccuagacugugcacacgcgaagaguucaccaaaaaggugagaacaaacgccgccaugggcgcgguuuuuaccgaagagaaucagugggauuccgcuaaggccgccguggaagacgaggauuucuggaaacuugucgaccgggagcgcgaacugcacaagcucgggaaauguggaucuugcguguauaacaugaugggcaagagagagaaaaagcugggggaauuuggcaaagcuaagggaagccgggccaucugguacauguggcuuggcgcuagauaccuggaguucgaggcccucggguuucugaaugaagaucauugguucucccgggagaacucuuauagcggaguugaaggcgaggggcugcacaagcucggauacauccugcgcgacauuuccaaaauccccggcggggcgauguaugccgaugacacggcuggcugggacaccagaauuacagaagaugaccuucauaaugaggagaagaucacccagcagauggauccugaacaccggcaacuggccaacgcuauuuuuaaacucacauaccagaauaagguggucaaagugcagcgccccaccccgacaggaaccgucauggacaucaucucuagaaaggaucagcggggcagcgggcaagugggaacguauggccugaacacauucaccaauauggaggcccagcuuauucgccagauggaaggggagggaguucuguccaaggcggaccucgaaaacccucaccugcccgagaaaaagaucacccaguggcuggagacaaaaggcguggaaagacucaagcggauggccauuagcggggaugacugcgucgugaaacccaucgaugaccgcuuugcuaacgcccugcuugcucugaaugauaugggcaaggugagaaaggacauuccucaauggcagccgucuaaaggauggcaugauuggcagcagguucccuucuguucccaccauuuccacgagcucaucaugaaggacggccggaaacugguggucccuugccgcccccaagacgaacuuauugggagagcccggaucagccagggagcuggcuggucucugcgcgagaccgccugucucgggaaggcguacgcccagauguggucccugauguauuuucacagacgggaucugagacucgcuagcaacgccaucugcucugccgugccuguucauugggugcccacaucccgcacgaccuggagcauucacgcucaucaccaauggaugacaaccgaagacaugcugacagucuggaaucggguguggaucgaggauaacccuuggauggaggacaaaacccccgucacgaccugggaaaaugugccguaccuuggaaagagagaggaucagugguguggcucccugauugggcucacaagccgcgccaccugggcgcagaacaucccuacagcuauucagcaaguucggucucugaucggcaaugaagaguuccuugacuacaugcccagcaugaagagauuucgcaaagaggaagaguccgaaggagccaucugguga

SEQ ID NO: 20434 - RNA, 9873 nt, Artificial Sequence
  derived and/or modified CDS sequence (opt5) from DENV-3__GU131870__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuugugcugaagaaagaggucuccgaaacccagcaugggacaauccucaucaagguggaguaccggggagaagaugcccccuguaagauuccuuucagcaccgaggacggccaagggaaagcgcacaacggaagacugaucacagcuaaucccguugugaccaagaaagaggaacccgucaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguggggggaguucucaacagccugggcaaaaugguccaucagauuuuugggucugccuacaccgcucuguucuccggcgugagcugggugaugaagaucggaauuggcauccuccugaccuggauugggcuuaauucuaaaaacacaagcauguccuuuucuugcaucgccaucggaauuaucacccuguaucucggcgcugucgugcaggccgacaugggguguguuauuaauuggaagggaaaagagcugaagugcggcagcgggaucuucgugacaaacgagguccacacguggaccgaacaguacaaguuucaagcggauucccccaaacgccuggccacagcuauugccggcgcuugggagaauggaguguguggcauccggagcaccacaagaauggaaaaccuucucuggaagcagaucgccaaugagcugaaccauauucugugggaaaauaacaucaaacucaccguuguggucggggacauuaucggagugcuggagcagggcaagcgcacgcuuaccccucagcccauggagcugaaauauucuuggaagacaugggggaaagccaagauuguuaccgcugaaacacaaaacuccagcuucaucaucgauggaccuaauacccccgagugcccgucugcgucccgggccuggaacgugugggaagucgaggacuacggcuuuggcguguucacaaccaauauuuggcucaagcugagagaaguguauacgcagcugugugaccaccgccuuaugagcgcugccgucaaagaugagcgggccguucacgcugacaugggguacuggaucgagucccagaagaacggaucuuggaaacucgaaaaggccagccugauugaggugaaaacaugcaccuggccuaagucccauacccuguggucuaauggcgugcucgaaagcgauaugaucauucccaagucccuggcggggccuaucagccagcacaaccauagacccggauaccacacacaaaccgcuggcccuuggcaccuugggaaacuggagcucgacuuuaauuauugcgagggaacgacagucgugaucaccgaaaacuguggcacacgcggccccucucugcggaccacaaccguuuccgggaagcugauucaugaguggugcuguagaagcugcacgcuuccgccucuccgguacaugggagaagauggcuguugguaugggauggagauccgccccauuucugaaaaagaggagaauauggugaagucccuggucagcgccggaucuggcaaaguggacaacuucaccauggggguucugugccucgccauccuguuugaagaggugaugagaggaaaguucggcaagaaacacaugauugcuggcgucuucuuuacauucgugcuucugcucagcgggcagaucaccuggcgggauaugacacauacccugauuaugaucggauccaaugccagcgacagaaugggcauggggguuacguaccuggcgcuuaucgcuacauuuaagauucagcccuuccuggcccucggauuuuuccugcgcaaacucaccucucgggaaaaccugcuucugggcguggggcucgccauggcuacaacccugcaacugccugaggauaucgaacagauggccaauggaauugcucuuggccugauggcccucaagcugaucacccaguuugagacauaucagcucuggacggcgcugauuucccuuaccuguagcaacacaauguucacccugacagucgccuggagaaccgcuacgcucauccuggccggcgugucccugcuuccggugugccaaucuagcuccaugcgcaaaacagacuggcugcccauggcugucgccgccauggggguuccuccccucccucuguuuaucuucucucucaaggauacccugaagagacggagcuggccccuuaaugagggagugauggcugugggccuggucuccauucuggcgucuagccuccugcgcaacgacgugccuauggccgggccccuuguugcuggaggccugcucaucgccuguuacgugauuaccgggacauccgccgaucugaucgucgaaaaagcugccgacauuaccugggaggaagaggcggaacagacaggagugagccacaaccucaugaucacgguugacgaugacggcaccaugagaaucaaggaugacgagacagagaauauucugaccgugcuucugaaaacagcucugcucaucgucucuggcguguuuccguauuccauuccugccacccugcuugucuggcauacguggcagaagcagacccaacggagcggggugcugugggauguucccucuccucccgaaacacagaaagccgagcucgaagagggaguguaccgcaucaagcagcagggcauuuucgggaaaacccaagucggagugggcguucagaaggaggggguguuucacacaauguggcacgucaccagaggagcugugcugacauacaacggcaagcggcucgaaccgaauugggccuccgugaaaaaggaccugaucagcuauggcgggggauggcgccuuucugcgcaguggcaaaaaggcgaggaaguucaggucauugcuguggagccugggaagaaccccaaaaauuuccagacgaugccuggaaccuuccagacaaccaccggcgaaaucggggccaucgcccuggauuuuaagcccggaacauccggcagccccauuaucaacagagagggcaagguggucgggcuguacggaaauggcgugguuacgaaaaacgggggauauguguccggcauugcucaaaccaaugccgagccugacgggccgacacccgaacucgaggaagagauguucaagaaacggaaccugaccaucauggaucuucauccuggcagcggaaagacacgcaaauaccugcccgcuauuaucagagaagccaucaagcggagacuccgcacccugauucucgcgccuacgcgggucguggccgcugagauggaggaagcccugaagggccuucccaucagauaucagacaaccgcuaccaaaucugagcacacagggcgcgaaauuguugaccugaugugccaugccaccuuuacaaugcggcugcucagcccugugagagucccgaauuacaaccugaucauuauggaugaggcccacuucaccgaccccgcuuccaucgcggcccgcggauauaucucuacgcgggugggcaugggggaagcugccgccauuuuuaugacagcuaccccucccggaacagccgaugcguucccucagagcaaugcucccauccaggacgaggagagagacauuccggaacgcuccuggaacucuggcaaugaguggaucaccgauuuugccgggaagacgguuugguucgugccuagcauuaaagccggcaacgacaucgcuaacugucuucggaagaauggaaaaaaggucauucaacuguccagaaagaccuuugauacagaauaccagaaaaccaagcucaacgacugggauuucguggugacaaccgacaucucugagaugggcgccaauuuuaaagcggaucgggucaucgacccccgcagaugccugaagcccguuauucugacagaugggccugagcgggugauccucgccggacccaugccugugaccgcugccagcgcugcccagcgcagaggccgggucgggagaaacccgcagaaagaaaaugaccaauacauuuucacgggacagccccuuaacaaugaugaggaccaugcucacuggacagaagccaagaugcugcuggacaacaucaauaccccugagggcauuauccccgcgcucuucgaaccugagcgcgagaaguccgccgcuaucgauggggaauaucggcugaaaggcgagagcagaaagaccuuuguggaacuuaugcgccggggagaccugcccguuuggcucgcccacaaaguggcuucugagggcauuaaguacacagauagaaaauggugcuucgacgggcagcgcaacaaucagauccuggaagagaacauggaugucgagauuuggaccaaggaaggagagaaaaagaagcugcggccgagauggcucgacgcccgcacauauuccgauccucuugcccugaaagaauuuaaggacuucgcugcgggcagaaaaagcaucgcccuggaucucgugacggagauugggcggguucccucucaucuggcucaccgcaccagaaaugcccuugacaaccuggugaugcuccauacauccgaacacggaggccgggccuaccgccacgcugucgaggagcugccugaaaccauggagacacugcuccuucugggccugaugauccuccugaccgggggagccaugcuuuuucugaucagcggcaaggggauuggaaaaacguccaucggccucauuugugugaucgcgucuagcgggaugcuguggauggccgaaauuccccugcaauggaucgcuuccgccauuguccucgaguucuuuaugauggugcuucugaucccugagcccgaaaagcagagaaccccgcaggauaaucaacuggcuuauguugugaucggaauucucacacuggccgcgaucauugccgcuaacgagaugggccuucuggaaaccacaaagcgggaccucggcaugagcaaagagccugggguggucucucccaccuccuaccuggauguugaccugcaucccgccagcgcuuggacgcucuaugccguggcuacaaccgugaucacaccuaugcuuagacacaccauugaaaauucuaccgccaacgucagccuggcggccaucgcuaaccaggccgugguucugaugggacucgacaagggcuggccgaucuccaaaauggaucugggggugccccuucuggcucucggaugcuacucucaggucaauccucugacacugacggccgccgugcuccuucugauuacccauuacgcgaucauuggccccgggcugcaggcuaaggccacacgcgaggcucaaaaacggaccgccgccggaaucaugaagaacccuacagucgacggcauuaugaccaucgaucucgaccccgugaucuaugauagcaaguucgagaaacagcugggccagguuaugcuucuggugcucugugcuguccagcugcugcucaugagaacguccugggcccuuugcgaagcgcugacacuggccaccgggccuauuaccacacucugggagggaucuccgggcaaguuuuggaauaccacaaucgcugugagcauggccaacauuuuccgcggguccuaccuggcuggagccggccuugcguuuagcaucaugaaaucuguugggacgggaaagcggggcaccggcucccaaggggaaacacugggagagaaauggaagaagaaacucaaucagcugagcagaaaggaauucgaccuguauaaaaaguccggcauuaccgagguggaucggacagaggccaaagaagggcucaagcgcggagagaucacccaccaugcugucucuagaggcagcgccaaacuucagugguuuguggaacggaacauggugauucccgaggggcgcguuaucgaccugggauguggcagaggcgggugguccuacuauugcgcuggacugaagaaggucacggaagugcggggcuacaccaaagggggaccuggccacgaggagcccgugccuaugucuacauauggguggaauaucgucaagcucaugagcggaaaagauguuuucuaccugcccccggaaaagugugacacccuucugugcgauauuggcgaguccagcccuucucccacaguggaagagucccgcaccaucagagugcucaaaauggucgagcccuggcugaagaacaaucaguucuguauuaaggugcugaacccuuacaugcccacaguuaucgaacaccucgagcggcuucaacgcaaacauggcgggaugcuggugagaaauccucugagccggaacucuacccacgaaauguauuggauuuccaauggaacgggcaacaucgucgccagcgugaauaugguuucuagacuccugcuuaaccgcuuuacaaugacccaucggagaccgaccaucgagaaggacguggaucugggggcuggaacacgccacgucaacgccgaacccgagacgccuaauauggacgugauuggcgagcggaucaaaagaauuaaggaagagcacaacagcaccuggcauuacgacgaugaaaaucccuauaaaacaugggcguaccacggguccuaugaggugaaggccaccggaucugcuagcuccaugaucaacggcgucguuaagcuccugacaaaaccuugggacguggugcccauggucacccagauggccaugacagauaccacgccguucggccagcaacgcguguuuaaggaaaaaguugacacccggacaccuagaagcaugcccgggacccgccgggugaugggaauuacagcugaguggcuguggagaacccucggccgcaauaagaaaccucggcugugcacgagagaggaauucacaaagaagguccgcaccaacgccgccaugggggcgguguuuacagaggaaaaucagugggauuccgcuaaagccgccguugaggacgaagauuucuggaagcuuguggacagagagcgggagcugcauaaacucggaaaguguggcucuugcgucuacaacaugauggggaaacgcgaaaagaaacugggcgaguuuggaaaggcuaagggcagcagagccaucugguauauguggcuuggggcucgguaccuggaauucgaggcccucggauuucugaaugaggaucacugguucuccagagaaaacucuuacagcggcguggagggggaaggacugcauaaacucggcuauauccugcgggacauuuccaagauccccgggggcgcgauguacgccgaugacaccgcuggaugggacacgcgcauuaccgaggaugaccuucacaaugaagagaaaaucacacagcagauggauccugagcacagacaacuggccaacgcuauuuuuaagcucaccuaucagaauaaaguugugaagguccagcggcccacaccgaccggcacagugauggacaucaucucucgcaaggaucagagagggagcggacaagucggcaccuacgggcugaacacguucacaaauauggaagcccagcuuauucggcagauggagggagaaggcgugcuguccaaagcggaccucgagaacccucaucugcccgaaaagaaaaucacccaguggcuggagaccaaggggguugagcgccucaaaagaauggccauuagcggcgaugacugcguggucaagcccaucgaugaccgguuugcuaacgcccugguggcucuuaaugauaugggaaaggugcgcaaagacauuccucaauggcagccgucuaagggcuggcacgauuggcagcagguucccuucuguucccaucacuuccacgaacugaucaugaaagacgggagaaagcucguggucccuugccggccccaagacgagcugauuggacgcgccagaaucagccagggcgcuggguggucucuucgggaaacagccugucugggaaaagcguaugcccagauguggucccucauguacuuucaucgcagagaucugcggcuggcuagcaacgccaucugcucugccgugccuguucacugggugcccaccuccagaacaacguggagcauucaugcucaccaucaauggaugaccacagaggacaugcucaccgucuggaaucgcguguggaucgaagauaacccuuggauggaggacaagacacccgucaccacgugggagaaugugccguaucugggcaagcgggaagaucaguggugugggucccuuauuggccugaccagcagagccacaugggcgcagaacaucccuaccgcuauucagcaaguucgcucucucaucggaaaugaggaauuccuggacuacaugcccagcaugaaacgguuuagaaaggaggaggaauccgagggcgccaucugguga

SEQ ID NO: 20435 - RNA, 9873 nt, Artificial Sequence
  derived and/or modified CDS sequence (opt5) from DENV-3__GU131871__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaaccggcgccacaaccgaaacgccuacauggaaucgcaaagagcuucuggucaccuuuaagaacgcucaugcgaaaaagcaagaagugguugugcucgggagccaggagggagccaugcacacagcucugaccggcgccaccgaaauccagaauucugggggcacauccauuuucgccggacaccugaaguguagacucaaaauggacaagcuggagcuuaaaggcaugagcuacgcuaugugcacgaacaccuuuguccugaagaaagaggugucugaaacacagcaugggaccauccucaucaagguugaguaccggggagaagaugcccccuguaagauuccuuucuccacagaggacggccaagggaaagcgcacaacggaagacugaucaccgcuaaucccguggucacgaagaaagaggaacccgugaacauugaggccgaaccuccguucggcgagagcaauaucgugauugggaucggcgauaacgcccugaagaucaauugguauaaaaagggauccucuauuggcaagauguuugaagcuacagcccgcggggcucggagaauggccauccuuggagacaccgcgugggauuucggcagcguugggggaguccucaacucccugggcaaaauggugcaucagauuuuugggagcgccuacaccgcucuguucucuggcguguccugggucaugaagaucggaauuggcauccuccugacauggauugggcuuaauagcaaaaacaccucuaugagcuuuuccugcaucgccaucggaauuaucacacuguaucucggcgcugugguucaggccgacauggggugugugauuaauuggaagggaaaagagcugaagugcggcucugggaucuucgucacgaacgaggugcacaccuggacagaacaguacaaguuucaagcggauagccccaaacgccuggccaccgcuauugccggcgcuugggagaauggaguuuguggcauccgguccacaaccagaauggaaaaccuucucuggaagcagaucgccaaugagcugaacuauauucugugggaaaauaacaucaaacucacgguggucgugggggacauuaucggaguucuggagcagggcaagcgcacccuuacaccucagcccauggagcugaaauacagcuggaagaccugggggaaagccaagauugugacagcugaaacccaaaacucuuccuucaucaucgauggaccuaauacacccgagugcccgagcgcgucucgggccuggaacgucugggaaguggaggacuauggcuuuggcguguucaccacgaauauuuggcucaagcugagagaagucuacacacagcugugugaccaucgccuuauguccgcugccguuaaagaugagcgggccgugcacgcugacaugggguacuggaucgagagccagaagaacggauccuggaaacucgaaaaggccucucugauugaggugaaaaccugcaccuggccuaagagccacacacugugguccaauggcguccucgaaucugauaugaucauucccaagagccuggcggggccuaucucccagcauaaccacagacccggauaucauacccaaacggcuggcccuuggcaccuugggaaacuggagcucgacuuuaauuacugcgagggaacaaccgugguuaucacagaaaacuguggcacccgcggccccagccugcggacaaccacggugucugggaagcugauucacgaguggugcuguagauccugcacccuuccgccucuccgguauaugggagaagauggcuguugguacgggauggagauccgccccauuagcgaaaaagaggagaauauggucaagucucugguguccgccggaagcggcaaaguugacaacuucacaaugggggugcugugccucgccauccuguuugaagaggucaugagaggaaaguucggcaagaaacauaugauugcuggcguguucuuuaccuucguucuucugcucucugggcagaucacauggcgggauaugacccacacgcugauuaugaucggaagcaaugccuccgacagaaugggcaugggggugacauaucuggcgcuuaucgcuaccuuuaagauucagcccuuccuggcccucggauuuuuccugcgcaaacucacaagccgggaaaaccugcuucugggcgucgggcucgccauggcuaccacccugcaacugccugaggauaucgaacagauggccaauggaauugcucuuggccugauggcccucaagcugaucacacaguuugagacguaccagcucuggaccgcgcugauuucucuuacauguuccaacaccauguucacacugaccguggccuggagaacggcuacacucauccuggccggcgugagccugcuuccggucugccaauccucuagcaugcgcaaaaccgacuggcugcccauggcuguugccgccaugggggugccuccccucccucuguuuaucuucucccucaaggauacccugaagagacggucuuggccccuuaaugagggagugauggcugucggccuggugagcauucuggcguccucucuccugcgcaacgacguuccuauggccgggccccuuguggcuggaggccugcucaucgccuguuaugucauuacagggaccagcgccgaucugacaguggaaaaagcugccgacaucacgugggaggaagaggcggaacagaccggaguuucccauaaccucaugauuacaguggacgaugacggcaccaugagaaucaaggaugacgagacagagaauauccugaccguccuucugaaaacggcucugcucauugugagcggcgucuuuccguacucuaucccugccacccugcuuguguggcacacauggcagaagcagacccaacgguccgggguucugugggaugugcccagcccucccgaaacacagaaagccgagcucgaagagggagucuaccgcauuaagcagcagggcaucuucgggaaaacccaagugggaguuggcgugcagaaggagggggucuuucauacaauguggcacgugacgagaggagcugugcugaccuauaacggcaagcggcucgaaccgaauugggccucuguuaaaaaggaccugauuuccuacggcgggggauggcgccuuagcgcgcaguggcaaaaaggcgaggaaguccaggugaucgcuguggagccugggaagaaccccaaaaauuuccagacaaccccuggaaccuuccagacaacgaccggcgaaauuggggccaucgcccuggauuuuaagcccggaacaucuggcucccccaucauuaacagagagggcaaggucguggggcuguauggaaauggcguugugaccaaaaacgggggauacgucagcggcaucgcucaaacaaaugccgagccugacgggccgacccccgaacucgaggaagagauguucaagaaacggaaccugacgauuauggaucuucacccuggcuccggaaagacacgcaaauaucugcccgcuaucauuagagaagccaucaagcggagacuccgcacccugauccucgcgccuacccgggugguugccgcugagauggaggaagcccugaagggccuucccauuagauaccagacaaccgcuacaaaaagcgagcauaccgggcgcgaaaucguggaccugaugugccacgccacguuuacaaugcggcugcucucuccugucagagugccgaauuauaaccugauuaucauggaugaggcccauuucaccgaccccgcuagcauugcggcccgcggauacaucuccacacggguuggcaugggggaagcugccgccaucuuuaugaccgcuacgccucccggaaccgccgaugcguucccucagucuaaugcucccauucaggacgaggagagagacaucccggaacgcagcuggaacuccggcaaugaguggauuacagauuuugccgggaagaccgugugguucgucccuucuaucaaagccggcaacgacauugcuaacugucuucggaagaauggaaaaaaggugauccaacugagcagaaagacauuugauaccgaauaccagaaaacaaagcucaacgacugggauuucguggucaccacggacauuuccgagaugggcgccaauuuuaaagcggaucggguuaucgacccccgcagaugccugaagcccgugauccugacagaugggccugagcgggugauucucgccggacccaugccugucaccgcugccucugcugcccagcgcagaggccggguggggagaaacccgcagaaagaaaaugaccaauauaucuucaccggacagccccuuaacaaugaugaggaccacgcucauuggacagaagccaagaugcugcuggacaacauuaauaccccugagggcaucauucccgcgcucuucgaaccugagcgcgagaagagcgccgcuaucgauggggaauaccggcugaaaggcgaguccagaaagacauuuguugaacuuaugcgccggggagaccugcccguguggcucgcccacaaagucgcuagcgagggcaucaaguauacggauagaaaauggugcuucgacgggcagcgcaacaaucagauucuggaagagaacauggauguggagaucuggaccaaggaaggagagaaaaagaagcugcggccgagauggcucgacgcccgcacauacucugauccucuugcccugaaagaauuuaaggacuucgcugcgggcagaaaauccauugcccuggaucucguuaccgagaucgggcgggugcccagccaccuggcucaucgcacaagaaaugcccuugacaaccuggucaugcuccacaccucugaacauggaggccgggccuaucgccacgcuguggaggagcugccugaaacgauggagacccugcuccuucugggccugaugauucuccugacagggggagccaugcuuuuucugaucuccggcaaggggaucggaaaaaccagcauuggccucaucugugucauugcguccucugggaugcuguggauggccgaaaucccccugcaauggauugcuagcgccaucgugcucgaguucuuuaugaugguucuucugauuccugagcccgaaaagcagagaacaccgcaggauaaucaacuggcuuacguggugaucggaauccucacccuggccgcgauuaucgccgcuaacgagaugggccuucuggaaacgacaaagcgggaccucggcauguccaaagagccuggggucguuagccccaccucuuaucuggauguggaccugcaccccgccuccgcuuggacacucuacgccguggcuaccaccgucauuacaccuaugcuuagacauacgaucgaaaauagcaccgccaacgugucucuggcggccauugcuaaccaggccguugugcugaugggacucgacaagggcuggccgaucagcaaaauggaucugggggucccccuucuggcucucggaugcuacucccaggugaauccucugacacugaccgccgccguccuccuucugaucacacacuaugcgauuaucggccccgggcugcaggcuaaggccacccgcgaggcucaaaaacggacggccgccggaauuaugaagaacccuacaguggacggcaucaugaccauugaucucgaccccguuaucuacgauucuaaguucgagaaacagcugggccaggugaugcuucugguccucugugcugugcagcugcugcucaugagaaccagcugggcccuuugcgaagcgcugacacuggccaccgggccuaucacaacgcucugggagggauccccgggcaaguuuuggaauaccacaauugcuguuucuauggccaacaucuuccgcgggagcuaucuggcuggagccggccuugcguuuuccauuaugaaaagcguggggaccggaaagcggggcacaggcucucaaggggaaacccugggagagaaauggaagagaaagcucaaucagcugucccggaaagaauucgaccuguacaagaaaagcggcaucacggaggucgaucgcaccgaggccaaggaagggcucaaaagaggagagauuacacaucacgcugugucccggggcucugccaagcuucagugguuuguggaacgcaacaugguuauccccgaggggagagucauugaccugggauguggccggggcggguggagcuauuacugcgcuggacugaaaaaggugaccgaagugcgcggcuauacaaaggggggaccuggccaugaggagcccgucccuauguccaccuacggguggaauaucguuaaacucaugucuggaaaggauguguucuaccugcccccggaaaaaugugacacacuucugugcgauaucggcgagagcuccccuagccccaccguggaagagucuagaacgauucggguccucaagaugguggagcccuggcugaaaaacaaucaguucuguaucaagguucugaacccuuauaugcccacagugauugaacaccucgagcgccuucaaagaaagcacggcgggaugcugguccggaauccucuguccagaaacagcacccaugaaauguacuggaucucuaauggaaccggcaacauuguggccuccguuaauauggugagccgccuccugcuuaaccgguuuacaaugacgcacagacgcccgaccaucgagaaagacgucgaucugggggcuggaacacggcaugugaacgccgaacccgagaccccuaauauggacgugaucggcgagagaauuaagcgcaucaaagaagagcacaacucuacauggcacuaugacgaugaaaaucccuacaagaccugggcguaucaugggagcuacgaggucaaagccacaggauccgcuucuagcaugauuaacggcguugugaagcuccugaccaagccuugggacgugguccccauggugacgcagauggccaugaccgauacaaccccguucggccagcaacggguuuuuaaagaaaagguggacacaagaaccccucgcuccaugcccgggacgcggagagucauggagaucacagcugaguggcuguggcgcacccucggacggaauaaaaagccuagacugugcacacgcgaagaguucaccaaaaaggugagaacgaacgccgccaugggcgcgguuuuuaccgaagagaaucagugggauagcgcuaaggccgccguggaagacgaggauuucuggaaacuugucgaccgggagcgcgaacugcacaagcucgggaaauguggauccugcguguauaacaugaugggcaagagagagaaaaagcugggggaauuuggcaaagcuaagggaucucgggccauuugguacauguggcuuggcgcuagauaccuggaguucgaggcccucggguuucugaaugaagaucauugguucagccgggagaacuccuauucuggaguugaaggcgaggggcugcacaagcucggauacauccugcgcgacaucagcaaaauucccggcggggcgauguaugccgaugacacagcuggcugggacaccagaaucacagaagaugaccuucauaaugaggagaagauuacccagcagauggauccugaacaccggcaacuggccaacgcuaucuuuaaacucacauaccagaauaagguggucaaagugcagcgccccaccccgacgggaacagucauggacauuaucuccagaaaggaucagcggggcucugggcaagugggaaccuauggccugaacaccuucacaaauauggaggcccagcuuauccgccagauggaaggggagggaguucugagcaaggcggaccucgaaaacccucaccugcccgagaaaaagauuacccaguggcuggagacaaaaggcguggaaagacucaagcggauggccaucuccggggaugacugcgucgugaaacccauugaugaccgcuuugcuaacgcccugcuugcucugaaugauaugggcaaggugagaaaggacaucccucaauggcagccgagcaaaggauggcaugauuggcagcagguucccuucuguucucaccauuuccacgagcucauuaugaaggacggccggaaacugguggucccuugccgcccccaagacgaacuuaucgggagagcccggauuucccagggagcuggcuggagccugcgcgagacggccugucucgggaaggcguacgcccagauguggucucugauguauuuucacagacgggaucugagacucgcuuccaacgccaucugcagcgccgugccuguucauugggugcccaccucucgcacaaccugguccauccacgcucaucaccaauggaugacaaccgaagacaugcugacggucuggaaucggguguggauugaggauaacccuuggauggaggacaaaacccccgucacaaccugggaaaaugugccguaccuuggaaagagagaggaucagugguguggcagccugaucgggcucacaucccgcgccaccugggcgcagaacauuccuacggcuauccagcaaguucggagccugauuggcaaugaagaguuccuugacuacaugcccucuaugaagagauuucgcaaagaggaagagagcgaaggagccaucugguga

SEQ ID NO: 20436 - RNA, 9873 nt, Artificial Sequence
  derived and/or modified CDS sequence (opt5) from DENV-3__GU131872__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaagcggcgccaccacagaaaccccuacguggaaucgcaaagagcuucuggucacauuuaagaacgcucaugcgaaaaagcaagaagugguugugcucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuuguccugaagaaagagguguccgaaacccagcaugggacaauccucaucaagguugaguaccggggagaagaugcccccuguaagauuccuuucagcaccgaggacggccaagggaaagcgcacaacggaagacugaucacagcuaaucccguggucaccaagaaagaggaacccgugaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguugggggaguccucaacagccugggcaaaauggugcaucagauuuuugggucugccuacaccgcucuguucuccggcgugagcugggucaugaagaucggaauuggcauccuccugaccuggauugggcuuaauucuaaaaacacaagcauguccuuuucuugcaucgccaucggaauuaucacccuguaucucggcgcugugguucaggccgacauggggugugugauuaauuggaagggaaaagagcugaagugcggcagcgggaucuucgucacaaacgaggugcacacguggaccgaacaguacaaguuucaagcggauucccccaaacgccuggccacagcuauugccggcgcuugggagaauggaguuuguggcauccggagcaccacaagaauggaaaaccuucucuggaagcagaucgccaaugagcugaacuauauucugugggaaaauaacaucaaacucaccguggucgugggggacauuaucggaguucuggagcagggcaagcgcacgcuuaccccucagcccauggagcugaaauacucuuggaagacaugggggaaagccaagauggugaccgcugaaacacaaaacuccagcuucauuaucgauggaccuaauacccccgagugcccgucugcgucccgggccuggaacgucugggaaguggaggacuauggcuuuggcguguucacaaccaauaucuggcucaagcugagagaagucuacacgcagcugugugaccaucgccuuaugagcgcugccguuaaagaugagcgggccgugcacgcugacaugggguacuggauugagucccagaagaacggaucuuggaaacucgaaaaggccagccugaucgaggugaaaacaugcaccuggccuaagucccacacccuguggucuaauggcguccucgaaagcgauaugauuauccccaagucccuggcggggccuauuagccagcauaaccacagacccggauaucauacacaaaccgcuggcccuuggcaccuugggaaacuggagcucgacuuuaauuacugcgagggaacgacagugguuaucaccgaaaacuguggcacacgcggccccucucugcggaccacaaccguguccgggaagcugauccacgaguggugcuguagaagcugcacgcuuccgccucuccgguauaugggagaagauggcuguugguacgggauggagauucgccccaucucugaaaaagaggagaauauggucaagucccuggugagcgccggaucuggcaaaguugacaacuucaccaugggggugcugugccucgccauucuguuugaagaggucaugagaggaaaguucggcaagaaacauaugaucgcuggcguguucuuuacauucguucuucugcucagcgggcagauuaccuggcgggauaugacacacacccugaucaugauuggauccaaugccagcgacagaaugggcaugggggugacguaucuggcgcuuaucgcuacauuuaagauccagcccuuccuggcccucggauuuuuccugcgcaaacucaccucucgggaaaaccugcuucugggcgucgggcucgccauggcuacaacccugcaacugccugaggauauugaacagauggccaauggaaucgcucuuggccugauggcccucaagcugauuacccaguuugagacauaccagcucuggacggcgcugaucucccuuaccuguagcaacacaauguucacccugacaguggccuggagaaccgcuacgcucauucuggccggcgugucccugcuuccggucugccaaucuagcuccaugcgcaaaacagacuggcugcccauggcuguugccgccaugggggugccuccccucccucuguuuaucuucucucucaaggauacccugaagagacggagcuggccccuuaaugagggagugauggcugucggccugguguccauccuggcgucuagccuccugcgcaacgacguuccuauggccgggccccuuguggcuggaggccugcucauugccuguuaugucaucaccgggacauccgccgaucugaccguggaaaaagcugccgacauuacaugggaggaagaggcggaacagacgggaguuagccauaaccucaugaucaccguggacgaugacggcacaaugagaauuaaggaugacgagaccgagaauauccugacaguccuucugaaaaccgcucugcucaucgugucuggcgucuuuccguacuccauuccugccacgcugcuuguguggcacaccuggcagaagcagacacaacggagcgggguucugugggaugugcccucuccucccgaaacccagaaagccgagcucgaagagggagucuaccgcaucaagcagcagggcauuuucgggaaaacacaagugggaguuggcgugcagaaggagggggucuuucauaccauguggcacgugacaagaggagcugugcugacguauaacggcaagcggcucgaaccgaauugggccuccguuaaaaaggaccugaucagcuacggcgggggauggcgccuuucugcgcaguggcaaaaaggcgaggaaguccaggugauugcuguggagccugggaagaaccccaaaaauuuccagaccacaccuggaaccuuccagaccacaacgggcgaaaucggggccauugcccuggauuuuaagcccggaaccuccggcagccccaucaucaacagagagggcaaggucguggggcuguauggaaauggcguugugacaaaaaacgggggauacgucuccggcauugcucaaaccaaugccgagccugacgggccgacacccgaacucgaggaagagauguucaagaaacggaaccugaccaucauggaucuucacccuggcagcggaaagacgcgcaaauaucugcccgcuauuaucagagaagccauuaagcggagacuccgcacacugauccucgcgccuacccgggugguugccgcugagauggaggaagcccugaagggccuucccaucagauaccagaccacagcuaccaaaucugagcauacagggcgcgaaauuguggaccugaugugccacgccaccuuuacgaugcggcugcucagcccugucagagugccgaauuauaaccugaucauuauggaugaggcccauuucacagaccccgcuuccaucgcggcccgcggauacauuucuacccggguuggcaugggggaagcugccgccaucuuuaugacagcuaccccucccggaacggccgaugcguucccucagagcaaugcucccauccaggacgaggagagagacauuccggaacgcuccuggaacucuggcaaugaguggaucaccgauuuugccgggaagacagugugguucgucccuagcauuaaagccggcaacgacaucgcuaacugucuucggaagaauggaaaaaaggugauucaacuguccagaaagaccuuugauacagaauaccagaaaaccaagcucaacgacugggauuucguggucacaaccgacaucucugagaugggcgccaauuuuaaagcggaucggguuauugacccccgcagaugccugaagcccgugauccugacggaugggccugagcgggugauccucgccggacccaugccugucacagcugccagcgcugcccagcgcagaggccggguggggagaaacccgcagaaagaaaaugaccaauauauuuucaccggacagccccuuaacaaugaugaggaccacgcucauuggaccgaagccaagaugcugcuggacaacaucaauacaccugagggcauuauccccgcgcucuucgaaccugagcgcgagaaguccgccgcuauugauggggaauaccggcugaaaggcgagagcagaaagaccuuuguugaacuuaugcgccggggagaccugcccguguggcucgcccacaaagucgcuucugagggcaucaaguauacagauagaaaauggugcuucgacgggcagcgcaacaaucagauccuggaagagaacauggauguggagauuuggacgaaggaaggagagaaaaagaagcugcggccgagauggcucgacgcccgcaccuacuccgauccucuugcccugaaagaauuuaaggacuucgcugcgggcagaaaaagcaucgcccuggaucucguuacagagauugggcgggugcccucucaccuggcucaucgcaccagaaaugcccuugacaaccuggucaugcuccacacauccgaacauggaggccgggccuaucgccacgcuguggaggagcugccugaaaccauggagacgcugcuccuucugggccugaugauccuccugaccgggggagccaugcuuuuucugauuagcggcaaggggaucggaaaaacauccaucggccucauuugugucaucgcgucuagcgggaugcuguggauggccgaaauuccccugcaauggaucgcuuccgccauugugcucgaguucuuuaugaugguucuucugaucccugagcccgaaaagcagagaaccccgcaggauaaucaacuggcuuacguggugauuggaauccucacacuggccgcgaucauugccgcuaacgagaugggccuucuggaaaccacgaagcgggaccucggcaugagcaaagagccuggggucguuucucccacauccuaucuggauguggaccugcaccccgccagcgcuuggacccucuacgccguggcuacaaccgucaucaccccuaugcuuagacauacaauugaaaauucuacggccaacgugagccuggcggccaucgcuaaccaggccguugugcugaugggacucgacaagggcuggccgauuuccaaaauggaucugggggucccccuucuggcucucggaugcuacucucaggugaauccucugacccugacagccgccguccuccuucugaucacccacuaugcgaucauuggccccgggcugcaggcuaaggccacacgcgaggcucaaaaacggaccgccgccggaaucaugaagaacccuacgguggacggcauuaugacaaucgaucucgaccccguuauuuacgauagcaaguucgagaaacagcugggccaggugaugcuucugguccucugugcugugcagcugcugcucaugagaaccuccugggcccuuugcgaagcgcugacccuggccacagggccuaucaccacacucugggagggaucuccgggcaaguuuuggaauacgaccaucgcuguuagcauggccaacauuuuccgcggguccuaucuggcuggagccggccuugcguuuagcaucaugaaaucuguggggacaggaaagcggggcaccggcucccaaggggaaacacugggagagaaauggaagaagaaacucaaucagcugagcagaaaggaauucgaccuguacaaaaaguccggcauuaccgaggucgaucggacggaggccaaagaagggcucaagcgcggagagaucacccaucacgcugugucuagaggcagcgccaaacuucagugguuuguggaacggaacaugguuauucccgaggggcgcgucaucgaccugggauguggcagaggcgggugguccuauuacugcgcuggacugaagaaggugacagaagugcggggcuauaccaaagggggaccuggccaugaggagcccgucccuaugucuacauacggguggaauauuguuaagcucaugagcggaaaagauguguucuaccugcccccggaaaagugugacacccuucugugcgauaucggcgaguccagcccuucucccacaguggaagagucccgcaccaucagaguccucaaaaugguggagcccuggcugaagaacaaucaguucuguauuaagguucugaacccuuauaugcccacggugaucgaacaccucgagcggcuucaacgcaaacacggcgggaugcuggucagaaauccucugagccggaacucuacacaugaaauguacuggauuuccaauggaaccggcaacaucguggccagcguuaauauggugucuagacuccugcuuaaccgcuuuaccaugacacaccggagaccgacgauugagaaggacgucgaucugggggcuggaacccgccaugugaacgccgaacccgagacaccuaauauggacgugaucggcgagcggaucaaaagaauuaaggaagagcacaacagcaccuggcacuaugacgaugaaaaucccuacaaaacaugggcguaucauggguccuacgaggucaaggccaccggaucugcuagcuccaugaucaacggcguugugaagcuccugacaaaaccuugggacgugguccccauggugacccagauggccaugacggauaccacaccguucggccagcaacgcguuuuuaaggaaaaaguggacacccggacaccuagaagcaugcccgggacccgccgggucauggagauuacggcugaguggcuguggagaacacucggacgcaauaagaaaccucggcugugcaccagagaagaguucacaaagaaggugcgcaccaacgccgccaugggcgcgguuuuuacggaagagaaucagugggauuccgcuaaagccgccguggaagacgaggauuucuggaagcuugucgacagagagcgggaacugcacaaacucgggaaguguggaucuugcguguauaacaugaugggcaaacgcgagaagaaacugggggaauuuggcaaggcuaagggaagcagagccaucugguacauguggcuuggcgcucgguaccuggaguucgaggcccucggguuucugaaugaagaucauugguucuccagagagaacucuuauagcggaguugaaggcgaggggcugcacaaacucggauacauucugcgggacaucuccaagauccccggcggggcgauguaugccgaugacaccgcuggcugggacacacgcauuaccgaagaugaccuucauaaugaggagaaaaucacacagcagauggauccugaacacagacaacuggccaacgcuauuuuuaagcucaccuaccagaauaaaguggucaaggugcagcggcccacaccgaccggaacggucauggacaucauuucucgcaaggaucagagaggcagcgggcaagugggaacauauggccugaacaccuucaccaauauggaggcccagcuuauccggcagauggaaggggagggaguucuguccaaagcggaccucgaaaacccucaccugcccgagaagaaaaucacacaguggcuggagaccaagggcguggaacgccucaaaagaauggccauuagcggggaugacugcgucgugaagcccaucgaugaccgguuugcuaacgcccugcuugcucugaaugauaugggcaaggugcgcaaagacauuccucaauggcagccgucuaagggauggcaugauuggcagcagguucccuucuguucccaccauuuccacgagcucaucaugaaagacggcagaaagcugguggucccuugccggccccaagacgaacuuauugggcgcgccagaaucagccagggagcuggcuggucucugcgggagacagccugucucgggaaagcguacgcccagauguggucccugauguauuuucaccgcagagaucugcggcucgcuagcaacgccauuugcucugccgugccuguucauugggugcccacguccagaaccacauggagcauccacgcucaucaccaauggaugaccacagaagacaugcugaccgucuggaaucgcguguggaucgaggauaacccuuggauggaggacaagacgcccgucaccacaugggaaaaugugccguaccuuggaaagcgggaggaucagugguguggcucccugauugggcucaccagcagagccacaugggcgcagaacaucccuaccgcuauucagcaaguucgcucucugaucggcaaugaagaguuccuugacuacaugcccagcaugaaacgguuuagaaaggaggaagaguccgaaggagccauuugguga

SEQ ID NO: 20437 - RNA, 9873 nt, Artificial Sequence
  derived and/or modified CDS sequence (opt5) from DENV-3__GU131873__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcucauugagggcaaaguugugcaguaugaaaaucugaaguacacagucgugaucaccguucacacaggggaccagcaucaggugggaaacgagacgcaaggcaucaccgcugaaauuacaccccaggccucuaccacagaggcuauccugccugaauauggcacccucgggcuggagugcucccccagaacgggacuugacuucaaugagaugauucugcucaccaugaaaaacaaggccuggaugguccaccggcagugguuuuucgaucugccucuucccuggacaagcggcgccaccacagaaaccccgacguggaaucgcaaagagcugcucgugacauuuaagaacgcucaugcgaaaaagcaagaagucgugguucuggggucucaggagggagccaugcacaccgcucugacaggcgccaccgaaauccagaauuccgggggcaccagcauuuucgccggacaccucaaguguagacugaaaauggacaagcuugagcugaaaggcaugucuuacgcuaugugcacaaacacguuugugcucaagaaagaggucuccgaaacccagcaugggacaauccugaucaagguggaguacaagggagaagaugccccuuguaaaauucccuucagcaccgaggacggccaagggaaggcgcacaacggacggcugaucacagcuaauccuguugugaccaaaaaggaggaacccgucaacauugaggccgaacccccuuucggcgaguccaauaucgugauugggaucggcgauaacgcccuuaaaaucaauugguauaagaagggaucuagcauuggcaaaauguuugaagcuacggccagaggggcucgccggauggccauccucggagacacagcgugggauuucggcuccguggggggaguucugaacagccugggcaagaugguccaucagauuuuugggucugccuacaccgcucucuucuccggcgugagcugggugaugaaaaucggaauuggcguccugcuuaccuggaucgggcugaauucuaagaacacaagcauguccuuuucuugcauugccaucggaaucauuacccucuaucugggcgcugugguucaggccgacauggggugugugaucaauuggaaaggaaaggagcugaagugcggcagcgggauuuucgucacaaacgaggugcacacguggaccgaacaguacaaauuucaagcggauuccccgaagagacuugccacagcuaucgccggcgcuugggagaauggaguuuguggcauucgcagcaccacacggauggaaaaccuccuguggaaacagaucgccaaugagcugaacuauauccucugggaaaauaacauuaagcugaccguggucgugggggacaucauuggaguucuugagcagggcaaaagaacgcugaccccccagccuauggagcucaaguacucuuggaaaacaugggggaaggccaagaucgugaccgcugaaacacaaaacuccagcuucauuaucgauggacccaauaccccugagugccccucugcgucccgcgccuggaacgucugggaaguggaggacuauggcuuuggcguguucacaaccaauaucuggcugaaacugcgggaagucuacacgcagcuuugugaccauagacucaugagcgcugccguuaaggaugagcgcgccgugcacgcugacaugggguacuggauugagucccagaaaaacggaucuuggaagcuggaaaaagccagccugaucgaggugaagacaugcaccuggccgaagucccacacccucuggucuaauggcguccuggaaagcgauaugauuaucccuaaaucccuugcggggcccauuagccagcauaaccaccggccuggauaucauacacaaaccgcuggccccuggcaccuggggaagcucgagcuggacuuuaauuacugcgagggaacgacagugguuaucaccgaaaacuguggcacaagaggcccuucucugcgcaccacaaccguguccgggaaacuuauccacgaguggugcugucggagcugcacgcuccccccgcugagauauaugggagaagauggcuguugguacgggauggagauucggccuaucucugaaaaggaggagaauauggucaaaucccuggugagcgccggaucuggcaagguugacaacuucaccaugggggugcucugccuggccauucuuuuugaagaggucaugcgcggaaaguucggcaaaaagcauaugaucgcuggcguguucuuuacauucguucugcuccugagcgggcagauuaccuggagagauauggcccacacacugaucaugauuggauccaaugcgagcgaccggaugggcaugggggugaccuaucuugcucugaucgccacguuuaaaauccagcccuuccucgcccugggauuuuuccucagaaagcugacaucucgcgaaaaccuucugcucggcgucgggcuggcuauggccaccacacugcaacuucccgaggauauugaacagauggcuaauggaaucgcccugggccucauggcgcugaaacucauuacccaguuugagaccuaccagcuguggacagcccuuaucucccugacguguagcaacaccauguucacacucaccguggcuuggcggacagccacccugauucuggcuggcgugucccuucugccugucugccaaucuagcuccaugagaaagacggacuggcucccgauggccguugccgcuaugggggugcccccucugccccucuuuaucuucucucugaaggauacacuuaaacgcagaagcuggccucugaaugagggagugauggcggucggccugguguccauccucgccucuagccugcuucggaacgacguucccauggcugggccucugguggccggaggccuccugauugccuguuaugucaucaccgggaccuccgcugaucucacaguggaaaaggccgcggacauuaccugggaggaagaggcugaacagacaggaguuagccauaaccugaugaucacgguggacgaugacggcaccaugcgcauuaaagaugacgagacagagaauauccuuaccguccugcugaagacagcccuccugaucgugucuggcgucuuucccuacuccauuccggccacccuucugguguggcacacguggcagaaacagacccaaagaagcgggguucucugggaugugccuucucccccugaaacacagaaggcugagcuggaagagggagucuaccggaucaaacagcagggcauuuucgggaagacccaagugggaguuggcgugcagaaggagggggucuuucauacaauguggcacgugacccgcggagccgugcucacauauaacggcaaaagacuggaacccaauugggcguccguuaagaaagaccuuaucagcuacggcgggggauggcggcugucugcucaguggcaaaagggcgaggaaguccaggugauugccguggagccggggaaaaacccuaagaauuuccagacgaugcccggaaccuuccagacaaccaccggcgaaaucggggccauugcucuggauuuuaagccuggaacauccggcagccccaucaucaaccgcgagggcaaagucguggggcucuauggaaauggcguugugacgaagaacgggggauacgucuccggcauugcccaaaccaaugcugagcccgacgggccuacaccggaacuggaggaagagauguucaaaaagagaaaccuuaccaucauggaucugcaccccggcagcggaaaaacacggaaguaucucccugccauugugcgcgaagcgaucaagagacggcugagaacccucauucuggcccccacgcgcguuguggcugccgagauggaggaagcucuuaaaggccugccuauccgguaccagacaaccgccaccaagucugagcauacagggagagaaaucgucgaccugaugugccacgccaccuuuacaaugcgccuccugagccccgugcggguuccuaauuauaaccuuauuaucauggaugaggcucauuucaccgacccggcguccauugccgcuagaggauacaucucuacgcgcgugggcaugggggaagccgccgcuauuuuuaugacagccacccccccuggaacagcggaugcuuucccccagagcaaugccccuauccaggacgaggagcgggacauccccgaaagauccuggaacucuggcaaugaguggauuaccgauuuugccgggaaaacggucugguucgugccgagcaucaaggcuggcaacgacauugccaacugucugcgcaaaaauggaaagaaggugauccaacucucccggaaaaccuuugauacagaauaccagaagaccaaacugaacgacugggauuucgucguuacaaccgacauuucugagaugggcgcgaauuuuaaggccgauagagugaucgacccucggcgcugccugaaacccgugauucucacagaugggcccgagagagucauccuugcuggaccuaugcccgugaccgccgcuagcgccgcucagcggcgcggcagaguugggcggaacccucagaaggaaaaugaccaauauaucuucacgggacagccgcugaacaaugaugaggaccacgcccauuggacagaagcgaagaugcugcucgacaacgugaauacccccgagggcauuaucccugcccuguucgaacccgagagagagaaauccgcugccauugauggggaauaccgccuuaagggcgagagccggaaaaccuuugucgaacugaugagacgcggagaccucccuguguggcuggcucacaagguugccucugagggcaucaaauauacagaucggaaguggugcuucgacgggcagagaaacaaucagauucuggaagagaacauggauguggagaucuggaccaaagaaggagagaagaagaaacuccgcccccgguggcuugacgccagaacauacuccgauccgcuggcucugaaggaauuuaaagacuucgcggccggccgcaagagcaucgcucucgaucuggucacggagauugggagagugccuucucaccuugcccaucggacccgcaaugcccuggacaaccucgucaugcugcacacauccgaacauggaggcagagcuuaucggcacgccguggaggagcugcccgaaaccauggagacacuccuucugcugggccucaugauccugcuuaccgggggagcgaugcuguuuauuaucagcggcaaagggauuggaaagacguccaucggccucaucuguguuauugccucuagcgggaugcuguggauggcugaaaucccucugcaauggauugccuccgcuaucgugcucgaguucuuuaugauggugcuucugauucccgagccugaaaagcagcgcaccccccaggauaaucaacuggccuacgucguuaucggaauucucacacuggcggccaucaucgcugccaacgagaugggccuucuggaaaccacaaaaagagaccucggcaugagcaaggagccggggguggugucuccuaccuccuaucuggaugucgaccugcaccccgcuagcgccuggacgcucuacgcuguggccacaaccguuauuacacccaugcuucggcauaccaucgaaaauucuaccgcgaacgugagccuggccgcuauugccaaccaggcugucgugcugaugggacucgacaaaggcuggccuaucuccaagauggaucugggggucccgcuucuggcccucggaugcuacucucaggugaauccccugacacugacggccgcgguucuccuucugauuacccacuaugcuaucaucggcccugggcugcaggccaaagcuacaagagaggcccaaaagcgcaccgccgcuggaauuaugaagaaccccacaguggacggcaucaugaccauugaucucgacccugucaucuacgauagcaaauucgagaagcagcugggccaggugaugcuucugguucucugugccgugcagcugcugcucaugcggacguccugggcgcuuugcgaagcccugacacuggcuaccgggcccauuaccacacucugggagggaucuccuggcaaauuuuggaauaccacaaucgccgucagcauggcuaacaucuucagaggguccuaucuggccggagcgggccuugccuuuagcauuaugaagucuguggggacgggaaaacgcggcaccggcucccaaggggaaacacugggagagaaguggaagaaaaagcucaaucagcugagccggaaagaauucgaccuguacaagaaauccggcaucaccgagguggauagaacagaggcuaaggaagggcucaaacggggagagauuacccaucacgccguuucucgcggcagcgcuaagcuucagugguuugucgaaagaaacauggugaucccggaggggcgggugauugaccugggauguggccgcggcgggugguccuauuacugcgccggacugaagaaagucacggaaguuagaggcuauaccaaggggggacccggccaugaggagccugugcccaugucuacauacggguggaauaucgugaaacucaugagcggaaaggaugucuucuaccugccucccgaaaaaugugacacccuucugugcgauauuggcgaguccagcccgucuccuacaguggaagagucccggaccauccgcguucucaagaugguggagcccuggcugaagaacaaucaguucuguaucaaaguccugaaccccuauaugccuacagugauugaacaccucgagagacuucaacggaagcacggcgggaugcugguucgcaauccccugagcagaaacucuacccaugaaauguacuggaucuccaauggaacgggcaacauuguggcuagcgucaauauggugucucggcuccugcuuaacagauuuacaaugacccaccgccggccuaccaucgagaaagacguggaucugggggccggaacaagacaugucaacgcggaaccggagacgcccaauauggacguuauuggcgagcgcaucaagcggaucaaagaagagcacaacagcaccuggcacuaugacgaugaaaauccuuacaagacaugggccuaucauggguccuacgaggugaaggcuaccggaucugccagcuccaugauuaacggcguggucaaacuccugacaaagcccugggacgugguuccuauggugacccagauggcuaugacagauaccacgcccuucggccagcaaagagucuuuaaagaaaagguggacacccgcacaccgcggagcaugccugggaccagacgcguuaugggaaucacagccgaguggcuguggcggacccucggcagaaauaaaaagccccgccugugcacgcgggaggaauucacaaagaaagugagaaccaacgccgcgaugggggcugucuuuacagaggaaaaucagugggauuccgccaaggccgcuguggaggacgaagauuucuggaaacuuguugaccgcgagagagagcugcacaagcucggaaaauguggcucuugcguguauaacaugauggggaagcgggaaaaaaagcugggcgaguuuggaaaggccaaaggcagccgcgcuauuugguacauguggcuuggggccagauaccuggaauucgaggcgcucggauuucugaaugaggaucauugguucucccgggaaaacucuuauagcggcgucgagggggaaggacugcacaagcucggcuacauccugagagacauuuccaaaaucccugggggcgccauguaugcugaugacaccgccggaugggacacgcggaucaccgaggaugaccuucauaaugaagagaagauuacacagcagauggaucccgagcaccgccaacuggcuaacgccaucuuuaaacucaccuaccagaauaagguggucaaggugcagagaccuacacccaccggcacaguuauggacauuaucucucggaaagaucagcgcgggagcggacaagugggcaccuaugggcugaacacguucacaaauauggaagcgcagcuuauuagacagauggagggagaaggcguccuguccaaggccgaccucgagaacccgcaccugccugaaaaaaagaucacccaguggcuggagaccaaagggguggagcggcucaagcgcauggcuaucagcggcgaugacugcgugguuaagcccauugaugacagauuugccaacgcucugcuugcccugaaugauaugggaaaagugcggaaggacaucccccaauggcagccuucuaaaggcuggcaugauuggcagcaggucccguucuguucccaccauuuccacgaacucauuaugaaggacgggcgcaaacuggugguucccugcagaccucaagacgagcuuaucggacgggcucgcauuagccagggcgccggguggucucugagagaaacagcgugucucggaaaggccuacgcucagauguggucccugauguauuuucaccggcgcgaucugagacucgccagcaacgccaucugcucugcugugcccguccauugggugccuaccucccggacaacguggagcauucacgcccaucaccaauggaugaccacagaggacaugcugaccgucuggaauagaguguggaucgaagauaaccccuggauggaggacaagacaccuguuaccacgugggagaaugugcccuaccuuggcaaacgcgaagaucaguggugugggucccugaucggccucaccagccgggcgacaugggcucagaacauuccgaccgccauccagcaagucagaucucugauuggaaaugaggaauuccuugacuacaugccuagcaugaagcgcuuucggaaagaggaggaauccgagggcgccaucugguga

SEQ ID NO: 20438 - RNA, 9873 nt, Artificial Sequence
  derived and/or modified CDS sequence (opt5) from DENV-3__GU131874__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcucauugagggcaaaguugugcaguaugaaaaucugaaguacacagucaucaucaccgugcacacaggggaccagcaucagguuggaaacgagacgcaaggcgugaccgcugaaauuacaccccaggccucuaccacagaggcuauccugccugaauauggcacccucgggcuggagugcucccccagaacgggacuugacuucaaugagaugauucugcucaccaugaaaaacaaggccuggaugguccaccggcagugguuuuucgaucugccucuucccuggacaagcggcgccaccacagaaaccccgacguggaaucgcaaagagcugcucgugacauuuaagaacgcucaugcgaaaaagcaagaagucgugguucuggggucucaggagggagccaugcacaccgcucugacaggcgccaccgaaauccagaauuccgggggcaccagcauuuucgccggacaccucaaguguagacugaaaauggacaagcuugagcugaaaggcaugucuuacgcuaugugcacaaacacguuugugcucaagaaagaggucuccgaaacccagcaugggacaauccugaucaagguggaguacaagggagaagaugccccuuguaaaauucccuucagcaccgaggacggccaagggaaggcgcacaacggacggcugaucacagcuaauccuguugugaccaaaaaggaggaacccgucaacauugaggccgaacccccuuucggcgaguccaauaucgugauugggacgggcgauaacgcccuuaaaaucaauugguauaagaagggaucuagcaucggcaaaauguuugaagcuacagccagaggggcucgccggauggccauucucggagacaccgcgugggauuucggcuccguggggggaguucugaacagccugggcaagaugguccaucagaucuuugggucugccuacaccgcucucuucuccggcgugagcugggugaugaaaauuggaaucggcguccugcuuacauggauugggcugaauucuaagaacaccagcauguccuuuucuugcaucgccauuggaaucaucacacucuaucugggcgcugugguucaggccgacauggggugugugauuaauuggaaaggaaaggagcugaagugcggcagcgggaucuucgucacgaacgaggugcacaccuggacagaacaguacaaauuucaagcggauuccccgaagagacuugccaccgcuauugccggcgcuugggagaauggaguuuguggcauccgcagcacaacccggauggaaaaccuccuguggaaacagauugccaaugagcugaacuauauccucugggaaaauaacaucaagcugacgguggucgugggggacauuaucggaguucuugagcagggcaaaagaacccugacaccccagccuauggagcucaaguacucuuggaaaaccugggggaaggccaagauugugacagcugaaacccaaaacuccagcuucaucauugauggacccaauacaccugagugccccucuaccucccgcgcguggaacgucugggaaguggaggacuauggcuuuggcguguucacgacaaauaucuggcugaaacugcgggaagucuacacccagcuuugugaccauagacucaugagcgccgcuguuaaggaugagcgcgccgugcacgccgacaugggguacuggaucgagucccagaaaaacggaucuuggaagcuggaaaaagcuagccugauugaggugaagaccugcacauggccgaagucccacacccucuggucuaauggcguccuggaaagcgauaugaucauuccuaaaucccuugccgggcccaucagccagcauaaccaccggccuggauaucauacgcaaacagcgggccccuggcaccuggggaagcucgagcuggacuuuaauuacugcgagggaaccacagugguuauuaccgaaaacuguggcacaagaggcccuucucugcgcaccacgaccguguccgggaaacuuauccacgaguggugcugucggagcugcacacuccccccgcugagauauaugggagaagauggcuguugguacgggauggagauccggccuauuucugaaaaggaggagaauauggucaaaucccuggugagcgcuggaucuggcaagguugacaacuucaccaugggggugcucugccuggccauccuuuuugaagaggucaugcgcggaaaguucggcaaaaagcauaugauugccggcguguucuuuacauucguucugcuccugagcgggcagaucaccuggagagauauggcucacacgcugauuaugaucggauccaaugccagcgaccggaugggcaugggggugacauaucuugcgcugauugcuaccuuuaaaauccagcccuuccucgcccugggauuuuuccucagaaagcugacaucucgcgaaaaccuucugcucggcgucgggcuggccauggcuaccacccugcaacuucccgaggauaucgaacagauggccaauggaauugcucugggccucauggcccugaaacucaucacacaguuugagacguaccagcuguggaccgcgcuuauuucccugacauguagcaacaccauguucacacucaccguggccuggcggacggcuacacugauccuggccggcgugucccuucugccugucugccaaucuagcuccaugagaaagaccgacuggcucccgauggcuguugccgccaugggggugcccccucugccccucuuuauuuucucucugaaggauacccuuaaacgcagaagcuggccucugaaugagggagugauggcugucggccugguguccauccucgcgucuagccugcuucggaacgacguucccauggccgggccucugguggcuggaggccuccugaucgccuguuaugucauuacagggaccuccgccgaucucacaguggaaaaggcugccgacaucacgugggaggaagaggcggaacagaccggaguuagccauaaccugaugauuacaguggacgaugacggcaccaugcgcaucaaagaugacgagacagagaauauucuuaccguccugcugaagacggcucuccugaucgugucuggcgucuuucccuacuccaucccggccacccuucugguguggcacacauggcagaaacagacccaaagaagcgggguucucugggaugugccuucucccccugaaacacagaaggccgagcuggaagagggagucuaccggauuaaacagcagggcaucuucgggaagacccaagugggaguuggcgugcagaaggagggggucuuucauacaauguggcacgugacgcgcggagcugugcucaccuauaacggcaaaagacuggaacccaauugggccuccguuaagaaagaccuuauuagcuacggcgggggauggcggcugucugcgcaguggcaaaagggcgaggaaguccaggugaucgcuguggagccggggaaaaacccuaagaauuuccagacaaugcccggaaccuuccagaccacaacgggcgaaauuggggccaucgcccuggauuuuaagccuggaaccuccggcagccccauuaucaaccgcgagggcaaagucguggggcucuauggaaauggcguugugacaaagaacgggggauacgucuccggcaucgcucaaaccaaugccgagcccgacgggccuacaccggaacuggaggaagagauguucaaaaagagaaaccuuaccauuauggaucugcaccccggcagcggaaaaacgcggaaguaucucccugcuaucgugcgcgaagccauuaagagacggcugagaacacucauccuggcgcccacccgcguuguggccgcugagauggaggaagcccuuaaaggccugccuauucgguaccagaccacagcuaccaagucugagcauacagggagagaaaucgucgaccugaugugccacgccaccuuuacgaugcgccuccugagccccgugcggguuccuaauuauaaccuuaucauuauggaugaggcccauuucacagacccggcuuccaucgcggccagaggauacauuucuacccgcgugggcaugggggaagcugccgccaucuuuaugacagcuacccccccuggaacggccgaugcguucccccagagcaaugcuccuauucaggacgaggagcgggacauccccgaaagauccuggaacucuggcaaugaguggaucaccgauuuugccgggaaaacagucugguucgugccgagcauuaaggccggcaacgacaucgcuaacugucugcgcaaaaauggaaagaaggugauucaacucucccggaaaaccuuugauacagaauaccagaagaccaaacugaacgacugggauuucgucguuacaaccgacaucucugagaugggcgccaauuuuaaggcggauagagugauugacccucggcgcugccugaaacccgugauccucacggaugggcccgagagagucauucuugccggaccuaugcccgugacagcugccagcgcugcccagcggcgcggcagaguugggcggaacccucagaaggaaaaugaccaauauaucuucaccggacagccgcugaacaaugaugaggaccacgcucauuggaccgaagccaagaugcugcucgacaacaucaauacacccgagggcauuaucccugcgcuguucgaacccgagagagagaaauccgccgcuauugauggggaauaccgccuuaagggcgagagccggaaaaccuuuguggaacugaugagacgcggagaccucccugucuggcuggcccacaagguggcuucugagggcaucaaauauacagaucggaaguggugcuucgacgggcagagaaacaaucagauucuggaagagaacauggauguugagaucuggacgaaagaaggagagaagaagaaacuccgcccccgguggcuugacgccagaaccuacuccgauccgcuggcccugaaggaauuuaaagacuucgcugcgggccgcaagagcaucgcccucgaucuggugacagagauugggagagucccuucucaccuugcucaucggacccgcaaugcccuggacaaccucgugaugcugcacacauccgaacauggaggcagagccuaucggcacgcugucgaggagcugcccgaaaccauggagacgcuccuucugcugggccucaugauccugcuuaccgggggagccaugcuguuucucauuagcggcaaagggaucggaaagacauccauuggccugaucugugugaucgcgucuagcgggaugcuguggauggccgaaauuccucuccaauggaucgcuuccgccauuguucuugaguucuuuaugauggugcugcugauccccgagccugaaaagcagcgcaccccccaggauaaucaacucgcuuacguggucauuggaauccugacacuugccgcgauuaucgccgcuaacgagaugggccugcucgaaaccacgaaaagagaccugggcaugagcaaggagccggggguugugucuccuacauccuaucuggauguggaccuccaccccgccagcgcuuggacccuuuacgccgucgcuacaaccgugaucacccccaugcugcggcauacaauugaaaauucuacggccaacguuagccuggcggccaucgcuaaccaggccgugguccucaugggacuggacaaaggcuggccuauuuccaagauggaucuuggggugccgcugcucgcucugggaugcuacucucaggucaauccccugacccucacagccgccgugcuucugcugaucacccacuaugcgauuaucggcccugggcuccaggcuaaagccacaagagaggcucaaaagcgcaccgccgccggaaucaugaagaaccccacgguugacggcauuaugacaaucgaucuggacccugugauuuacgauagcaaauucgagaagcagcuuggccaggucaugcugcucgugcugugugcugcccagcugcuccuuaugcggaccuccugggcgcugugcgaagcccugacccucgcuacagggcccaucaccacacugugggagggaucuccuggcaaauuuuggaauacgaccauugccguuagcauggcuaacaucuucagaggguccuaucuugccggagcgggccuggccuuuagcaucaugaagucuguggggacaggaaaacgcggcaccggcucccaaggggaaacacucggagagaaguggaagaaaaagcugaaucagcugagccggaaagaauucgaccucuacaagaaauccggcauuaccgaggucgauagaacggaggcuaaggaagggcuuaaacggggagagaucacccaucacgccgugucucgcggcagcgcuaagcugcagugguuuguggaaagaaacaugguuauuccggaggggcgggucaucgaccugggauguggccgcggcgggugguccuauuacugcgccggacucaagaaagugacagaagugagaggcuauaccaaggggggacccggccaugaggagccuguccccaugucuacauacggguggaauauuguuaaacugaugagcggaaaggauguguucuaccuuccucccgaaaaaugugacacccugcucugcgauaucggcgaguccagcccgucuccuacaguggaagagucccggaccauucgcguccugaagaugguggagcccuggcugaagaacaaucaguucuguaucaaaguucucaaccccuauaugccuacggugaucgaacaccuugagagacugcaacggaagcacggcgggaugcugguccgcaauccccucagcagaaacucuacacaugaaauguacuggauuuccaauggaaccggcaacaucguggcuagcguuaauauggugucucggcugcuucugaacagauuuaccaugacacaccgccggccuacgauugagaaagacgucgaucucggggccggaaccagacaugugaacgcggaaccggagacacccaauauggacgugaucggcgagcgcauuaagcggaucaaagaagagcacaacagcaccuggcacuaugacgaugaaaauccuuacaagacaugggccuaucauggguccuacgaggucaaggcuaccggaucugccagcuccaugaucaacggcguugugaaacugcugacaaagcccugggacguggucccuauggugacccagauggcuaugacggauaccacacccuucggccagcaaagaguuuuuaaagaaaagguggacacccgcacaccgcggagcaugccugggaccagacgcgucaugggaauuacggccgaguggcucuggcggacacugggcagaaauaaacgcccccggcuuugcaccagagaggaauucacaaagaaggugcgcaccaacgccgcgaugggggcuguuuuuacggaggaaaaucagugggauuccgccaaagccgcuguggaggacgaagauuucuggaagcuggucgacagagagcgggagcuccacaaacugggaaaguguggcucuugcguguauaacaugauggggaaacgcgaaaagaaacuuggcgaguuuggaaaggccaagggcagcagagcuaucugguacauguggcugggggcccgguaccucgaauucgaggcgcugggauuucugaaugaggaucauugguucuccagagaaaacucuuauagcggcguugagggggaaggacuccacaaacugggcuacauucuucgggacaucuccaagauuccugggggcgccauguaugcugaugacaccgccggaugggacacacgcaucaccgaggaugaccugcauaaugaagagaaaaucacacagcagauggaucccgagcacagacaacucgcuaacgccauuuuuaagcugaccuaccagaauaaaguggucaaggugcagcggccuacacccaccggcacggucauggacaucauuucucgcaaggaucagagagggagcggacaagugggcacauaugggcuuaacaccuucaccaauauggaagcgcagcugauccggcagauggagggagaaggcguucucuccaaagccgaccuggagaacccgcaccugccugaaaagaaaauugcucaguggcucgagacaaaggggguggagcgccugaaaagaauggccaucagcggcgaugacugcgucgugaagcccaucgaugaccgguuugcuaacgcccuucuggcucucaaugauaugggaaaggugcgcaaagacauuccccaauggcagccuucuaagggcuggcaugauuggcagcagguuccguucuguucccaccauuuccacgaacugaucaugaaagacgggagaaagcuugugguccccugccggccucaagacgagcugauuggacgcgccagaaucagccagggcucuggguggucccuccgggaaaccgcgugucugggaaaagccuacgcucagauguggagccugauguauuuucaccgcagagaucuccggcuggccucuaacgccauuugcuccgcugugcccguucauugggugccuacaagcagaacgaccugguccauccacgcccaucaccaauggaugacaaccgaggacaugcuugcggucuggaaucgcguguggauugaagauaaccccuggauggaggacaagacaccugucaccacgugggagaaugugcccuaccugggcaagcgggaagaucaguggugugggagccucaucggccugaccucuagagcuacaugggcccagaacaucccgaccgccauucagcaaguucgcagccuuaucggaaaugaggaauuccuggacuacaugccuuccaugaaacgguuuagaaaggaggaggaaucugagggcgcuauuugguga

SEQ ID NO: 20439 - RNA, 9873 nt, Artificial Sequence
  derived and/or modified CDS sequence (opt5) from DENV-3__GU131875__SS-prME
accagccugugccucgugaugauccugcccgccgcucuugccuuccaccugacauccagagacggcgagccucggaugauugucgggaagaacgaacgcggaaaaucucuccuguuuaagacggcgagcggcaucaauauguguacccuuauugcuauggaucugggggagaugugcgacgauacaguuaccuacaaauguccgcauaucacagaaguggagcccgaagacauugauugcugguguaaccucaccuccacaugggugaccuauggaacgugcaaucaggccggcgagagacggcgcgacaagagaucugucgcccuggcuccucacguggggaugggacuggauacccggacacaaaccuggaugagcgccgagggcgcuuggcgccagguugaaaaaguggagacaugggcccucagacaucccggcuucaccauccuggcgcuuuuucuggcccacuacaucgggacgucccucacacagaaggucgugauuuucauccugcuuaugcugguuaccccuucuaugacaaugcggugugugggagucggcaaccgcgacuuuguggaagggcucagcggagcuaccuggguggaugucguucuggagcauggcgggugcgugaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuaugucuguaaacacaccuacguggaucgcggcugggggaacggaugcggccuguucgggaagggaagccuuguuaccugcgccaaguuucaaugucuggagcccauugagggcaaagugguccaguaugaaaaucucaaguacacagugaucaucaccguucacacaggggaccagcaucaggugggaaacgagacgcaaggcgucaccgcugaaauuacaccucaggccucuaccacagaggcuauccugcccgaauauggcacccuggggcucgagugcuccccuagaacgggacuggacuucaaugagaugauucuucugaccaugaaaaacaaggccuggauggugcaccggcagugguuuuucgaucucccccugccguggacaagcggcgccaccacagaaaccccuacguggaaucgcaaagagcuucuggucacauuuaagaacgcucaugcgaaaaagcaagaagugguugugcucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuuguccugaagaaagagguguccgaaacccagcaugggacaauccucaucaagguugaguaccggggagaagaugcccccuguaagauuccuuucagcaccgaggacggccaagggaaagcgcacaacggaagacugaucacagcuaaucccguggucaccaagaaagaggaacccgugaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguugggggaguccucaacagccugggcaaaauggugcaucagauuuuugggucugccuacaccgcucuguucuccggcgugagcugggucaugaagaucggaauuggcauccuccugaccuggauugggcuuaauucuaaaaacacaagcauguccuuuucuugcaucgccaucggaauuaucacccuguaucucggcgcugugguucaggccgacauggggugugugauuaauuggaagggaaaagagcugaagugcggcagcgggaucuucgucacaaacgaggugcacacguggaccgaacaguacaaguuucaagcggauucccccaaacgccuggccacagcuauugccggcgcuugggagaauggaguuuguggcauccggagcaccacaagaauggaaaaccuucucuggaagcagaucgccaaugagcugaacuauauucugugggaaaauaacaucaaacucaccguggucgugggggacauuaucggaguucuggagcagggcaagcgcacgcuuaccccucagcccauggagcugaaauacucuuggaagacaugggggaaagccaagauugugaccgcugaaacacaaaacuccagcuucaucaucgauggaccuaauacccccgagugcccgucugcgucccgggccuggaacgucugggaaguggaggacuauggcuuuggcguguucacaaccaauauuuggcucaagcugagagaagucuacacgcagcugugugaccaucgccuuaugagcgcugccguuaaagaugagcgggccgugcacgcugacaugggguacuggaucgagucccagaagaacggaucuuggaaacucgaaaaggccagccugauugaggugaaaacaugcaccuggccuaagucccacacccuguggucuaauggcguccucgaaagcgauaugaucauucccaagucccuggcggggccuaucagccagcauaaccacagacccggauaucauacacaaaccgcuggcccuuggcaccuugggaaacuggagcucgacuuuaauuacugcgagggaacgacagugguuaucaccgaaaacuguggcacacgcggccccucucugcggaccacaaccguguccgggaagcugauucacgaguggugcuguagaagcugcacgcuuccgccucuccgguauaugggagaagauggcuguugguacgggauggagauccgccccauuucugaaaaagaggagaauauggucaagucccuggugagcgccggaucuggcaaaguugacaacuucaccaugggggugcugugccucgccauccuguuugaagaggucaugagaggaaaguucggcaagaaacauaugauugcuggcguguucuuuacauucguucuucugcucagcgggcagaucaccuggcgggauaugacacacacccugauuaugaucggauccaaugccagcgacagaaugggcaugggggugacguaucuggcgcuuaucgcuacauuuaagauucagcccuuccuggcccucggauuuuuccugcgcaaacucaccucucgggaaaaccugcuucugggcgucgggcucgccauggcuacaacccugcaacugccugaggauaucgaacagauggccaauggaauugcucuuggccugauggcccucaagcugaucacccaguuugagacauaccagcucuggacggcgcugauuucccuuaccuguagcaacacaauguucacccugacaguggccuggagaaccgcuacgcucauccuggccggcgugucccugcuuccggucugccaaucuagcuccaugcgcaaaacagacuggcugcccauggcuguugccgccaugggggugccuccccucccucuguuuaucuucucucucaaggauacccugaagagacggagcuggccccuuaaugagggagugauggcugucggccugguguccauucuggcgucuagccuccugcgcaacgacguuccuauggccgggccccuuguggcuggaggccugcucaucgccuguuaugucauuaccgggacauccgccgaucugaccguggaaaaagcugccgacaucacaugggaggaagaggcggaacagacgggaguuagccauaaccucaugauuaccguggacgaugacggcacaaugagaaucaaggaugacgagaccgagaauauccugacaguccuucugaaaaccgcucugcucauugugucuggcgucuuuccguacuccaucccugccacgcugcuuguguggcacaccuggcagaagcagacacaacggagcgggguucugugggaugugcccucuccucccgaaacccagaaagccgagcucgaagagggagucuaccgcauuaagcagcagggcaucuucgggaaaacacaagugggaguuggcgugcagaaggagggggucuuucauaccauguggcacgugacaagaggagcugugcugacguauaacggcaagcggcucgaaccgaauugggccuccguuaaaaaggaccugauuagcuacggcgggggauggcgccuuucugcgcaguggcaaaaaggcgaggaaguccaggugaucgcuguggagccugggaagaaccccaaaaauuuccagaccaugccuggaacauuccagaccaccacaggcgaaauuggggccaucgcccuggauuuuaagcccggaacguccggcagccccaucauuaacagagagggcaaggucguggggcuguauggaaauggcguugugaccaaaaacgggggauacgucuccggcaucgcucaaacaaaugccgagccugacgggccgacccccgaacucgaggaagagauguucaagaaacggaaccugacaauuauggaucuucacccuggcagcggaaagacccgcaaauaucugcccgcuaucauuagagaagccaucaagcggagacuccgcacgcugauccucgcgccuacacgggugguugccgcugagauggaggaagcccugaagggccuucccauuagauaccagaccaccgcuacaaaaucugagcauaccgggcgcgaaaucguggaccugaugugccacgccacauuuaccaugcggcugcucagcccugucagagugccgaauuauaaccugauuaucauggaugaggcccauuucacggaccccgcuuccauugcggcccgcggauacaucucuacacggguuggcaugggggaagcugccgccaucuuuaugaccgcuacaccucccggaaccgccgaugcguucccucagagcaaugcucccauucaggacgaggagagagacaucccggaacgcuccuggaacucuggcaaugaguggauuacggauuuugccgggaagaccgugugguucgucccuagcaucaaagccggcaacgacauugcuaacugucuucggaagaauggaaaaaaggugauccaacuguccagaaagacauuugauaccgaauaccagaaaacaaagcucaacgacugggauuucguggucaccacagacauuucugagaugggcgccaauuuuaaaguugaucgggugaucgacccccgcagaugccugaagcccgugauccugaccgaugggccugagcgggucauucucgcgggacccaugccugugacggccgcuagcgccgcucagcgcagaggccggguugggagaaacccgcagaaagaaaaugaccaauauaucuucacaggacagccccuuaacaaugaugaggaccacgcccauuggaccgaagcuaagaugcugcuggacaacauuaauaccccugagggcaucauucccgcccucuucgaaccugagcgcgagaaguccgcggccaucgauggggaauaccggcugaaaggcgagagcagaaagacauuuguggaacuuaugcgccggggagaccugcccgucuggcucgcucacaaaguggccucugagggcaucaaguauaccgauagaaaauggugcuucgacgggcagcgcaacaaucagauucuggaagagaacauggauguugagaucuggacaaaggaaggagagaaaaagaagcugcggccgagauggcucgacgcucgcacguacuccgauccucuugcccugaaagaauuuaaggacuucgccgcuggcagaaaaagcauugcgcuggaucucgugaccgagaucgggcggguccccucucaccuggcccaucgcacaagaaaugcucuugacaaccuggugaugcuccacaccuccgaacauggaggccgggccuaucgccacgccgucgaggagcugccugaaacaauggagacccugcuccuucugggccugaugauucuccugacggggggagcuaugcuuuuucugaucagcggcaaggggaucggaaaaaccuccauuggccucaucugugugauugccucuagcgggaugcuguggauggcggaaaucccccugcaauggauugccuccgcuaucguucucgaguucuuuaugauggugcuucugauuccugagcccgaaaagcagagaacaccgcaggauaaucaacuggccuacguggucaucggaauccucacccuggcugccauuaucgcggccaacgagaugggccuucuggaaacaaccaagcgggaccucggcaugagcaaagagccugggguugugucucccacguccuaucuggauguggaccugcaccccgcuagcgccuggacacucuacgcugucgccaccacagugauuaccccuaugcuuagacauaccaucgaaaauucuacagcuaacguuagccuggccgcgauugccaaccaggcugugguccugaugggacucgacaagggcuggccgaucuccaaaauggaucugggggugccccuucuggcccucggaugcuacucucaggucaauccucugacgcugaccgcugccgugcuccuucugaucacacacuaugccauuaucggccccgggcugcaggcgaaggcuacccgcgaggcccaaaaacggacagcugccggaauuaugaagaacccuaccguugacggcaucaugacgauugaucucgaccccgugaucuacgauagcaaguucgagaaacagcugggccaggucaugcuucuggugcucugugccguucagcugcugcucaugagaacauccugggcucuuugcgaagcccugacccuggcgaccgggccuaucacaacccucugggagggaucuccgggcaaguuuuggaauacaacgauugccgugagcauggcuaacaucuuccgcggguccuaucuggccggagcuggccuugccuuuagcauuaugaaaucugucgggaccggaaagcggggcacaggcucccaaggggaaacccugggagagaaauggaagaagaaacucaaucagcugagcagaaaggaauucgaccuguacaaaaaguccggcaucacagagguggaucggaccgaggcgaaagaagggcucaagcgcggagagauuacgcaucacgccgugucuagaggcagcgcuaaacuucagugguuuguugaacggaacauggucauccccgaggggcgcgugauugaccugggauguggcagaggcgggugguccuauuacugcgccggacugaagaaggugaccgaaguccggggcuauacaaaagggggaccuggccaugaggagcccguuccuaugucuaccuacggguggaauaucgugaagcucaugagcggaaaagauguguucuaccugcccccggaaaagugugacacacuucugugcgauaucggcgaguccagcccuucucccaccgucgaagagucccgcacaauuagagugcucaaaaugguugagcccuggcugaagaacaaucaguucuguaucaaggugcugaacccuuauaugcccaccgucauugaacaccucgagcggcuucaacgcaaacacggcgggaugcuggugagaaauccucugagccggaacucuacgcaugaaauguacuggaucuccaauggaacaggcaacauuguugcuagcgugaauauggucucuagacuccugcuuaaccgcuuuaccaugacccaccggagaccgacaaucgagaaggacguggaucugggggccggaacgcgccaugugaacgcugaacccgagaccccuaauauggacgucaucggcgagcggauuaaaagaaucaaggaagagcacaacagcacauggcacuaugacgaugaaaaucccuacaaaaccugggccuaucauggguccuacgagguuaaggcgacaggaucugccagcuccaugauuaacggcguggugaagcuccugaccaaaccuugggacgucgugcccaugguuacacagauggcuaugaccgauacgaccccguucggccagcaacgcguguuuaaggaaaaagucgacacacggaccccuagaagcaugcccgggacacgccgggugaugggaaucaccgccgaguggcuguggagaacgcucggccgcaauaagaaaccucggcugugcacaagagaggaauucaccaagaagguucgcacaaacgcugccaugggggccguguuuaccgaggaaaaucagugggauuccgcgaaagcugccgucgaggacgaagauuucuggaagcuuguggacagagagcgggagcugcacaaacucggaaaguguggcucuugcguuuauaacaugauggggaaacgcgaaaagaaacugggcgaguuuggaaaggccaagggcagcagagcuauuugguacauguggcuuggggcccgguaccuggaauucgaggcucucggauuucugaaugaggaucauugguucuccagagaaaacucuuauagcggcguggagggggaaggacugcacaaacucggcuacauccugcgggacaucuccaagauucccgggggcgccauguaugcggaugacacggccggaugggacacccgcaucacagaggaugaccuucauaaugaagagaaaauuacccagcagauggauccugagcacagacaacuggcuaacgccaucuuuaagcucacauaccagaauaaagucgugaagguccagcggcccaccccgacaggcaccgugauggacauuaucucucgcaaggaucagagagggagcggacaaguuggcacguaugggcugaacacauucaccaauauggaagcucagcuuauccggcagauggagggagaaggcgugcuguccaaagccgaccucgagaacccucaccugcccgaaaagaaaauuacccaguggcuggagacaaagggggucgagcgccucaaaagaauggcgaucagcggcgaugacugcguggugaagcccauugaugaccgguuugccaacgcucugcuugcccugaaugauaugggaaagguucgcaaagacaucccucaauggcagccgucuaagggcuggcaugauuggcagcaggugcccuucuguucccaccauuuccacgaacucauuaugaaagacgggagaaagcuggucgugccuugccggccccaagacgagcuuaucggacgcgcuagaauuagccagggcgccggguggucucugcgggaaaccgcuugucucggaaaagccuacgcgcagauguggucccugauguauuuucaccgcagagaucugcggcucgccagcaacgcuaucugcucugccguuccugugcauuggguccccacauccagaacgaccuggagcauccacgcccaucaccaauggaugacaaccgaggacaugcugacaguguggaaucgcgucuggauugaagauaacccuuggauggaggacaagacccccgugacgaccugggagaauguuccguaccuuggcaagcgggaagaucaguggugugggucccugaucggccucacaagcagagcuaccugggcccagaacauuccuacagcgauccagcaagugcgcucucugauuggaaaugaggaauuccuugacuacaugcccagcaugaaacgguuuagaaaggaggaggaauccgagggcgcuaucugguga

SEQ ID NO: 20440 - RNA, 9873 nt, Artificial Sequence
  derived and/or modified CDS sequence (opt5) from DENV-3__GU131877__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuugugcugaagaaagaggucuccgaaacccagcaugggacaauccucaucaagguggaguaccggggagaagaugcccccuguaagauuccuuucagcaccgaggacggccaagggaaagcgcacaacggaagacugaucacagcuaaucccguugugaccaagaaagaggaacccgucaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguggggggaguucucaacagccugggcaaaaugguccaucagauuuuugggucugccuacaccgcucuguucuccggcgugagcugggugaugaagaucggaauuggcguccuccugaccuggaucgggcuuaauucuaaaaacacaagcauguccuuuucuugcauugccaucggaaucauuacccuguaucucggcgcugugguucaggccgacauggggugugugaucaauuggaagggaaaagagcugaagugcggcagcgggauuuucgucacaaacgaggugcacacguggaccgaacaguacaaguuucaagcggauucccccaaacgccuggccacagcuaucgccggcgcuugggagaauggaguuuguggcauucggagcaccacaagaauggaaaaccuucucuggaagcagaucgccaaugagcugaacuauauccugugggaaaauaacauuaaacucaccguggucgugggggacaucauuggaguucuggagcagggcaagcgcacgcuuaccccucagcccauggagcugaaauacucuuggaagacaugggggaaagccaagaucgugaccgcugaaacacaaaacuccagcuucauuaucgauggaccuaauacccccgagugcccgucugcgucccgggccuggaacgucugggaaguggaggacuauggcuuuggcguguucacaaccaauaucuggcucaagcugagagaagucuacacgcagcugugugaccaucgccuuaugagcgcugccguuaaagaugagcgggccgugcacgcugacaugggguacuggauugagucccagaagaacggaucuuggaaacucgaaaaggccagccugaucgaggugaaaacaugcaccuggccuaagucccacacccuguggucuaauggcguccucgaaagcgauaugauuauccccaagucccuggcggggccuauuagccagcauaaccacagacccggauaucauacacaaaccgcuggcccuuggcaccuugggaaacuggagcucgacuuuaauuacugcgagggaacgacagugguuaucaccgaaaacuguggcacacgcggccccucucugcggaccacaaccguguccgggaagcugauccacgaguggugcuguagaagcugcacgcuuccgccucuccgguauaugggagaagauggcuguugguacgggauggagauucgccccaucucugaaaaagaggagaauauggucaagucccuggugagcgccggaucuggcaaaguugacaacuucaccaugggggugcugugccucgucauucuguuugaagaggugaugagaggaaaguucggcaagaaacauaugaucgccggcguuuucuuuacauucgugcuucugcucagcgggcagauuaccuggcgggauauggcucacacacugaucaugauuggauccaaugccagcgacagaaugggcaugggggucaccuaucuggcgcuuaucgcuacguuuaagauccagcccuuccuggcccucggauuuuuccugcgcaaacucacaucucgggaaaaccugcuucugggcguggggcucgccauggcuaccacacugcaacugccugaggauauugaacagauggccaauggaaucgcucuuggccugauggcccucaagcugauuacccaguuugagaccuaccagcucuggacagcgcugaucucccuuacguguagcaacaccauguucacacugaccguggccuggagaacagcuacccucauucuggccggcgucucccugcuuccgguuugccaaucuagcuccaugcgcaaaacggacuggcugcccauggcuguggccgccaugggggugccuccccucccucuguuuaucuucucucucaaggauacacugaagagacggagcuggccccuuaaugagggagucauggcugugggccugguuuccauccuggcgucuagccuccugcgcaacgacgugccuauggccgggccccuugucgcuggaggccugcucauugccuguuaugugaucaccgggaccuccgccgaucugacaguugaaaaagcugccgacauuaccugggaggaagaggcggaacagacaggagugagccauaaccucaugaucacggucgacgaugacggcaccaugagaauuaaggaugacgagacagagaauauccugaccgugcuucugaaaacagcucugcucaucauuucuggcgucuuuccguacuccaucccugccacccugcuuguguggcacacguggcagaagcagacccaacggagcgggguucugugggaugugcccucuccucccgaaacacagaaagccgagcucgaagagggagucuaccgcauuaagcagcagggcaucuucgggaaaacccaagugggaguuggcgugcagaaggagggggucuuucauacaauguggcacgugaccagaggagcugugcugacauauaacggcaagcggcucgaaccgaauugggccuccguuaaaaaggaccugauuagcuacggcgggggauggcgccuuucugcgcaguggcaaaaaggcgaggaaguccaggugaucgcuguggagccugggaagaaccccaaaaauuuccagacgaugccuggaaccuuccagacaaccaccggcgaaauuggggccaucgcccuggauuuuaagcccggaacauccggcagccccaucauuaacagagagggcaaggucguggggcuguauggaaauggcguugugacgaaaaacgggggauacgucuccggcaucgcucaaaccaaugccgagccugacgggccgacacccgaacucgaggaagagauguucaagaaacggaaccugaccauuauggaucuucacccuggcagcggaaagacacgcaaauaucugcccgcuaucauuagagaagccaucaagcggagacuccgcacccugauccucgcgccuacgcgggugguugccgcugagauggaggaagcccugaagggccuucccauuagauaccagacaaccgcuaccaaaucugagcauacagggcgcgaaaucguggaccugaugugccacgccaccuuuacaaugcggcugcucagcccugucagagugccgaauuauaaccugauuaucauggaugaggcccauuucaccgaccccgcuuccauugcggcccgcggauacaucucuacgcggguuggcaugggggaagcugccgccaucuuuaugacagcuaccccucccggaacagccgaugcguucccucagagcaaugcucccauucaggacgaggagagagacaucccggaacgcuccuggaacucuggcaaugaguggauuaccgauuuuagcgggaagacggugugguucgucccuuccaucaaagccggcaacgacauugccaacugucuucggaagaauggaaaaaaggugauccaacugucuagaaagaccuuugauacagaauaccagaaaaccaagcucaacgacugggauuucguggucacaaccgacauuagcgagaugggcgcuaauuuuaaagccgaucggguuaucgacccccgcagaugccugaagcccgugauccugacagaugggccugagcgggugauucucgcgggacccaugccugucaccgccgcuuccgccgcucagcgcagaggccggguggggagaaacccgcagaaagaaaaugaccaauauaucuucacgggacagccccuuaacaaugaugaggaccacgcccauuggacagaagcuaagaugcugcuggacaacauuaauaccccugagggcaucauucccgcccucuucgaaccugagcgcgagaagagcgcggccaucgauggggaauaccggcugaaaggcgagucuagaaagaccuuuguugaacuuaugcgccggggagaccugcccguguggcucgcucacaaagucgccuccgagggcaucaaguauacagauagaaaauggugcuucgacgggcagcgcaacaaucagauucuggaagagaacauggauguggagaucuggaccaaggaaggagagaaaaagaagcugcggccgagauggcucgacgcucgcacauacagcgauccucuugcccugaaagaauuuaaggacuucgccgcuggcagaaaaucuauugcgcuggaucucguuacggagaucgggcgggugcccucccaccuggcccaucgcaccagaaaugcucuugacaaccuggucaugcuccacacaagcgaacauggaggccgggccuaucgccacgccguggaggagcugccugaaaccauggagacacugcuccuucugggccugaugauucuccugaccgggggagcuaugcuuuuucugaucuccggcaaggggaucggaaaaacgucuauuggccucaucugugucauugccagcuccgggaugcuguggauggcggaaaucccccugcaauggauugccagcgcuaucgugcucgaguucuuuaugaugguucuucugauuccugagcccgaaaagcagagaaccccgcaggauaaucaacuggccuacguggugaucggaauccucacacuggcugccauuaucgcggccaacgagaugggccuucuggaaaccacaaagcgggaccucggcaugucuaaagagccuggggucguuucccccaccagcuaucuggauguggaccugcaccccgcuucugccuggacgcucuacgcuguggccacaaccgucauuacaccuaugcuuagacauaccaucgaaaauagcaccgcuaacgugucccuggccgcgauugccaaccaggcuguugugcugaugggacucgacaagggcuggccgaucucuaaaauggaucugggggucccccuucuggcccucggaugcuacagccaggugaauccucugacacugacggcugccguccuccuucugaucacccacuaugccauuaucggccccgggcugcaggcgaaggcuacacgcgaggcccaaaaacggaccgcugccggaauuaugaagaacccuacaguggacggcaucaugaccauugaucucgaccccguuaucuacgauuccaaguucgagaaacagcugggccaggugaugcuucugguccucugugccgugcagcugcugcucaugagaacgucuugggcucuuugcgaagcccugacacuggcgaccgggccuaucaccacacucugggagggaagcccgggcaaguuuuggaauaccacaauugccguuuccauggcuaacaucuuccgcgggagcuaucuggccggagcuggccuugccuuuucuauuaugaaauccguggggacgggaaagcggggcaccggcagccaaggggaaacacugggagagaaauggaagaagaaacucaaucagcuguccagaaaggaauucgaccuguacaaaaagucuggcaucaccgaggucgaucggacagaggcgaaagaagggcucaagcgcggagagauuacccaucacgccgugagcagaggcuccgcuaaacuucagugguuuguggaacggaacaugguuauccccgaggggcgcgucauugaccugggauguggcagaggcggguggucuuauuacugcgccggacugaagaaggugacggaagugcggggcuauaccaaagggggaccuggccaugaggagcccgucccuaugagcacauacggguggaauaucguuaagcucauguccggaaaagauguguucuaccugcccccggaaaagugugacacccuucugugcgauaucggcgagagcucuccuucccccacaguggaagagagccgcaccauuagaguccucaaaaugguggagcccuggcugaagaacaaucaguucuguaucaagguucugaacccuuauaugcccacagugauugaacaccucgagcggcuucaacgcaaacacggcgggaugcuggucagaaauccucugucucggaacuccacccaugaaauguacuggaucagcaauggaacgggcaacauuguggcuucuguuaauauggugagcagacuccugcuuaaccgcuuuacaaugacccaccggagaccgaccaucgagaaggacgucgaucugggggccggaacacgccaugugaacgcugaacccgagacgccuaauauggacgugaucggcgagcggauuaaaagaaucaaggaagagcacaacuccaccuggcacuaugacgaugaaaaucccuacaaaacaugggccuaucaugggucuuacgaggucaaggcgaccggaagcgccuccagcaugauuaacggcguugugaagcuccugacaaaaccuugggacgugguccccauggugauccagauggcuaugaccgauacaaccccguucggccagcaacgcguuuuuaaggaaaaaguggacacgcggaccccuagauccaugcccgggacacgccgggucaugggaauuaccgccgaguggcuguggagaacacucggccgcaauaagaaaccucggcugugcaccagagaggaauucacgaagaaggugcgcacaaacgcugccaugggggccguuuuuaccgaggaaaaucagugggauucugcgaaagcugccguggaggacgaagauuucuggaagcuugucgacagagagcgggagcugcacaaacucggaaaguguggcagcugcguguauaacaugauggggaaacgcgaaaagaaacugggcgaguuuggaaaggccaagggcuccagagcuaucugguacauguggcuuggggcccgguaccuggaauucgaggcucucggauuucugaaugaggaucauugguucucuagagaaaacagcuauuccggcguugagggggaaggacugcacaaacucggcuacauccugcgggacauuucuaagauccccgggggcgccauguaugcggaugacacagccggaugggacacccgcauuacggaggaugaccuucauaaugaagagaaaaucacccagcagauggauccugagcacagacaacuggcuaacgccauuuuuaagcucacauaccagaauaaaguggucaaggugcagcggcccaccccgacaggcaccgucauggacaucaucagccgcaaggaucagagaggguccggacaagugggcacauaugggcugaacaccuucacgaauauggaagcucagcuuauucggcagauggagggagaaggcguucugagcaaagccgaccucgagaacccucaccugucugaaaagaaaaucacacaguggcuggagaccaaggggguggagcgccucaaaagaauggcgauuuccggcgaugacugcgucgugaagcccaucgaugaccgguuugccaacgcucugcuugcccugaaugauaugggaaaggugcgcaaagacauuccccaauggcagccuagcaagggcuggcaugauuggcagcagguuccguucuguucucaccauuuccacgaacucaucaugaaagacgggagaaagcuggugguccccugccggccucaagacgagcuuauuggacgcgcuagaaucucccagggcgccggguggagccugcgggaaaccgcuugucucggaaaagccuacgcgcagauguggucucugauguauuuucaccgcagagaucugcggcucgccuccaacgcuaucugcagcgccgugcccguucauugggugccuacauccagaaccacauggagcauucacgcccaucaccaauggaugacgaccgaggacaugcugacagucuggaaucgcguguggaucgaagauaaccccuggauggaggacaagaccccugucacaaccugggagaaugugcccuaccuuggcaagcgggaagaucaguggugugggucucugauuggccucacgagcagagcuaccugggcccagaacaucccgacagcgauucagcaaguucgcucccugaucggaaaugaggaauuccuugacuacaugccuucuaugaaacgguuuagaaaggaggaggaaagcgagggcgcuaucugguga

SEQ ID NO: 20441 - RNA, 9873 nt, Artificial Sequence
  derived and/or modified CDS sequence (opt5) from DENV-3__GU131878__SS-prME
accagccugugccucaugaugauccugcccgccgcucuugccuuccaccugacguccagagacggcgagccucggaugauuguggggaagaacgaacgcggaaagucucuccuguuuaagacggcgagcggcaucaauauguguacccuuauugcuauggaucugggggagaugugcgacgauacagugaccuacaaguguccgcacaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacagaccuggaugagcgccgagggcgcuuggcgccagguggaaaagguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacagcuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcucauugagggcaaaguugugcaguaugaaaaucugaaguacacagucaucaucaccgugcacacaggggaccagcaucagguuggaaacgagacgcaaggcgugaccgcugaaauuacaccccaggccucuaccacagaggcuauccugccugaauauggcacccucgggcuggagugcucccccagaacgggacuugacuucaaugagaugauucugcucaccaugaaaaacaaggccuggaugguccaccggcagugguuuuucgaucugccucuucccuggacaagcggcgccaccacagaaaccccgacguggaaucgcaaagagcugcucgugacauuuaagaacgcucaugcgaaaaagcaagaagucgugguucuggggucucaggagggagccaugcacaccgcucugacaggcgccaccgaaauccaaaauuccgggggcaccagcauuuucgccggacaccucaaguguagacugaaaauggacaaacuugagcugaaaggcaugucuuacgcuaugugcacaaacacguuugugcucaagaaagaggucuccgaaacccagcaugggacaauccugaucaagguggaguacaagggagaagaugccccuuguaaaauucccuucagcaccgaggacggccaagggaaggcgcacaacggacggcugaucacagcuaauccuguugugaccaaaaaggaggaacccgucaacauugaggccgaacccccuuucggcgaguccaauaucgugauugggacgggcgauaacgcccuuaaaaucaauugguauaagaagggaucuagcaucggcaaaauguuugaagcuacagccagaggggcucgccggauggccauucucggagacaccgcgugggauuucggcuccgucgggggaguucugaacagccugggcaagaugguccaucagaucuuugggucugccuacaccgcucucuucuccggcgugagcugggugaugaaaauuggaaucggcguccugcuuacauggauugggcucaauucuaagaacaccagcauguccuuuucuugcaucgccauuggaaucaucacacucuaucugggcgcugugguucaggccgacauggggugugugauuaauuggaaaggaaaggagcugaagugcggcagcgggaucuucgucacgaacgaggugcacaccuggacagaacaguacaaauuucaagcggauuccccgaagagacuugccaccgcuauugccggcgcuugggagaauggaguuuguggcauccgcagcacaacccggauggaaaaccuccuguggaaacagauugccaaugagcugaacuauauccucugggaaaauaacaucaagcugacgguggucgugggggacauuaucggaguucuugagcagggcaaaagaacccugacaccccagccuauggagcucaaguacucuuggaaaaccugggggaaggccaagauugugacagcugaaacccaaaacuccagcuucaucauugauggacccaauacaccugagugccccucugcgucccgcgccuggaacgucugggaaguggaggacuauggcuuuggcguguucaccacgaauaucuggcugaaacugcgggaagucuacacacagcuuugugaccauagacucaugagcgcugccguuaaggaugagcgcgccgugcacgcugacaugggguacuggaucgagucccagaaaaacggaucuuggaagcuggaaaaagccagccugauugaggugaagaccugcaccuggccgaagucccacacacucuggucuaauggcguccuggaaagcgauaugaucauuccuaaaucccuugcggggcccaucagccagcauaaccaccggccuggauaucauacccaaacggcuggccccuggcaccuggggaagcucgagcuggacuuuaauuacugcgagggaacaaccgugguuauuacagaaaacuguggcaccagaggcccuucucugcgcacaaccacgguguccgggaaacuuauccacgaguggugcugucggagcugcacccugcccccgcugagauauaugggagaagauggcuguugguacgggauggagauccggccuauuucugaaaaggaggagaauauggucaaaucccuggugagcgccggaucuggcaagguugacaacuucacaaugggggugcucugccuggccauccuuuuugaagaggucaugcgcggaaaguucggcaaaaagcauaugauugcuggcguguucuuuaccuucguucugcuccugagcgggcagaucacauggagagauauggcccacacccugauuaugaucggauccaaugcgagcgaccggaugggcaugggggugacguaucuugcucugauugccacauuuaaaauccagcccuuccucgcccugggauuuuuccucagaaagcugaccucucgcgaaaaccuucugcucggcgucgggcuggcuauggccacaacccugcaacuucccgaggauaucgaacagauggcuaauggaauugcccugggccucauggcgcugaaacucaucacccaguuugagacauaccagcuguggacggcccuuauuucccugaccuguagcaacacaauguucacccucacaguggcuuggcggaccgccacgcugauccuggcuggcgugucccuucugccugucugccaaucuagcuccaugagaaagacagacuggcucccgauggccguugccgcuaugggggugcccccucugccccucuuuauuuucucucugaaggauacccuuaaacgcagaagcuggccucugaaugagggagugauggcggucggccugguguccauccucgccucuagccugcuucggaacgacguucccauggcugggccucugguggccggaggccuccugaucgccuguuaugucauuaccgggacauccgcugaucucaccguggaaaaggccgcggacaucacaugggaggaagaggcugaacagacgggaguuagccauaaccugaugauuaccguggacgaugacggcacaaugcgcaucaaagaugacgagaccgagaauauucuuacaguccugcugaagaccgcccuccugaucgugucuggcgucuuucccuacuccaucccggccacgcuucugguguggcacaccuggcagaaacagacacaaagaagcgggguucucugggaugugccuucucccccugaaacccagaaggcugagcuggaagagggagucuaccggauuaaacagcagggcaucuucgggaagacacaagugggaguuggcgugcagaaggagggggucuuucauaccauguggcacgugacacgcggagccgugcucacguauaacggcaaaagacuggaacccaauugggcguccguuaagaaagaccuuauuagcuacggcgggggauggcggcugucugcucaguggcaaaagggcgaggaaguccaggugaucgccguggagccggggaaaaacccuaagaauuuccagaccaugcccggaacauuccagaccaccacaggcgaaauuggggccaucgcucuggauuuuaagccuggaacguccggcagccccauuaucaaccgcgagggcaaagucguggggcucuauggaaauggcguugugaccaagaacgggggauacgucuccggcaucgcccaaacaaaugcugagcccgacgggccuaccccggaacuggaggaagagauguucaaaaagagaaaccuuacaauuauggaucugcaccccggcagcggaaaaacccggaaguaucucccugccaucgugcgcgaagcgauuaagagacggcugagaacgcucauccuggcccccacacgcguuguggcugccgagauggaggaagcucuuaaaggccugccuauucgguaccagaccaccgccacaaagucugagcauaccgggagagaaaucgucgaccugaugugccacgccacauuuaccaugcgccuccugagccccgugcggguuccuaauuauaaccuuaucauuauggaugaggcucauuucacggacccggcguccaucgccgcuagaggauacauuucuacacgcgugggcaugggggaagccgccgcuaucuuuaugaccgccacacccccuggaaccgcggaugcuuucccccagagcaaugccccuauucaggacgaggagcgggacauccccgaaagauccuggaacucuggcaaugaguggaucacggauuuugccgggaaaaccgucugguucgugccgagcauuaaggcuggcaacgacaucgccaacugucugcgcaaaaauggaaagaaggugauucaacucucccggaaaacauuugauaccgaauaccagaagacaaaacugaacgacugggauuucgucguuaccacagacaucucugagaugggcgcgaauuuuaaggccgauagagugauugacccucggcgcugccugaaacccgugauccucaccgaugggcccgagagagucauucuugcuggaccuaugcccgugacggccgcuagcgccgcucagcggcgcggcagaguugggcggaacccucagaaggaaaaugaccaauauaucuucacaggacagccgcugaacaaugaugaggaccacgcccauuggaccgaagcgaagaugcugcucgacaacaucaauacccccgagggcauuaucccugcccuguucgaacccgagagagagaaauccgcugccauugauggggaauaccgccuuaagggcgagagccggaaaacauuuguggaacugaugagacgcggagaccucccugucuggcuggcucacaagguggccucugagggcaucaaauauaccgaucggaaguggugcuucgacgggcagagaaacaaucagauucuggaagagaacauggauguugagaucuggacaaaagaaggagagaagaagaaacuccgcccccgguggcuugacgccagaacguacuccgauccgcuggcucugaaggaauuuaaagacuucgcggccggccgcaagagcaucgcucucgaucuggugaccgagauugggagagucccuucucaccuugcccaucggacacgcaaugcccuggacaaccucgugaugcugcacaccuccgaacauggaggcagagcuuaucggcacgccgucgaggagcugcccgaaacaauggagacccuccuucugcugggccucaugauccugcuuacagggggagcgaugcuguuucucauuagcggcaaagggaucggaaagaccuccauuggccugaucugugugaucgccucuagcgggaugcuguggauggcugccauuccucuccaauggaucgcuuccgccauuguucuugaguucuuuaugauggugcugcugauccccgagccugagaagcagcgcacaccccaggauaaucaacucgcguacguggucauuggaauccugacccuugccgcuauuaucgccgcuaacgaaaugggccugcucgagacaaccaaaagagaccugggcaugagcaaggaaccggggguugugucuccuacguccuaucuggauguggaccuccaccccgccagcgcuuggacacuuuacgccgucgcgaccacagugaucacccccaugcugcggcauaccauugaaaauucuacagccaacguuagccuggcugccaucgcuaaccaggccgugguccucaugggacuggacaaaggcuggccuauuuccaagauggaucuuggggugccgcugcucgcccugggaugcuacucucaggucaauccccugacgcucaccgcggcugugcuucugcugaucacacacuaugccauuaucggcccugggcuccaggcuaaagccaccagagaagcccaaaagcgcacagcugccggaaucaugaagaaccccaccguugacggcauuaugacgaucgaucuggacccugugauuuacgauagcaaauucgagaagcagcuuggccaggucaugcugcucgugcugugugcgguucagcugcuccuuaugcggacauccugggcccugugcgaggcucugacccucgccaccgggcccaucacaacccugugggaaggaucuccuggcaaauuuuggaauacaacgauugcugugagcauggccaacaucuucagaggguccuaucuugcgggagccggccuggcuuuuagcaucaugaagucugucgggaccggaaaacgcggcacaggcucccaaggggagacccucggagaaaaguggaagaaaaagcugaaucagcugagccggaaagaguucgaccucuacaagaaauccggcauuacagaaguggauagaaccgaggccaaggaggggcuuaaacggggagaaaucacgcaucacgcugugucucgcggcagcgccaagcugcagugguuuguugagagaaacauggucauuccggaagggcgggugaucgaccugggauguggccgcggcgggugguccuauuacugcgcuggacucaagaaagugaccgaggucagaggcuauacaaaagggggacccggccaugaggaaccuguucccaugucuaccuacggguggaauauugugaaacugaugagcggaaaggauguguucuaccuuccucccgagaaaugugacacacugcucugcgauaucggcgaauccagcccgucuccuaccgucgaggaaucccggacaauucgcgugcugaagaugguugagcccuggcugaagaacaaucaguucuguaucaaagugcucaaccccuauaugccuaccgucaucgagcaccuugaaagacugcaacggaagcacggcgggaugcuggugcgcaauccccucagcagaaacucuacgcaugagauguacuggauuuccaauggaacaggcaacaucguugccagcgugaauauggucucucggcugcuucugaacagauuuaccaugacccaccgccggccuacaauugaaaaagacguggaucucggggcgggaacgagacaugugaacgccgagccggaaacccccaauauggacgucaucggcgagcgcauuaagcggaucaaagaggaacacaacagcacauggcacuaugacgaugagaauccuuacaagaccugggcuuaucauggguccuacgaaguuaaggccacaggaucugcuagcuccaugaucaacggcguggugaaacugcugaccaagcccugggacgucgugccuaugguuacacagauggccaugaccgauacgacccccuucggccagcaaagaguguuuaaagagaaggucgacacacgcaccccgcggagcaugccugggacaagacgcgugaugggaauuaccgccgaauggcucuggcggacgcugggcagaaauaaaaagccccgccuuugcacacgggaggaguucaccaagaaaguuagaacaaacgcggcuaugggggccguguuuaccgaagagaaucagugggauuccgccaaggcugccgucgaagacgaggauuucuggaaacugguggaccgcgaaagagagcuccacaagcugggaaaauguggcucuugcguuuauaacaugauggggaagcgggagaagaaacuuggcgaauuuggaaaagcuaaaggcagccgcgccaucugguacauguggcugggggcgagauaccucgaguucgaagcccugggauuucugaaugaggaucauugguucucccgggagaacucuuauagcggcguggaaggggagggacuccacaagcugggcuacauucuuagagacaucuccaaaauuccugggggcgcuauguaugccgaugacacggcuggaugggacacccggaucacagaagaugaccugcauaaugaggaaaagaucacccagcagauggaucccgagcaccgccaacucgccaacgcgauuuuuaaacugacauaccagaauaaggucgugaagguccagagaccuacccccacaggcaccgugauggacaucauuucucggaaagaucagcgcgggagcggacaaguuggcacguaugggcuuaacacauucaccaauauggaggcccagcugaucagacagauggaaggagagggcgugcucuccaaggcugaccuggaaaacccgcaucugccugagaaaaagauuacccaguggcucgaaacaaaaggggucgagcggcugaagcgcauggccaucagcggcgaugacugcguggugaagcccaucgaugacagauuugcuaacgcccuucuggcucucaaugauaugggaaaaguucggaaggacauuccccaauggcagccuucuaaaggcuggcaugauuggcaacaggugccguucuguucccaccauuuccacgagcugaucaugaaggacgggcgcaaacuugucgugcccugcagaccucaagacgaacugauuggacgggcccgcaucagccagggcgcgggguggucucucagagagaccgccugucugggaaaggcuuacgcccagauguggucccugauguauuuucaccggcgcgaucucagacuggccagcaacgcuauuugcucugccguucccgugcauugggucccuacaucccggacgaccuggagcauccacgcgcaucaccaauggaugacaaccgaagacaugcuuacaguguggaauagagucuggauugaggauaaccccuggauggaagacaagaccccugugacgaccugggagaauguucccuaccugggcaaacgcgaggaucaguggugugggucccucaucggccugacaagccgggcuaccugggcccagaacaucccgacagccauucagcaagugagaucucuuaucggaaaugaagaguuccuggacuacaugccuagcaugaagcgcuuucggaaagaagaggaguccgaaggcgcuauuugguga

SEQ ID NO: 20442 - RNA, 9873 nt, Artificial Sequence
  derived and/or modified CDS sequence (opt5) from DENV-3__FJ898455__SS-prME
accagccugugccucaugaugaugcugcccgccacccuugcuuuccaccugacguccagagacggcgagccucggaugaucguggggaagaacgaacgcggaaagucucuccuguuuaagaccgccagcggcauuaauauguguacccuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacguugggaugggacucgauacaagaacccaaacauggaugagcgcugagggcgccuggcggcaaguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucacaccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcgucgggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgucaucggagugcuugagcagggcaaacgcacccugacgccccagccuauggagcucaaguauuccuggaagaccugggggaaagccaagauuguuacagcugaaacccaaaauagcucuuuuaucaucgauggacccaacacaccugagugccccuccgcgagccgggccuggaacgugugggaagucgaggacuacggcuucggcguguuuaccacaaauauuuggcugaaacugagagaaauguauacccagcuuugugaccaccgccucauguccgcugccgugaaggaugagcgggccguccacgcugacaugggguacuggaucgagucucagaaaaacggaagcuggaagcuggaaaaggccucccugauugagguuaaaacgugcacauggccgaagucucauacccucuggagcaauggcgugcuggaauccgauaugaucauuccuaaaagccuugcggggcccaucucucagcacaacuacagaccuggauaucauacccaaacagcuggccccuggcaccuggggaagcucgagcuggacuucaauuacugcgagggaaccacgguggucaucacagaaaacuguggcacccgcggcccuucccugcggacaaccacagugagcgggaaacuuauucacgaguggugcuguagaucuugcacccugcccccgcugcgcuauaugggagaagauggcuguugguacgggauggagauccggccuauuaaugaaaaggaggagaacaugguuaagucccuggugagcgccggaucuggcaaagccgacaauuuuacgauggggguccucugccuggcuauccuuuucgaagaggugaugagaggaaaguucggcaaaaagcauaugauugccggcgcgcuguuuaccuucguucuccugcugagcgggcagaucacauggcgggauauggcucacacccuuauuaugaucggauccaacgccagcgaccgcaugggcaugggggugacauaucuggcccucaucgcuaccuuuaaaauucagcccuuccuggcccucggauuuuuccugagaaaacuuacgucucgggaaaaucugcuccugggcgucgggcuggcuauggccacaacccuucaacugcccgaggauaucgaacagauggcgaacggaauugcccucggccugauggcucucaagcugaucacacaguuugagaccuaccagcuuuggaccgcccuggugucccucauguguagcaauacaauuuucacgcugaccguugcuuggagaacagccacccugauccuugccgugaucucccugcucccugucugccaaucuagcuccaugcgcaaaacagacuggcugccgaugaccguggcugcgaugggcgugcccccucucccccuguuuauuuucucucuuaaggauacgcugaaacggagaagcuggccucugaacgagggggucauggccguuggacucguguccauccuggcuucuagcuuucuucgcaaugacgugcccauggccggcccucuggucgccgggggacuccugauugcuuguuaugugaucacaggcaccuccgccgaucucaccguugaaaaggcggcugacgugacaugggaggaagaggccgaacagaccggggucagccauaaccugaugauuacaguggacgaugacggaacgaugagaaucaaagaugacgagaccgagaacauccuuacaguucugcugaagaccgcccuccugauugugucuggcaucuuccccuacuccauuccggcuacacuucuggucuggcacaccuggcagaaacagacgcaacggagcggcgugcucugggaugucccuucucccccugaaacccagaaggccgagcuggaagaggggguguaccgcaucaagcagcagggaauuuuuggcaaaacacaaguuggggugggaguccauaaggagggcguguuccacaccauguggcacguuacaagaggggcggugcucacccauaauggaaaacggcuggaacccaacugggcuaaugucaagaaagaccuuaucuccuauggcggcggguggaagcugagcgcccaguggcagaagggagaggaagugcaagugauugccguugagccgggcaaaaacccuaagaauuuccagacaaugcccgggaucuuucagacgaccacaggagaaaucggcgcuauugcccuggauuucaaaccugggaccucuggaucccccaucauuaaccgcgagggcaaggucgugggccucuacgggaauggaguggucaccaaaaacggcggguaugugagcggaaucgcucagacaaaugccgagcccgacggcccuacgccggaacuggaggaagagauguuuaagaagagaaaccuuaccauuauggaucugcaccccggguccggcaaaacacggaaguaccucccugcgaucguucgcgaagccaucaaaagacggcugcgcacccucauucuggcucccacaagaguggucgccgcugagauggaggaagcccuuaagggacugccuauccgguaucaaaccacggccacaaaaagcgagcauaccggcagagaaauuguggaccugaugugccacgcuaccuucacaaugcgccuccugucucccguucgggugccuaauuacaaccuuaucgucauggaugaggcgcauuuuaccgacccggccagcauugcugccagaggguauaucuccacacgcgugggaaugggcgaagccgcugccaucuucaugaccgcgacgcccccugggacagcugaugccuuuccccagucuaaugccccuauucaggacgaggagcgggacauccccgaaagaagcuggaacuccggaaaugaguggauuaccgauuucgcuggcaagacaguuugguuugugccgucuaucaaggccgggaacgacauugcgaacugucugcgcaaaaauggcaagaaagucauccagcucagccggaagaccuucgauacggaauaccagaagaccaagcugaacgacugggauuuuguggugacaaccgacauuuccgagaugggagccaauuucaaggcugauagagucaucgacccucgccggugccugaaacccguuauccucacagauggccccgagagagugauucuugccgggccuaugcccgugaccgucgcuucugccgcucagcggcgcggaagagugggccggaacccucagaaggaaaaugaccaguacaucuucacagggcaaccgcugaacaaugaugaggaccacgcccacuggaccgaagcgaaaaugcugcucgacaacauuaauacgcccgagggaaucauuccugcccuguuugaacccgagcgcgaaaagagcgcugccaucgauggcgaauauagacuuaaaggggagucccggaagacauucguugaacugaugagacgcggcgaccucccuguguggcuggcucauaaagucgccagcgagggaaucaaguacaccgaucggaaguggugcuuugacggcgaaagaaacaaucagauucuggaggagaacauggauguggaaaucuggaccaaagagggggaacgcaagaaacuccggcccagauggcuugacgcccgcacauauucugauccgcuggcucugaaggaguucaaagacuuugcggccggacggaaguccauugcucucgaucugguuaccgaaaucggcagagugccuagccaccuugcccaucgcacaagaaaugcccuggacaaccucgucaugcugcacacgucugagcacgggggacgggcuuaccgccaugccguggaggaacugcccgagaccauggaaacacuccuucugcugggccucaugauucugcuuaccggcggggcgaugcuguuccucaucuccggaaagggcaucgggaaaacaagcauuggacugaucugugucguggccuccucuggcaugcuguggauggcugauguuccucuccaguggauugccagcgcuaucgugcuugaguuuuucaugauggugcugcugauucccgagccugaaaagcagagaacaccccaggacaaucagcucgccuaugucguuaucgggauucugacgcuugcggccaucguggcugccaacgagaugggacugcucgaaaccacaaaacgggaucugggcauguccaaggagccgggcguggucagcccuaccucuuaccuggacguggaccuccaccccgcuuccgccuggacacuuuaugcuguugccaccacggugaucacacccaugcugcgccauaccauugaaaauagcacagcgaacgucucucuggccgcuaucgccaaccaggcugugguccucauggggcuggauaaaggauggccuauuagcaagauggaccuuggcgugccgcugcucgcccuggggugcuacucccaaguuaauccccugacccucaccgccgcggugcuucugcuggucacacacuacgcuaucauuggaccuggccuccaggccaaggcuacgagagaggcccagaaacggaccgccgcugggaucaugaagaaccccacaguggauggaaucaugaccauugaccuggauccuguuaucuaugacucuaaauuugagaagcagcuuggccaagugaugcugcucguccugugugccgugcagcugcuccuuaugagaacaagcugggcguucugcgaagcccugacccuggcuacgggccccauuacaacccucugggagggguccccuggaaaauuuuggaauaccacaaucgccgugucuauggcuaacauuuuccgcggcagcuaccuggccggggcgggacuugccuuuuccaucaugaaaagcguuggcaccgggaagcggggaacaggcucucagggcgaaacgcugggggagaaauggaagaaaaagcucaaucagcuguccagaaaagaguucgaucuguauaagaaaagcggaaucaccgaggucgaccgcacagaggcuaaggaaggccucaagagaggggaaauuacccaucacgccgugucccggggaucugcuaaacuucaaugguucguggaacggaacauggucaucccggagggccgcguuauugaucugggguguggaagaggcggcuggagcuacuauugcgccgggcugaagaaagugacagaagugcggggauacaccaagggcgggcccggacacgaggagccuguccccauguccacguauggcuggaauaucgugaaacucaugucugggaaggacgucuuuuaccugccucccgaaaagugugauacccuucugugcgacauuggagagagcuccccgagcccuacaguggaagagucucgcaccaucagaguccucaaaaugguggagcccuggcugaagaacaaucaguucuguauuaaaguucugaaccccuacaugccuacagugaucgaacaucucgagcggcuucagcgcaagcacggcggcaugcuggucagaaauccccugucccggaacagcacccaugaaauguauuggaucucuaaugggacaggaaacauuguguccagcgugaauauggucucucgccuccugcuuaacagauuuaccaugacgcaccggagaccuacaaucgagaaagauguugaccugggcgcugggacccgccacgugaacgccgaaccggagacccccaauauggacgugauuggagagcggaucagacgcauuaaggaggaacauagcuccacauggcacuacgaugacgaaaacccuuauaagacgugggcguaccauggcucuuaugaggucaaagccaccgggagcgcuuccagcaugaucaauggagugguuaagcuccugacaaaacccugggauguggucccuauggugacccagauggccaugacagacaccacacccuucggccaacagcggguuuuuaaggaaaaaguggauaccagaacgccgcgcccuaugcccggcacccggaaggucauggagaucacagcugaguggcuguggagaacccucgggcgcaacaagcggccuagacugugcacacgcgaagaguucauuaaaaaggugcggaccaaugccgccaugggagcgguuuuuacggaagagaaccagugggacuccgcuagagccgccguggaagaugaggaguucuggaaacuugucgaccgcgaaagagagcugcacaagcucggcaaaugugggucuugcguguacaauaugaugggaaagcgggagaagaagcugggcgaguuugggaaggcuaaaggcagccgcgccaucugguauauguggcuuggagcuagauaccuggaguucgaagcccucggcuuucugaacgaggaucauugguucucccgggaaaauucuuacagcggggucgagggagaaggccugcacaagcucggguauauucugagagacaucuccaaaauucccggaggcgcgauguacgccgaugacacagcugggugggacacccggaucacagaggaugaccuucacaacgaggaaaagaucacccaacagauggauccugagcaucgccagcuggccaaugcuauuuuuaaacucacguaucagaacaaggugguuaaggugcaaagacccaccccgaaaggcacagucauggacaucauuucucggaaggaucagcgcggaagcggccagguggggaccuacggacugaauacauucaccaacauggaagcccagcuuaucagacaaauggagggcgaaggggugcuguccaaagcggaccucgagaauccucaccuccuggagaagaaaguuacacaguggcucgaaaccaagggaguggagcggcugaagcgcauggccauuagcggcgaugacugcgucgugaaacccaucgaugacagauucgcuaacgcccuucuggcucucaacgauauggggaagguucggaaagacaucccccaguggcagccuucuaagggcuggcaugauuggcaacaggugccguuuuguucccaccacuuccaugaacugauuaugaaagacggacgcaaacuugucgugcccugcagaccucaggacgagcugaucggccgggcccgcauuagccagggggcuggauggucucucagagaaacggccugucugggcaaggcguaugcccaaaugugggcucugauguacuuucaccggcgcgaucucagacuggccuccaaugccaucugcagcgcuguccccgugcauuggguuccuacaucucggaccaccugguccauucacgcccaucaccaguggaugacaaccgaggacaugcuuacaguguggaacagagucuggaucgaggauaaucccuggauggaagacaaaacgccugugaccacaugggaggauguucccuaucuggggaagcgcgaagaccagugguguggaagccucauuggccugaccucccgggcgacaugggcucaaaacauccuuaccgccauccaacaggugagaagccugauugggaaugaggaguuccucgauuacaugccgucuaugaaacgcuuucggaaggaagaggaaagcgagggcgccaucugguga

SEQ ID NO: 20443 - RNA, 9873 nt, Artificial Sequence
  derived and/or modified CDS sequence (opt5) from DENV-3__GQ199891__SS-prME
accagccugugccucaugaugauccugcccgcggcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagucaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaaggcugugauuuucauccugcuuaugcuggucaccccuucuaugacaaugagaugugugggaguuggcaaccgggacuuuguggaagggcucagcggagccaccugggucgauguggugcuggagcacggcgggugcgucaccacaauggcuaagaauaaacccacgcuggacauugagcuccagaagaccgaagccacacagcuggcgacccuucgcaaacuguguaucgagggaaagauuacaaacaucaccacggauuccagaugcccuacacagggcgaagccguucucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaacuaucgccccggauaccauacacaaaccgcuggcccuuggcaccuugggaagcuggagcucgacuuuaauuauugcgagggaacgacagugguuaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauauggucaaaucccuggugagcgccggaucuggcgaaguugacaacuucaccaugggggugcugugccucgccauucuguuugaggaagucaugcggggaaaguucggcaagaaacauaugaucgcuggcguguucuuuacauucguucuucugcucagcgggcagauuaccuggcgcgauauggcccacacacugaucaugauuggauccaaugcgagcgacagaaugggcaugggggugaccuaccuggcucuuaucgccacguuuaagauccagcccuuccuggcccucggauuuuuccugcggaaacucacaucuagagagaaccugcuucugggcgucgggcucgcuauggccaccacacugcaacugccugaagauauugagcagauggcuaauggaaucgcccuuggccugauggcgcucaagcugauuacccaguuugagaccuaucagcucuggacagcccugaucucccuuacguguagcaacaccauuuucacacugaccguggcuuggcgcacagccacccucauccuggcuggcgugucccugcuuccggucugccaaucuagcuccaugcggaaaacggacuggcugcccaugacaguugccgccaugggggugccuccccucccucuguuuaucuucucucucaaggauacccugaagagacgcagcuggccccuuaaugaaggagugauggcugucggccugguguccauucuggcgucuagccuccugagaaacgacguuccuauggccgggccccuuguggcuggaggccugcucaucgccuguuacgucauuaccgggacauccgccgaucugaccguggagaaagcugccgacguuacaugggaagaggaagcggagcagacgggagugagccauaaccucaugaucaccgucgacgaugacggcacaaugcggauuaaggaugacgagaccgaaaauauccugacagugcuucugaaaaccgcucugcucaucgucucuggcauuuuuccguacuccaucccugccacgcugcuuguguggcacaccuggcagaagcagacacaacgcagcgggguucugugggaugugcccucuccucccgagacccagaaagccgaacucgaggagggagucuauagaauuaagcagcagggcaucuucgggaaaacacaagugggaguuggcgugcagaaggaaggggucuuucauaccauguggcacgugacacggggagcugugcugacguacaacggcaagcgccucgagccgaauugggccuccguuaaaaaggaccugauuagcuauggcgggggauggagacuuucugcgcaguggcaaaaaggcgaagagguccaggugaucgcuguggaaccugggaagaaccccaaaaauuuccagaccaugccuggaacauuccagaccaccacaggcgagauuggggccaucgcccuggauuuuaagcccggaacguccggcagccccaucauuaaccgggagggcaaggucguggggcuguacggaaauggcguugugaccaaaaacgggggauaugucuccggcaucgcucaaacaaaugccgaaccugacgggccgacccccgagcucgaagaggaaauguucaagaaacgcaaccugacaauuauggaucuucacccuggcagcggaaagaccagaaaauaccugcccgcuaucgugcgggaggccauuaagcgcagacuccggacgcugauccucgcgccuacaagaguuguggccgcugagauggaagaggcccugaagggccuucccauccgcuaucagaccaccgcuacaaaaucugaacauaccgggcgggagauugucgaccugaugugccacgccacauuuaccaugagacugcucagcccugugcgcguuccgaauuacaaccugaucauuauggaugaagcccauuucacggaccccgcuuccaucgcggcccggggauacauuucuacaagagugggcaugggggaggcugccgccaucuuuaugaccgcuacaccucccggaaccgccgaugcguucccucagagcaaugcucccauccaggacgaggaacgcgacauuccggagcgguccuggaacucuggcaaugaauggaucacggauuuugccgggaagaccgucugguucgugccuagcauuaaagccggcaacgacaucgcuaacugucuuagaaagaauggcaaaaaggugauucaacugucccgcaagacauuugauaccgaguaucagaaaacaaagcucaacgacugggauuucgucguuaccacagacaucucugagaugggagccaauuuuaaagcggaucgggugauugaccccagacggugccugaagcccgugauccugaccgaugggccugaacgcgucauccucgccggacccaugccugugacggcugccagcgcugcccagagacggggccgcguugggagaaacccgcagaaagagaaugaccaauacauuuucacaggacagccccuuaacaaugaugaagaccacgcucauuggaccgaggccaagaugcugcuggacaacaucaauaccccugaaggcauuauccccgcccucuucgagccugagcgggaaaaguccgccgcuauugauggggaguauagacugaaaggcgaaagccgcaagacauuuguggagcuuaugcggagaggagaccugcccgucuggcucgcccacaaaguggcuucugaaggcaucaaguacaccgaucgcaaauggugcuucgacgggcagcggaacaaucagauccuggaggagaacauggauguugaaauuuggacaaaggagggagagaagaagaagcugagaccgcgcuggcucgacgcccggacguauuccgauccucuugcccugaaagaguuuaaggacuucgcugcgggcagaaaaagcaucgcccuggaucucgugaccgaaauugggcgcguccccacacaccuggcucauagaacccggaaugcccuugacaaccuggugaugcuccacacaucugagcauggaggcaaggccuaccgccacgcugucgaggaacugccugagaccauggaaacgcugcuccuucugggccugaugauccuccugaccgggggagccaugcuuuuucugauuuccggcaaagggaucggaaagacaagcaucggccucauuugugugaucgcguccucugggaugcuguggauggccgagauuccccugcaauggaucgcuagcgccauuguucucgaguucuuuaugauggugcuucugaucccugaacccgagaagcagagaaccccgcaggauaaucaacuggcuuauguggucauuggaauccucacacuggccgcgaucauugccgcuaacgaaaugggccuucuggagaccacgaaacgggaccucggcauguccaaggaaccugggguugugagccccacaucuuaccuggauguggaccugcaccccgccuccgcuuggacccucuacgccgucgcuacaaccgugaucaccccuaugcuucgccauacaauugagaauagcacggccaacguuucucuggcggccaucgcuaaccaggccgugguccugaugggacucgacaaaggcuggccgauuagcaagauggaucugggggugccccuucuggcucucggaugcuauucccaggucaauccucugacccugacagccgccgugcuccuucugaucacccacuacgcgaucauuggccccgggcugcaggcuaaagccacaagagaggcucaaaagcggaccgccgccggaaucaugaagaacccuacgguugacggcauuaugacaaucgaucucgaccccgugauuuaugauucuaaauucgaaaagcagcugggccaggucaugcuucuggugcucugugcuguucagcugcugcucaugagaaccagcugggcccuuugcgaggcgcugacccuggccacagggccuaucaccacacucugggaaggauccccgggcaaauuuuggaauacgaccaucgcugugucuauggccaacauuuuccgcgggagcuaccuggcuggagccggccuugcguuuuccaucaugaaaagcgucgggacaggaaaacggggcaccggcucucaaggggagacacugggagaaaaguggaagaaaaagcucaaucagcuguccagaaaagaguucgaccuguauaagaaaagcggcauuaccgagguggaucgcacggaagccaaggaggggcucaaacggggagaaaucacccaucacgcuguguccagaggcucugccaaacuucagugguuuguugagcggaacauggucauucccgaagggcgcgugaucgaccugggauguggcagaggcggguggagcuacuauugcgcuggacugaagaaagugacagagguccggggcuacaccaaagggggaccuggccaugaggaacccguuccuauguccacauacggguggaauauugugaaacucaugucuggaaaggauguguucuaucugcccccggagaaaugugacacccuucugugcgauaucggcgaaagcuccccuagccccacagucgaggagucucgcaccaucagagugcucaagaugguugaacccuggcugaagaacaaucaguucuguauuaaagugcugaacccuuacaugcccacggucaucgagcaccucgaacggcuucaacgcaagcacggcgggaugcuggugagaaauccucugucccggaacagcacacaugagauguauuggauuucuaauggaaccggcaacaucguugccuccgugaauauggucagccgccuccugcuuaacagauuuaccaugacacaccggagaccgacgauugaaaaagacguggaucugggggcuggaacccgccaugugaacgccgagcccgagacaccuaauauggacgucaucggcgaacggaucaagagaauuaaagaggaacacaacucuaccuggcacuacgacgaugagaaucccuauaagacaugggcguaccaugggagcuaugaaguuaaggccaccggauccgcuucuagcaugaucaacggcguggugaaacuccugacaaagccuugggacgucgugcccaugguuacccagauggccaugacggauaccacaccguucggccagcaacgcguguuuaaagagaaggucgacacccggacaccuagauccaugcccgggacccgccgggugaugggaauuacggcugaguggcuguggagaacacucggccgcaauaaaaagccucggcugugcaccagagaagaguucacaaagaaaguucgcaccaacgccgccaugggggcgguguuuacggaagagaaucagugggauagcgcuaaggccgccgucgaagacgaggauuucuggaaacuuguggaccgggagagagaacugcacaagcucggaaaauguggcuccugcguuuacaacaugauggggaagcgcgagaaaaagcugggcgaauuuggaaaggcuaaaggcucuagagccaucugguacauguggcuuggggcucgguaucuggaguucgaggcccucggauuucugaaugaagaucauugguucagccgcgagaacuccuacucuggcguggaaggggagggacugcacaagcucggcuauauucugagagacaucagcaaaauccccgggggcgcgauguacgccgaugacaccgcuggaugggacacacggauuaccgaagaugaccuucauaaugaggagaagaucacacagcagauggauccugaacacagacaacuggccaacgcuauuuuuaaacucaccuaucagaauaaggucgugaagguccagcggcccacaccgaccggcacggugauggacaucauuucccgcaaagaucagagagggucuggacaaguuggcacauacgggcugaacaccuucaccaauauggaggcccagcuuauccggcagauggaaggagagggcgugcugagcaaggcggaccucgaaaacccucaucugcccgagaaaaagaucacacaguggcuggagaccaaaggggucgaacgccucaagagaauggccauuuccggcgaugacugcguggugaagcccaucgaugaccgguuugcuaacgcccugcuugcucugaaugauaugggaaaaguucgcaaggacauuccucaauggcagccgagcaaaggcuggcaugauuggcaacaggugcccuucuguucucaccauuuccacgagcucaucaugaaggacgggagaaaacuggucgugccuugccggccccaagacgaacuuauuggacgcgccagaaucucccagggcgcuggguggagccugcgggagacagccugucucggaaaggcguaugcccagauguggucucugauguacuuucaccgcagagaucugcggcucgcuuccaacgccauuugcagcgccguuccugugcauuggguccccacgucucgcaccacaugguccauccacgcucaucaccaauggaugaccacagaagacaugcugaccguguggaauagagucuggaucgaggauaacccuuggauggaggacaagacgcccgugaccacaugggaaaauguuccguaccuuggcaaacgggaggaucaguggugugggagccugauuggccucaccuccagagccacaugggcgcagaacaucccuaccgcuauucagcaagugcgcagccugaucggaaaugaagaguuccuugacuauaugcccucuaugaagcgguuuagaaaagaggaagagagcgaaggcgccauuugguga

SEQ ID NO: 20444 - RNA, 9873 nt, Artificial Sequence
  derived and/or modified CDS sequence (opt5) from DENV-3__FJ898443__SS-prME
accagccugugccucaugaugauccugcccgcggcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaaggcugugauuuucauccugcuuaugcuggucaccccuucuaugacaaugagaugugugggaguuggcaaccgggacuuuguggaagggcucagcggagccaccugggucgauguggugcuggagcacggcgggugcgucaccacaauggcuaagaauaaacccacgcuggacauugagcuccagaagaccgaagccacacagcuggcgacccuucgcaaacuguguaucgagggaaagauuacaaacaucaccacggauuccagaugcccuacacagggcgaagccguucucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggacgggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaccagaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcauaccuggacagaacaguacaaauuucaagcggauucccccaagcggcuggccaccgcuauugccggcgcuugggagaauggaguuuguggcaucagaagcacaacccgcauggaaaaccuucucuggaaacagauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccaaaacuccagcuucaucauugauggaccuaauacacccgagugcccgucugcguccagagccuggaacgucugggaaguggaggacuauggcuuuggcguguucaccacgaauaucuggcucaaacugcgcgaagucuacacacagcugugugaccaccggcuuaugagcgcugccguuaaggaugagagagccgugcacgcugacaugggguacuggaucgagucccagaaaaacggaucuuggaagcucgaaaaagccagccugauugaggugaagaccugcaccuggccuaagucccauacacuguggucuaauggcguccucgaaagcgauaugaucauucccaaaucccuggcggggccuaucagccagcacaacuaucgccccggauaccauacccaaacggcuggcccuuggcaccuugggaagcuggagcucgacuuuaauuauugcgagggaacaaccgugguuauuacagaaaacuguggcacccggggccccucucugagaacaaccacgguguccgggaaacugauccacgaguggugcugucgcagcugcacccuuccgccucuccgguacaugggagaagauggcuguugguaugggauggagaucagacccauuucugaaaaggaggagaauauggucaaaucccuggugagcgccggaucuggcaagguugacaacuucacaaugggggugcugugccucgccauccuguuugaagaggucaugcggggaaaguucggcaaaaagcauaugauugcuggcguguucuuuaccuucguucuucugcucagcgggcagaucacauggcgcgauauggcccacacccugauuaugaucggauccaaugcgagcgacagaaugggcaugggggugacguaccuggcucuuauugccacauuuaaaauccagcccuuccuggcccucggauuuuuccugcggaagcucaccucuagagaaaaccugcuucugggcgucgggcucgcuauggccacaacccugcaacugccugaggauaucgaacagauggcuaauggaauugcccuuggccugauggcgcucaaacugaucacccaguuugagacauaucagcucuggacggcccugauuucccuuaccuguagcaacacaaucuucacccugacaguggcuuggcgcaccgccacgcucauucuggcuggcgugucccugcuuccggucugccaaucuagcuccaugcggaagacagacuggcugcccaugaccguugccgccaugggggugccuccccucccucuguuuaucuucucucucaaggauacccugaaaagacgcagcuggccccuuaaugagggagugauggcugucggccugguguccauccuggcgucuagccuccugagaaacgacguuccuauggccgggccccuuguggcuggaggccugcucauugccuguuacgucaucacagggaccuccgccgaucugacaguggaaaaggcugccgacguuacgugggaggaagaggcggaacagaccggagugagccauaaccucaugauuacagucgacgaugacggcaccaugcggaucaaagaugacgagacagagaauauucugaccgugcuucugaagacggcucugcucaucgucucuggcaucuuuccguacuccauuccugccacccugcuuguguggcacacauggcagaaacagacccaacgcagcgggguucugugggaugugcccucuccucccgaaacacagaaggccgagcucgaagagggagucuauagaaucaaacagcagggcauuuucgggaagacccaagugggaguuggcgugcagaaggagggggucuuucauacaauguggcacgugacgcggggagcugugcugaccuacaacggcaaacgccucgaaccgaauugggccuccguuaagaaagaccugaucagcuauggcgggggauggagacuuucugcgcaguggcaaaagggcgaggaaguccaggugauugcuguggagccugggaaaaaccccaagaauuuccagacaaugccuggaaccuuccagaccacaacgggcgaaaucggggccauugcccuggauuuuaagcccggaaccuccggcagccccaucaucaaccgggagggcaaagucguggggcuguacggaaauggcguugugacaaagaacgggggauaugucuccggcauugcucaaaccaaugccgagccugacgggccgacacccgaacucgaggaagagauguucaaaaagcgcaaccugaccaucauggaucuucacccuggcagcggaaaaacgagaaaguaccugcccgcuauugugcgggaagccaucaagcgcagacuccggacacugauucucgcgccuaccagaguuguggccgcugagauggaggaagcccugaaaggccuucccauccgcuaucagaccacagcuaccaagucugagcauacagggcgggaaaucgucgaccugaugugccacgccaccuuuacgaugagacugcucagcccugugcgcguuccgaauuacaaccugauuaucauggaugaggcccauuucacagaccccgcuuccauugcggcccggggauacaucucuaccagagugggcaugggggaagcugccgccauuuuuaugacagcuaccccucccggaacggccgaugcguucccucagagcaaugcucccauccaggacgaggagcgcgacaucccggaacgguccuggaacucuggcaaugaguggauuaccgauuuugccgggaaaacagucugguucgugccuagcaucaaggccggcaacgacauugcuaacugucuucgcaaaaauggaaagaaggugauccaacuguccagaaaaaccuuugauacagaauaucagaagaccaaacucaacgacugggauuucgucguuacaaccgacauuucugagaugggcgccaauuuuaaggcggaucgggugaucgaccccagacggugccugaaacccgugauucugacggaugggccugagcgcgucauccucgccggacccaugccugugacagcugccagcgcugcccagagacggggccgcguugggagaaacccgcagaaggaaaaugaccaauacaucuucaccggacagccccuuaacaaugaugaggaccacgcucauuggaccgaagccaagaugcugcuggacaacauuaauacaccugagggcaucauucccgcccucuucgaaccugagcgggagaaauccgccgcuaucgauggggaauauagacugaagggcgagagccgcaaaaccuuuguggaacuuaugcggagaggagaccugcccgucuggcucgcccacaagguggcuucugagggcauuaaauacacagaucgcaaguggugcuucgacgggcagcggaacaaucagauccuggaagagaacauggauguugagaucuggacgaaagaaggagagaagaagaaacugagaccgcgcuggcucgacgcccggaccuauuccgauccucuugcccugaaggaauuuaaagacuucgcugcgggcagaaagagcauugcccuggaucucgugacagagaucgggcgcguccccacccaccuggcucauagaacacggaaugcccuugacaaccuggugaugcuccacaccucugaacauggaggcaaagccuaccgccacgcugucgaggagcugccugaaacgauggagacccugcuccuucugggccugaugauucuccugacagggggagccaugcuuuuucugaucuccggcaaggggauuggaaagaccagcaucggccucaucugugugauugcguccucugggaugcuguggauggccgaaaucccccugcaauggauugcuagcgccaucguucucgaguucuuuaugauggugcuucugauuccugagcccgaaaaacagagaacaccgcaggauaaucaacuggcuuauguggucaucggcauucucacccuggccgcgaucaucgccgcuaacgagaugggccuucuggaaacgacaaagcgggaccucggcauguccaaagagccugggguugugagccccaccucuuaccuggauguggaccugcaccccgccuccgcuuggacacucuacgccgucgcuaccaccgugauuacaccuaugcuucgccauacgaucgaaaauagcaccgccaacguuucucuggcggccauugcuaaccaggccgugguccugaugggacucgacaagggcuggccgaucagcaaaauggaucugggggugccccuucuggcucucggaugcuauucccaggucaauccucugacacugaccgccgccgugcuccuucugauuacacacuacgcgaucaucggccccgggcugcaggcuaaggccaccagagaggcucaaaagcggacggccgccggaauuaugaaaaacccuacaguugacggcaucaugaccauugaucucgaccccgugaucuaugauucuaaguucgagaaacagcugggccaggucaugcuucuggugcucugugcuguucagcugcugcucaugagaaccagcugggcccuuugcgaagcgcugacacuggccaccgggccuauuacaacgcucugggagggauccccgggcaaguuuuggaauaccacaaucgcugugucuauggccaacaucuuccgcgggagcuaccuggcuggagccggccuugcguuuuccauuaugaaaagcgucgggaccggaaagcggggcacaggcucucaaggggaaacccugggagagaaguggaaaaugaagcucaaucagcuguccagaaaagaguucgaccuguauaagaaaagcggcaucacggagguggaucgcaccgaggccaaggaagggcucaaacggggagagauuacacaucacgcuguguccagaggcucugccaaacuucagugguuuguugaacggaacauggucauccccgaggggcgcgugauugaccugggauguggcagaggcggguggagcuacuauugcgcuggacugaagaaagugaccgaaguccggggcuacacaaaagggggaccuggccaugaggagcccguuccuauguccaccuacggguggaauaucgugaaacucaugucuggaaaggauguguucuaucugcccccggaaaaaugugacacacuucugugcgauauuggcgagagcuccccuagccccaccgucgaagagucucgcacgaucagagugcucaagaugguugagcccuggcugaagaacaaucaguucuguaucaaagugcugaacccuuacaugcccacagucauugaacaccucgagcggcuucaacgcaagcacggcgggaugcuggugagaaauccucugucccggaacagcacccaugaaauguauuggaucucuaauggaaccggcaacauuguugccuccgugaauauggucagccgccuccugcuuaacagauuuacaaugacgcaccggagaccgaccaucgagaaagacguggaucugggggcuggaacacgccaugugaacgccgaacccgagaccccuaauauggacgucauuggcgagcggaucaagagaaucaaagaagaacacaacucuacauggcacuacgacgaugaaaaucccuauaagaccugggcguaccaugggagcuaugagguuaaggccacaggauccgcuucuagcaugauuaacggcguggugaaacuccugaccaagccuugggacgucgugcccaugguuacgcagauggccaugaccgauacaaccccguucggccagcaacgcguguuuaaagaaaaggucgacacacggaccccuagauccaugcccgggacgcgccgggugaugggaaucacagcugaguggcuguggagaacccucggccgcaauaaaaagccucggcugugcacaagagaggaguucaccaagaaaguucgcacgaacgccgccaugggggcgguguuuaccgaggaaaaucagugggauagcgcuaaggccgccgucgaggacgaagauuucuggaaacuuguggaccgggagagagagcugcacaagcucggaaaauguggcuccugcguuuacaacaugauggggaagcgcgagaagaagcugggcgaguuuggaaaggcuaaaggcucuagagccauuugguacauguggcuuggggcucgguaucuggaguucgaggcccucggauuucugaaugaggaucauugguucagccgcgaaaacuccuacucuggcguggagggggaaggacugcacaagcucggcuauauccugagagacauuagcaaaauccccgggggcgcgauguacgccgaugacacagcuggaugggacacccggaucacagaggaugaccuucauaaugaagagaagauuacccagcagauggauccugagcacagacaacuggccaacgcuaucuuuaaacucacauaucagaauaaggucgugaagguccagcggcccaccccgacgggcacagugauggacauuaucucccgcaaagaucagagagggucuggacaaguuggcaccuacgggcugaacaccuucacaaauauggaagcccagcuuauucggcagauggagggagaaggcgugcugagcaaggcggaccucgagaacccucaucugcccgagaagaagaucacccaguggcuggagacaaaaggggucgagcgccucaagagaauggccaucuccggcgaugacugcguggugaagcccauugaugaccgguuugcuaacgcccugcuugcucugaaugauaugggaaaaguucgcaaggacaucccucaauggcagccgagcaaaggcuggcaugauuggcaacaggugcccuucuguucucaccauuuccacgaacucauuaugaaggacgggagaaaacuggucgugccuugccggccccaagacgagcuuaucggacgcgccagaauuucccagggcgcuggguggagccugcgggaaacggccugucucggaaaggcguaugcccagauguggucucugauguacuuucaccgcagagaucugcggcucgcuuccaacgccaucugcagcgccguuccugugcauuggguccccaccucucgcacaaccugguccauucacgcucaucaccaauggaugacaaccgaggacaugcugacgguguggaauagagucuggaucgaagauaacccuuggauggaggacaagacccccgugacaaccugggagaauguuccguaccuuggcaaacgggaagaucaguggugugggagccugaucggccucacauccagagccaccugggcgcagaacauuccuacggcuauccagcaagugcgcagccugauuggaaaugaggaguuccuugacuauaugcccucuaugaagcgguuuagaaaagaggaggaacuggagggcgccaucugguga

SEQ ID NO: 20445 - RNA, 9873 nt, Artificial Sequence
  derived and/or modified CDS sequence (opt5) from DENV-3__FJ898444__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacgagcaaggcaaggcgcauaacgggagacugaucacagcuaaucccguugugaccaaaaaggaagagcccgucaacauugaagccgagccuccguucggagaauccaauaucgugauuggcaucggggauaacgcccugaaaaucaauugguauaagaagggcucuagcauuggaaaaauguuugaggcuacggcccggggcgcuagacgcauggccauccuuggggacacagcgugggauuucggauccgugggcgggguucucaacagccugggaaagaugguccaccagauuuuuggcucugccuacaccgcucuguucuccggggugagcugggugaugaaaaucggcauuggaguccuccugaccuggaucggccuuaauucuaagaacacaagcauguccuuuucuugcauugccaucgggaucauuacccuguaucucggagcugugguucaggccgacaugggcuguguggucaauuggaaagggaaggagcugaagugcggaagcggcaucuucgugacaaacgaaguucauacguggaccgagcaguacaaauuucaagcggauucccccaagcggcuggccacagcuauugccggggcuugggaaaauggcguguguggaaucagaagcaccacacgcauggagaaccuucucuggaaacagauugccaaugaacugaacuauauccugugggagaauaacaucaagcucaccgucgugguuggcgacauuaucggggugcuggagcagggaaaacggacgcuuaccccucagcccauggaacugaaguacucuuggaaaacauggggcaaggccaagauugucaccgcugagacacaaaacuccagcuucaucauugaugggccuaauacccccgaaugcccgucugcguccagagccuggaacgugugggagguggaagacuauggauuuggcgucuucacaaccaauaucuggcucaaacugcgcgagguuuacacgcagcugugugaccaccggcuuaugagcgcugccgugaaggaugagagagccgugcacgcugacaugggcuacuggaucgaaucccagaaaaacgggucuuggaagcucgagaaagccagccugauugaagucaagacaugcaccuggccuaagucccauacccuguggucuaauggagugcucgagagcgauaugaucauucccaaaucccuggcgggcccuaucagccagcacaacuaucgccccggguaccauacacaaaccgcuggaccuuggcaccuuggcaagcuggagcucgacuuuaauuauugcgaagggacgacaguugugauuaccgagaacuguggaacacggggccccucucugagaaccacaaccgucuccggcaaacugauccacgaauggugcugucgcagcugcacgcuuccgccucuccgguacaugggggaggauggauguugguauggcauggaaaucagacccauuucugagaaggaggaaaauauggugaaaucccugguuagcgccgggucuggagagguggacaacuucaccaugggcguccugugccucgccauccuguuugaagaggugaugcgggggaaguucggaaagaaacauaugauugcuggcguuuucuuuacauucgugcuucugcucagcggccagaucaccuggcgcgauauggcccacacacugauuaugaucggguccaaugcgagcgacagaaugggaaugggcgucaccuaccuggcucuuauugccacguuuaagauccagcccuuccuggcccucggguuuuuccugcggaaacucacaucuagagaaaaccugcuucugggagugggccucgcuauggccaccacacugcaacugccugaggauaucgagcagauggcuaaugggauugcccuuggacugauggcgcucaagcugaucacccaguuugaaaccuaucagcucuggacagcccugauuucccuuacguguagcaacaccaucuucacacugaccguggcuuggcgcacagccacccucauucuggcuggcgucucccugcuuccgguuugccaaucuagcuccaugcggaaaacggacuggcugcccaugacaguggccgccaugggcgugccuccccucccucuguuuaucuucucucucaaggauacccugaagagacgcagcuggccccuuaaugagggggucauggcugugggacugguuuccauccuggcgucuagccuccugagaaacgacgugccuauggccggcccccuugucgcugggggacugcucauugccuguuacgugaucaccggcacauccgccgaucugaccguugaaaaagcugccgacgugacaugggaggaagaggcggagcagacgggggucagccauaaccucaugauuaccguggacgaugacggaacaaugcggaucaaggaugacgaaaccgagaauauucugacaguccuucugaaaaccgcucugcucaucgugucuggcaucuuuccguacuccauuccugccacgcugcuuguuuggcacaccuggcagaagcagacacaacgcagcggcgugcugugggauguccccucuccucccgaaacccagaaagccgagcucgaggaagggguguauagaaucaagcagcagggaauuuucggcaaaacacaaguuggggugggaguccagaaggagggcguguuucauaccauguggcacgugacacggggggcuguucugacguacaacggaaagcgccucgaaccgaauugggccuccgucaaaaaggaccugaucagcuauggcggcggguggagacuuucugcgcaguggcaaaaaggagaggaagugcaggugauugcugucgagccuggcaagaaccccaaaaauuuccagaccaugccugggacauuccagaccaccacaggagagaucggcgccauugcccuggauuuuaagcccgggacguccggaagccccaucaucaaccgggaaggcaaggugguuggccuguacgggaauggaguggucaccaaaaacggcggguauguguccggaauugcucaaacaaaugccgagccugacggcccgacccccgaacucgaggaagagauguucaagaaacgcaaccugacaaucauggaucuucacccugggagcggcaagaccagaaaauaccugcccgcuauuguucgggaggccaucaagcgcagacuccggacgcugauucucgcgccuacaagaguggucgccgcugaaauggaggaagcccugaagggacuucccauccgcuaucagaccaccgcuacaaaaucugagcauaccggccgggaaaucguggaccugaugugccacgccacauuuaccaugagacugcucagcccuguucgcgugccgaauuacaaccugauuaucauggaugaggcccauuucacggaccccgcuuccauugcggcccggggguacaucucuacaagagucggaaugggcgaggcugccgccauuuuuaugaccgcuacaccucccgggaccgccgaugcguucccucagagcaaugcucccauccaggacgaagagcgcgacaucccggaacgguccuggaacucuggaaaugaguggauuacggauuuugccggcaagaccgugugguucgugccuagcaucaaagccgggaacgacauugcuaacugucuuagaaagaauggcaaaaaggucauccaacugucccgcaagacauuugauaccgaguaucagaaaacaaagcucaacgacugggauuucguugugaccacagacauuucugaaaugggagccaauuuuaaagcggaucgggugaucgaccccagacggugccugaagcccgucauucugaccgauggcccugagcgcgugauccucgccgggcccaugccuguuacggcugccagcgcugcccagagacggggacgcgugggcagaaacccgcagaaagaaaaugaccaauacaucuucacagggcagccccuuaacaaugaugaggaccacgcucauuggaccgaagccaagaugcugcuggacaacauuaauaccccugagggaaucauucccgcgcucuucgagccugaacgggagaaguccgccgcuaucgauggcgaauauagacugaaaggggagagccgcaagacauuugucgaacuuaugcggagaggcgaccugcccguguggcucgccuacaaaguugcuucugagggaauuaaguauaccgaucgcaaauggugcuucgacggccagcggaacaaucagauccuggaggaaaacauggauguggagaucuggacaaaggaaggggagaaaaagaagcugagaccgcgcuggcucgacgcccggacguacuccgauccucuugcccugaaagaauuuaaggacuucgcugcgggaagaaaaagcauugcccuggaucucgucaccgagaucggccgcgugcccacacaccuggcucacagaacccggaaugcccuugacaaccuggucaugcuccauacaucugagcacgggggaaaggccuaucgccaugcuguggaagagcugccugaaaccauggagacgcugcuccuucugggccugaugauucuccugaccggcggggccaugcuuuuucugaucuccggaaaaggcauugggaagacaagcaucggacucaucuguguuauugcguccucuggcaugcuguggauggccgagaucccccugcaauggauugcuagcgccaucgugcucgaauucuuuaugauggugcuucugauuccugagcccgaaaagcagagaaccccgcaggauaaucaacuggcuuacgucguuaucgggauucucacacuggccgcgaucaucgccgcuaacgagaugggacuucuggaaaccacgaaacgggaccucggcaugucccgcgagccuggcguggugagccccacaucuuaccuggaugucgaccugcaccccgccuccgcuuggacccucuaugccguggcuacaaccguuauuaccccuaugcuuagacacacaaucgagaauagcacggccaacgugucucuggcggccauugcuaaccaggccgucgugcugauggggcucgacaagggauggccgaucagcaaaauggaucugggcgucccccuucuggcucucgggugcuacucccaggugaauccucugacccugacagccgccguucuccuucugauuacccauuaugcgaucaucggacccggccugcaggcuaaggccacacgggaagcucaaaaaagaaccgccgccgggauuaugaagaacccuacgguggacggaaucaugacaauugaucucgaccccgucaucuacgauucuaaguucgagaaacagcugggccaggugaugcuucugguucucugugcugugcagcugcugcucaugcgcaccagcugggcccuuugcgaagcgcugacccuggccacaggcccuauuaccacacucugggagggguccccgggaaaguuuuggaauacgaccaucgcugucucuauggccaacaucuuccggggcagcuaucuggcuggggccggacuugcguuuuccauuaugaaaagcgugggcacagggaagagaggaaccggcucucaaggcgaaacacugggggagaaauggaagaagaaacucaaucagcugucccgcaaggaguucgaccuguacaaaaagagcggaaucaccgaaguggaucggacggaggccaaagaaggccucaagaaaggggagauuacccaccaugcuguuuccagaggaucugccaagcuucagugguuugucgaacggaacauggugauccccgagggccgcgugauugaccugggguguggaagaggcggcuggagcuauuacugcgcugggcugaagaaagucacagagguucggggauacaccaagggcgggccuggacacgaagagcccgugccuauguccacauauggcuggaauaucgugaaacucaugucugggaaggaugucuucuaccugcccccggaaaaaugugacacccuucugugcgauauuggagagagcuccccuagccccacaguggaggaaucucgcaccaucagaguucucaagaugguggagcccuggcugaagaacaaucaguucuguaucaaaguccugaacccuuauaugcccacggugauugaacaucucgagcggcuucaacgcaagcacggcggcaugcugguuagaaauccucugucccggaacagcacacacgaaauguacuggaucucuaaugggaccggaaacauuguggccuccgucaauauggugagccgccuccugcuuaacagauuuaccaugacacaucggagaccgacgaucgagaaagacguggaucugggcgcugggacccgccacgucaacgccgagcccgaaacaccuaauauggacguuauuggagagcggaucaagagaaucaaagaagagcauaacucuaccuggcacuaugacgaugaaaaucccuacaagacaugggcguaucacggcagcuacgaggugaaggccaccggguccgcuucuagcaugauuaacggaguggucaaacuccugacaaagccuugggacgugguucccauggugacccagauggccaugacggauaccacaccguucggccagcaacgcgucuuuaaagagaagguggacacccggacaccuagacccaugccuggcacccgccggguuauggggaucacggcugaauggcuguggagaacacucggacgcaauaaaaagccccggcugugcaccagagaggaauucacaaagaaagugcgcaccaacgccgccaugggcgcggucuuuacggaggaaaaucagugggauuccgcuaaggccgccguggaggacgaggauuucuggaaacuuguugaccgggaaagagagcugcauaagcucgggaaauguggaagcugcguguacaacaugaugggcaagcgcgaaaaaaagcugggggaguuuggcaaggcuaaaggauccagagccauuugguauauguggcuuggcgcucgguaccuggaguucgaagcccucggguuucugaaugaggaucacugguucucucgcgaaaacagcuauuccggagucgagggcgaagggcugcauaagcucggauacauccugagagacauuucuaaaaucccuggcggggcgauguaugccgaugacaccgcuggcugggacacacggaucaccgaggaugaccuucacaaugaggaaaagauuacacagcagauggaucccgagcauagacaacuggccaacgcuaucuuuaaacucaccuaccagaauaagguggucaaggugcagcggccgacaccuaccggaacgguuauggacauuaucagccgcaaagaucagagaggcuccgggcaagugggaacauauggccugaacaccuucaccaauauggaagcccagcuuauucggcagauggagggggaaggaguccugucuaaggcggaccucgagaacccccaccugcccgagaaaaagaucacacaguggcuggaaaccaaaggcguggagcgccucaagagaauggccaucagcggggaugacugcgugguuaagccuauugaugaccgguuugcuaacgcccugcuugcucugaaugauaugggcaaagugcgcaaggacaucccgcaauggcagcccuccaaaggauggcacgauuggcagcaggucccuuucuguagccaucacuuccaugaacucauuaugaaggacggcagaaaacuggugguucccugccggccucaagacgagcuuaucgggcgcgccagaauuucucagggagcuggcuggucccugcgggaaacagccugucucgggaaggcguacgcccagauguggagccugauguacuuucaccgcagagaucugcggcucgcuucuaacgccaucugcuccgccgugcccguccacugggugccuacgagccgcaccacauggucuauucaugcucaccaucaauggaugaccacagaggacaugcugaccgucuggaauagaguguggaucgaggauaaccccuggauggaagacaagacgccgguuaccacaugggagaaugugccuuaucuuggaaaacgggaagaucagugguguggcucccugaucgggcucaccagcagagccacaugggcgcagaacauucccaccgcuauccagcaaguccgcucccugauuggcaaugaggaguuccuugacuacaugccuagcaugaagcgguuuagaaaagaagaggaaucugagggagccaucugguga

SEQ ID NO: 20446 - RNA, 9873 nt, Artificial Sequence
  derived and/or modified CDS sequence (opt5) from DENV-3__FJ898445__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaaggcugugauuuucacccugcuuaugcuggucacaccuucuaugaccaugagaugugugggaguuggcaaccgggacuuuguggaagggcucagcggagccaccugggucgauguggugcuggagcacggcgggugcgucacaacgauggcuaagaauaaacccacccuggacaucgagcuccagaagacagaagccacccaacuggcgacacuucgcaaacuguguauugagggaaagaucaccaacauuacgacagauuccagaugcccuacccagggcgaagccguucucccggaggaacaggaccagaauuauguguguaaacacaccuacguggaucggggcugggggaacggaugcggccuguucgggaagggaagccuugucacaugcgcuaaguuucaaugucuggagcccaucgagggcaaagugguucaguaugaaaaucucaaguacaccgugauuaucacaguccauacgggggaccagcaccaggugggaaacgagacccaaggcguuacagccgaaaucaccccucaggcuucuacaaccgaggccauucugcccgaauauggcacgcuggggcucgagugcuccccucgcaccggacuggacuucaaugagaugauccuucugacaaugaaaaacaaggccuggauggugcauagacagugguuuuucgaucucccccugccguggaccagcggcgcuacaaccgaaacgccuacauggaaucggaaagagcuucuggucaccuuuaagaacgcgcacgccaaaaagcaagaaguggucgugcucgggucucaggagggagcuaugcacacagcccugaccggcgccaccgaaauucagaauuccgggggcacaagcaucuucgcuggacaucugaagugucgccucaaaauggacaagcuggagcuuaaaggcaugucuuacgccaugugcacgaacaccuuuguucugaagaaagagguguccgaaacacagcacgggaccauucucaucaaggucgaguacaagggagaagaugugcccuguaaaaucccuuucagcacagaggacggccaagggaaggcgcauaacggaagacugauuaccgcuaaucccguugugacgaaacgggaggaacccgucaacaucgaggccgaaccuccguucggcgaguccaauauugugaucgggauuggcgauaacgcccugaagaucaauugguauaaaaagggaucuagcaucggcaagauguuugaagcuacagccagaggggcucgccggauggccauucuuggagacaccgcgugggauuucggcuccguggggggaguucucaacagccugggcaaaaugguccaccagaucuuugggucugccuacaccgcucuguucuccggcgugagcugggugaugaagauuggaaucggcguccuccugacauggauugggcuuaauucuaaaaacaccagcauguccuuuucuugcaucgccauuggaaucaucacacuguaucucggcgcugugguucaggccgacauggggugugugauuaauuggaagggaaaagagcugaagugcggcagcgggaucuucgucacgaacgaggugcauaccuggacagaacaguacaaguuucaagcggauucccccaaaagacuggccaccgcuauugccggcgcuugggagaauggaguuuguggcauccgcagcacaacccggauggaaaaccuucucuggaagcagauugccaaugagcugaacuauauccugugggaaaauaacaucaaacucacgguggucgugggggacauuaucggaguucuggagcagggcaagagaacccuuacaccucagcccauggagcugaaauacucuuggaagaccugggggaaagccaagauugugacagcugaaacccaaaacuccagcuucaucauugauggaccuaauacacccgagugcccgucugcgucccgcgccuggaacgucugggaaguggaggacuauggcuuuggcguguucaccacgaauaucuggcucaagcugcgggaagucuacacacagcugugugaccacagacuuaugagcgcugccguuaaagaugagcgcgccgugcacgcugacaugggguacuggauggagucccagaagaacggaucuuggaaacucgaaaaggccagccugaucgaggugaaaaccugcaccuggccuaagucccauacacuguggucuaauggcguccucgaaagcgauaugauuauccccaagucccuggcggggccuauuagccagcacaacuaucggcccggauaccauacccaaacggcuggcccuuggcaccuugggaaacuggagcucgacuuuaauuauugcgagggaacaaccgugguuaucacagaaaacuguggcaccagaggccccucucugcgcacaaccacgguguccgggaagcugauucacgaguggugcugucggagcugcacccuuccgccucucagauacaugggagaagauggcuguugguaugggauggagauccggcccaucucugaaaaagaggagaauauggucaagucccuggugagcgccggaucuggcgaaguugacaacuucacaaugggggugcugugccucgccauucuguuugaggaagucaugcgcggaaaauucggcaagaagcauaugaucgcuggcguguucuuuaccuucguucuucugcucagcgggcagauuacauggagagauauggcccacacccugaucaugauuggauccaaugcgagcgaccggaugggcaugggggugacguaccuggcucuuaucgccacauuuaaaauucagcccuuccuggcccucggauuuuuccugagaaagcucaccucucgcgagaaccugcuucugggcgucgggcucgcuauggccacaacccugcaacugccugaagauaucgagcagauggcuaauggaaucgcccuuggccugauggcgcucaaacugauuacccaguuugagacauaucagcucuggacggcccugaucucccuuaccuguagcaacacaauuuucacccugacaguggcuuggcggaccgccacgcucauccuggcuggcgugucccugcuuccggucugccaaucuagcuccaugagaaagacagacuggcugcccaugaccguugccgccaugggggugccuccccucccucuguuuauuuucucucucaaagauacccugaagcgcagaagcuggccccuuaaugaaggagugauggcugucggccugguguccauccuggcgucuagccuccugcggaacgacguuccuauggccgggccccuuguggcuggaggccugcucaucgccuguuacgucauuacagggaccuccgccgaucugacaguggagaaggcugccgacguuacgugggaagaggaagcggagcagaccggagugagccauaaccucaugaucacagucgacgaugacggcaccaugcgcauuaaagaugacgagacagaaaauauccugaccgugcuucugaagacggcucugcucauugucucuggcaucuuuccguacuccaucccugccacccugcuuguguggcacacauggcagaaacagacccaaagaagcgggguucugugggaugugcccucuccucccgagacacagaaggccgaacucgaggagggagucuaucggauuaaacagcagggcaucuucgggaagacccaagugggaguuggcgugcagaaagaaggggucuuucauacaauguggcacgugacgcgcggagcugugcugaccuacaacggcaagagacucgagccgaauugggccuccguuaagaaagaccugauuagcuauggcgggggauggcggcuuucugcgcaguggcaaaagggcgaagagguccaggugaucgcuguggaaccugggaaaaaccccaagaauuuccagacaaugccuggaaccuuccagaccacaacgggcgagauuggggccaucgcccuggauuuuaaacccggaaccuccggcagccccauuaucaaccgcgagggcaaggucguggggcuguacggaaauggcguugugacaaagaacgggggauaugucuccggcaucgcucaaaccaaugccgaaccugacgggccgacacccgagcucgaagaggaaauguucaaaaagagaaaccugaccauuauggaucuucacccuggcagcggaaaaacgcggaaguaccugcccgcuaucgugcgcgaggccauuaaaagacggcucagaacacugauccucgcgccuacccgcguuguggccgcugagauggaagaggcccugaagggccuucccauucgguaucagaccacagcuaccaagucugaacauacagggagagagaucgucgaccugaugugccacgccaccuuuacgaugcgccugcucagcccugugcggguuccgaauuacaaccugaucauuauggaugaagcccauuucacagaccccgcuuccaucgcggccagaggauacauuucuacccgcgugggcaugggggaggcugccgccaucuuuaugacagcuaccccucccggaacggccgaugcguucccucagagcaaugcucccauucaggacgaggaacgggacaucccggagagauccuggaacucuggcaaugaauggaucaccgauuuugccgggaaaacagucugguucgugccuagcauuaaggccggcaacgacaucgcuaacugucuucgcaaaaauggaaagaaagugauucaacugucccggaagaccuuugauacagaguaucagaagaccaaacucaacgacugggauuucgucguuacaaccgacaucucugagaugggcgccaauuuuaaggcggauagagugauugacccccggcgcugccugaaacccgugauccugacggaugggccugaaagagucauucucgccggacccaugccugugacagcugccagcgcugcccagcggcgcggcagaguugggcggaacccgcagaaggagaaugaccaauacaucuucaccggacagccccuuaacaaugaugaagaccacgcucauuggaccgaggccaaaaugcugcuggacaacaucaauacaccugaaggcauuauccccgcgcucuucgagccugagagagaaaaguccgccgcuauugauggggaguaucgccugaagggcgaaagccggaaaaccuuuguggagcuuaugagacgcggagaccugcccgucuggcucgccuacaagguggcuucugaaggcaucaaauauacagaucggaaguggugcuucgacgggcagagaaacaaucagauucuggaggagaacauggauguugaaaucuggacgaaagagggagaaaagaaaaagcugcgcccgcgguggcucgacgccagaaccuacuccgauccucuugcccugaaggaguuuaaagacuucgcugcgggccgcaagagcaucgcccuggaucucgugacagaaauugggagaguccccacccaccuggcucaccggacacgcaaugcccuugacaaccuggugaugcuccauaccucugagcacggaggcaaagccuauagacaugcugucgaggaacugccugagacgauggaaacccugcuccuucugggccugaugauccuccugacagggggagccaugcuuuuucugauuuccggcaaggggaucggaaaaaccagcauuggccucaucugugugaucgcguccucugggaugcuguggauggccgagauuccccugcaauggaucgcuagcgccauuguucucgaguucuuuaugauggugcuucugaucccugaacccgagaagcagcggacaccgcaggauaaucaacuggcuuacguggucauuggaauccucacccuggccgcgauuaucgccgcuaacgaaaugggcaugcuugagacgacaaagcgcgaccugggcauguccaaagaaccugggguugccagccccaccucuuaccucgauguggaccugcaccccgcuuccgccuggacacuguaugcuguggccaccaccgucaucacaccuaugcucagacacacgauugagaauagcaccgcgaacgugucucuugccgcuaucgccaaccaggcuguugugcugaugggacuggacaagggcuggccgauuagcaaaauggaucucggggucccccugcuugcccugggaugcuacucccaggugaauccucucacacugaccgccgcgguccugcuccuuaucacacauuaugcuauuaucggccccgggcugcaggccaaggcuacccgggaggcccaaaaaagaacggccgcuggaaucaugaagaacccuacaguggacggcauuaugaccaucgaucuggaccccguuauuuacgauucuaaguucgaaaaacagcucggccaggugaugcugcuuguccugugugccgugcagcuccugcugaugcgcaccagcugggcgcucugcgaggcccuuacacuggcuaccgggccuaucacaacgcugugggaaggauccccgggcaaguuuuggaauaccacaauugccguuucuauggcuaacaucuuccgggggagcuaucucgccggagcgggccuggccuuuuccaucaugaaaagcguggggaccggaaagagaggcacaggcucucaaggggagacccuuggagaaaaauggaagaagaaacugaaucagcucucccgcaaggaguucgaccuguacaaaaagagcggcauuacggaggucgaucggaccgaagcuaaagaggggcugaagagaggagaaaucacacaccaugccgugucccggggcucugcuaaacuccagugguuuguggagcgcaacaugguuauucccgaagggagagucaucgaccuuggauguggccggggcggguggagcuauuacugcgccggacugaagaaggugaccgaggugcgcggcuacacaaaagggggaccuggccacgaggaacccgucccuauguccaccuauggguggaauauuguuaagcugaugucuggaaaagauguguucuaccuccccccggagaagugugacacacugcuuugcgauaucggcgaaagcuccccuagccccaccguggaggagucuagaacgauucggguccugaaaaugguggaacccuggcucaagaacaaucaguucuguaucaagguucugaacccuuauaugcccacagugaucgagcaucuggaacgccuccaaagaaaacacggcgggaugcuuguccggaauccucugucccgcaacagcacccacgagauguacuggauuucuaauggaaccggcaacaucguggcuuccguuaauauggugagcagacugcuccugaaccgguuuacaaugacgcauagacgcccgaccauugaaaaggacgucgaucuuggggccggaacacggcacgugaacgcggagcccgagaccccuaauauggacgugaucggcgaaagaauuaaacgcaucaaggaggaacauaacucuacauggcacuaugacgaugagaaucccuacaaaaccugggccuaucacgggagcuacgaagucaaggcuacaggauccgccucuagcaugaucaacggcguugugaagcugcucaccaaaccuugggacgugguccccauggugauucagauggcuaugacggauaccacaccguucggccagcaacggguuuuuaaggagaaaguggacaccagaacaccucgcuccaugcccgggacccggagagucaugggaaucacggccgaguggcuguggcgcacacugggccggaauaagaaaccuagacucugcacccgcgaagaguucacacggaaggugagaaccaacgccgcgaugggggcuguuuuuacggaagagaaucagugggauagcgccaaggccgcuguggaagacgaggauuucuggaaacuggucgaccgcgagagagaacuucauaagcugggaaaauguggcuccugcguguacaacaugauggggaagcgggagaaaaagcucggcgaauuuggaaaagccaagggcucucgcgcuauuugguauauguggcugggggccagauaccuugaguucgaggcgcugggauuucucaaugaagaucacugguucagccgggagaacuccuauucuggcguugaaggggagggacugcauaagcugggcuacauccucagagacauuagcaaaauccccgggggcgccauguaugcugaugacaccgccggaugggacacacggaucaccgaagaugaccugcacaaugaggagaagauuacacagcagauggauccugaacaucgccaacuugcuaacgccaucuuuaaacugaccuaccagaauaagguggucaaagugcagagacccacaccgaccggcacggucauggacauuaucucccggaaggaucagcgcgggucuggacaagugggcacauaugggcucaacaccuucaccaauauggaggcgcagcugauuagacagauggaaggagagggcguucuuagcaaggccgaccuggaaaacccucaccuccccgagaaaaagaucacacaguggcuggagaccaaagggguggaacggcugaagcgcauggcuaucuccggcgaugacugcgucgugaaacccauugaugacagauuugccaacgcucuccuggcccuuaaugauaugggaaaggugcggaaggacaucccucaauggcagccgagcaaaggcuggcacgauuggcagcagguucccuucuguucucaucacuuccaugagcugauuaugaaggacgggcgcaaacucguggucccuugcagaccccaagacgaacugaucggacgggcucgcauuucccagggcgccggguggagccuuagagagacagcgugucugggaaaggccuacgcucagauguggucucucauguacuuucaccggcgcgaucugagacuggccuccaacgccaucugcagcgcugugccuguucacugggugcccacgucucggaccacaugguccauucaugcccaccaucaauggaugaccacagaagacaugcucaccgucuggaauagaguguggaucgaggauaacccuuggauggaggacaaaacgcccgucaccacaugggaaaaugugccguaucugggcaagcgcgaggaucaguggugugggagccuuaucggccugaccucccgggcgacaugggcucagaacauuccuaccgccauccagcaaguuagaagccucauuggaaaugaagaguuccuggacuacaugcccucuaugaagcgcuuucggaaagaggaagagagcgaaggcgccaucugguga

SEQ ID NO: 20447 - RNA, 9873 nt, Artificial Sequence
  derived and/or modified CDS sequence (opt5) from DENV-3__GQ868571__SS-prME
accagccucugccucaugaugauccugcccgcggcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagucaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaaggcugugauuuucauccugcuuaugcuggucaccccuucuaugacaaugagaugugugggaguuggcaaccgggacuuuguggaagggcucagcggagccaccugggucgauguggugcuggagcacggcgggugcgucaccacaauggcuaagaauaaacccacgcuggacauugagcuccagaagaccgaagccacacagcuggcgacccuucgcaaacuguguaucgagggaaagauuacaaacaucaccacggauuccagaugcccuacacagggcgaagccguucucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaacuaucgccccggauaccauacacaaaccgcuggcccuuggcaccuugggaagcuggagcucgacuuuaauuauugcgagggaacgacagugguuaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauauggucaaaucccuggugagcgccggaucuggcgaaguugacaacuucaccaugggggugcugugccucgccauucuguuugaggaagucaugcggggaaaguucggcaagaaacauaugaucgcuggcguguucuuuacauucguucuucugcucagcgggcagauuaccuggcgcgauauggcccacacacugaucaugauuggauccaaugcgagcgacagaaugggcaugggggugaccuaccuggcucuuaucgccacguuuaagauccagcccuuccuggcccucggauuuuuccugcggaaacucacaucuagagagaaccugcuucugggcgucgggcucgcuauggccaccacacugcaacugccugaagauauugagcagauggcuaauggaaucgcccuuggccugauggcgcucaagcugauuacccaguuugagaccuaucagcucuggacagcccugaucucccuuacguguagcaacaccauuuucacacugaccguggcuuggcgcacagccacccucauccuggcuggcgugucccugcuuccggucugccaaucuagcuccaugcggaaaacggacuggcugcccaugacaguugccgccaugggggugccuccccucccucuguuuaucuucucucucaaggauacccugaagagacgcagcuggccccuuaaugaaggagugauggcugucggccugguguccauucuggcgucuagccuccugagaaacgacguuccuauggccgggccccuuguggcuggaggccugcucaucgccuguuacgucauuaccgggacauccgccgaucugaccguggagaaagcugccgacguuacaugggaagaggaagcggagcagacgggagugagccauaaccucaugaucaccgucgacgaugacggcacaaugcggauuaaggaugacgagaccgaaaauauccugacagugcuucugaaaaccgcucugcucaucgucucuggcauuuuuccguacuccaucccugccacgcugcuuguguggcacaccuggcagaagcagacacaacgcagcgggguucugugggaugugcccucuccucccgagacccagaaagccgaacucgaggagggagucuauagaauuaagcagcagggcaucuucgggaaaacacaagugggaguuggcgugcagaaggaaggggucuuucauaccauguggcacgugacacggggagcugugcugacguacaacggcaagcgccucgagccgaauugggccuccguuaaaaaggaccugauuagcuauggcgggggauggagacuuucugcgcaguggcaaaaaggcgaagagguccaggugaucgcuguggaaccugggaagaaccccaaaaauuuccagaccaugccuggaacauuccagaccaccacaggcgagauuggggccaucgcccuggauuuuaagcccggaacguccggcagccccaucauuaaccgggagggcaaggucguggggcuguacggaaauggcguugugaccaaaaacgggggauaugucuccggcaucgcucaaacaaaugccgaaccugacgggccgacccccgagcucgaagaggaaauguucaagaaacgcaaccugacaauuauggaucuucacccuggcagcggaaagaccagaaaauaccugcccgcuaucgugcgggaggccauuaagcgcagacuccggacgcugauccucgcgccuacaagaguuguggccgcugagauggaagaggcccugaagggccuucccauccgcuaucagaccaccgcuacaaaaucugaacauaccgggcgggagauugucgaccugaugugccacgccacauuuaccaugagacugcucagcccugugcgcguuccgaauuacaaccugaucauuauggaugaagcccauuucacggaccccgcuuccaucgcggcccggggauacauuucuacaagagugggcaugggggaggcugccgccaucuuuaugaccgcuacaccucccggaaccgccgaugcguucccucagagcaaugcucccauccaggacgaggaacgcgacauuccggagcgguccuggaacucuggcaaugaauggaucacggauuuugccgggaagaccgucugguucgugccuagcauuaaagccggcaacgacaucgcuaacugucuuagaaagaauggcaaaaaggugauucaacugucccgcaagacauuugauaccgaguaucagaaaacaaagcucaacgacugggauuucgucguuaccacagacaucucugagaugggagccaauuuuaaagcggaucgggugauugaccccagacggugccugaagcccgugauccugaccgaugggccugaacgcgucauccucgccggacccaugccugugacggcugccagcgcugcccagagacggggccgcguugggagaaacccgcagaaagagaaugaccaauacauuuucacaggacagccccuuaacaaugaugaagaccacgcucauuggaccgaggccaagaugcugcuggacaacaucaauaccccugaaggcauuauccccgcccucuucgagccugagcgggaaaaguccgccgcuauugauggggaguauagacugaaaggcgaaagccgcaagacauuuguggagcuuaugcggagaggagaccugcccgucuggcucgcccacaaaguggcuucugaaggcaucaaguacaccgaucgcaaauggugcuucgacgggcagcggaacaaucagauccuggaggagaacauggauguugaaauuuggacaaaggagggagagaagaagaagcugagaccgcgcuggcucgacgcccggacguauuccgauccucuugcccugaaagaguuuaaggacuucgcugcgggcagaaaaagcaucgcccuggaucucgugaccgaaauugggcgcguccccacacaccuggcucauagaacccggaaugcccuugacaaccuggugaugcuccacacaucugagcauggaggcaaggccuaccgccacgcugucgaggaacugccugagaccauggaaacgcugcuccuucugggccugaugauccuccugaccgggggagccaugcuuuuucugauuuccggcaaagggaucggaaagacaagcaucggccucauuugugugaucgcguccucugggaugcuguggauggccgagauuccccugcaauggaucgcuagcgccauuguucucgaguucuuuaugauggugcuucugaucccugaacccgagaagcagagaaccccgcaggauaaucaacuggcuuauguggucauuggaauccucacacuggccgcgaucauugccgcuaacgaaaugggcaugcuugagaccacgaaacgggaccugggcauguccaaggaaccugggguugugagccccacaucuuaccucgauguggaccugcaccccgccuccgcuuggacccuguacgccgucgcuacaaccgugaucaccccuaugcuccgccauacaauugagaauagcacggccaacguuucucuugcggccaucgcuaaccaggccgugguccugaugggacuggacaaaggcuggccgauuagcaagauggaucucggggugccccugcuugcucugggaugcuauucccaggucaauccucucacccugacagccgccgugcugcuccuuaucacccacuacgcgaucauuggccccgggcugcaggcuaaagccacaagagaggcucaaaagcggaccgccgccggaaucaugaagaacccuacgguugacggcauuaugacaaucgaucuggaccccgugauuuaugauucuaaauucgaaaagcagcucggccaggucaugcugcuugugcugugugcuguucagcuccugcugaugagaaccagcugggcccucugcgaggcgcuuacccuggccacagggccuaucaccacacugugggaaggauccccgggcaaauuuuggaauacgaccaucgcugugucuauggccaacauuuuccgcgggagcuaccucgcuggagccggccuggcguuuuccaucaugaaaagcgucgggacaggaaaacggggcaccggcucucaaggggagacacuuggagaaaaguggaagaaaaagcugaaucagcucuccagaaaagaguucgaccuguauaagaaaagcggcauuaccgagguggaucgcacggaagccaaggaggggcugaaacggggagaaaucacccaucacgcuguguccagaggcucugccaagcuccagugguuuguugagcggaacauggucauucccgaagggcgcgugaucgaccuuggauguggcagaggcggguggagcuacuauugcgcuggacugaagaaagugacagagguccggggcuacaccaaagggggaccuggccaugaggaacccguuccuauguccacauacggguggaauauugugaaacugaugucuggaaaggauguguucuaucugcccccggagaaaugugacacccugcuuugcgauaucggcgaaagcuccccuagccccacagucgaggagucucgcaccaucagagugcugaagaugguugaacccuggcucaagaacaaucaguucuguauuaaagugcugaacccuuacaugcccacggucaucgagcaccuggaacggcuccaacgcaagcacggcgggaugcuugugagaaauccucugucccggaacagcacacaugagauguauuggauuucuaauggaaccggcaacaucguugccuccgugaauauggucagccgccugcuccugaacagauuuaccaugacacaccggagaccgacgauugaaaaagacguggaucuuggggcuggaacccgccaugugaacgccgagcccgagacaccuaauauggacgucaucggcgaacggaucaagagaauuaaagaggaacacaacucuaccuggcacuacgacgaugagaaucccuauaagacaugggcguaccaugggagcuaugaaguuaaggccaccggauccgcuucuagcaugaucaacggcguggugaaacugcucacaaagccuugggacgucgugcccaugguuacccagauggccaugacggauaccacaccguucggccagcaacgcguguuuaaagagaaggucgacacccggacaccuagauccaugcccgggacccgccgggugaugggaauuacggcugaguggcuguggagaacacugggccgcaauaaaaagccucggcucugcaccagagaagaguucacaaagaaaguucgcaccaacgccgccaugggggcgguguuuacggaagagaaucagugggauagcgcuaaggccgccgucgaagacgaggauuucuggaaacugguggaccgggagagagaacuucacaagcugggaaaauguggcuccugcguuuacaacaugauggggaagcgcgagaaaaagcucggcgaauuuggaaaggcuaaaggcucuagagccaucugguacauguggcugggggcucgguaucuugaguucgaggcccugggauuucucaaugaagaucauugguucagccgcgagaacuccuacucuggcguggaaggggagggacugcacaagcugggcuauauucucagagacaucagcaaaauccccgggggcgcgauguacgccgaugacaccgcuggaugggacacacggauuaccgaagaugaccugcauaaugaggagaagaucacacagcagauggauccugaacacagacaacuugccaacgcuauuuuuaaacugaccuaucagaauaaggucgugaagguccagcggcccacaccgaccggcacggugauggacaucauuucccgcaaagaucagagagggucuggacaaguuggcacauacgggcucaacaccuucaccaauauggaggcccagcugauccggcagauggaaggagagggcgugcuuagcaaggcggaccuggaaaacccucaccuccccgagaaaaagaucacacaguggcuggagaccaaaggggucgaacgccugaagagaauggccauuuccggcgaugacugcguggugaagcccaucgaugaccgguuugcuaacgcccuccuggcucuuaaugauaugggaaaaguucgcaaggacauuccucaauggcagccgagcaaaggcuggcaugauuggcaacaggugcccuucuguucucaccauuuccacgagcugaucaugaaggacgggagaaaacucgucgugccuugccggccccaagacgaacugauuggacgcgccagaaucucccagggcgcuggguggagccuucgggagacagccugucugggaaaggcguaugcccagauguggucucucauguacuuucaccgcagagaucugcggcuggcuuccaacgccauuugcagcgccguuccugugcauuggguccccacgucucgcaccacaugguccauccacgcucaucaccaauggaugaccacagaagacaugcucaccguguggaauagagucuggaucgaggauaacccuuggauggaggacaagacgcccgugaccacaugggaaaauguuccguaccugggcaaacgggaggaucaguggugugggagccuuauuggccugaccuccagagccacaugggcgcagaacaucccuaccgcuauucagcaagugcgcagccucaucggaaaugaagaguuccuggacuauaugcccucuaugaagcgguuuagaaaagaggaagagagcgaaggcgccauuugguga

SEQ ID NO: 20448 - RNA, 9873 nt, Artificial Sequence
  derived and/or modified CDS sequence (opt5) from DENV-3__GU131951__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauguccaagaauaaacccacgcuggacauugagcuccagaagaccgaagccacacaacuggcuacccuucgcaaacuguguaucgagggaaagauuacaaacaucaccacggauagcagaugcccuacacagggcgaagccgugcucccggaggaacaggaccagaauuauguguguaaacacaccuacgucgaucggggcugggggaacggaugcggccuguucgggaagggaucucuugugaccugcgcgaaguuucaaugucuggagcccauugagggcaaaguugugcaguaugaaaaucucaaguacacagucaucaucaccgugcauacaggggaccagcaccagguuggaaacgagacgcaaggcgugaccgccgaaauuacaccucaggcuuccaccacagaggccauccugcccgaauauggcacccuggggcucgagugcagcccucgcacgggacuggacuucaaugagaugauucuucugaccaugaaaaacaaggcuuggaugguccauagacagugguuuuucgaucucccccugccguggacaucuggcgccaccacagaaaccccuacguggaaucggaaagagcuucuggugacauuuaagaacgcccacgcuaaaaagcaagaagucgugguucucgggucccaggagggagcgaugcacaccgcccugacaggcgcuaccgaaauccagaauagcgggggcaccucuauuuucgccggacaucugaagugucgccucaaaauggacaagcuggagcuuaaaggcauguccuacgccaugugcacaaacacguuugugcugaagaaagaggucagcgaaacccagcacgggacaauccucaucaagguggaguacaagggagaagauguucccuguaaaauuccuuucuccaccgaggacggccaagggaaggcucauaacggaagacugaucacagccaaucccguggucaccaaaaaggaggaacccgugaacauugaggcggaaccuccguucggcgagucuaauaucgugauugggaucggcgauaacgcucugaaaaucaauugguauaagaagggaagcuccauuggcaaaauguuugaagccacggccagaggggcuagacgcauggccauccuuggagacacagcuugggauuucggcagcguugggggaguccucaacucucugggcaagauggugcaccagauuuuuggguccgccuacaccgcgcuguucagcggcgugucuugggucaugaaaaucggaauuggcgugcuccugaccuggaucgggcuuaauagcaagaacacauccaugucuuuuagcugcauugccaucggaaucauuacccuguaucucggcgcuguugugcaggccgacauggggugugucaucaauuggaaaggaaaggagcugaagugcggcuccgggauuuucgugacaaacgagguucauacguggaccgaacaguacaaauuucaagcugauagccccaagcggcuggccacagcgaucgccggcgcuugggagaauggaguguguggcauuagaucuaccacacgcauggaaaaccuucucuggaaacagaucgccaaugagcugaacuauauccugugggaaaauaacauuaagcucaccgucgugguuggggacaucauuggagugcuggagcagggcaaacggacgcuuaccccucagcccauggagcugaaguacuccuggaaaacaugggggaaggcuaagaucgucaccgccgaaacacaaaacagcucuuucauuaucgauggaccuaauacccccgagugcccguccgccagcagagcuuggaacgugugggaaguggaggacuauggcuuuggcgucuucacaaccaauaucuggcucaaacugcgcgaaguuuacacgcagcugugugaccaccggcuuauguccgcggccgugaaggaugagagagcugugcacgccgacaugggguacuggauugagucucagaaaaacggaagcuggaagcucgaaaaagccucccugaucgaggucaagacaugcaccuggccuaagucucauacccuguggagcaauggcgugcucgaauccgauaugauuauccccaaaagccuggcugggccuauuucucagcacaacuaucgccccggauaccauacacaaaccgccggcccuuggcaccuugggaagcuggagcucgacuuuaauuauugcgagggaacgacaguugugaucaccgaaaacuguggcacacggggccccucccugagaaccacaaccgucagcgggaaacugauccacgaguggugcugucgcucuugcacgcuuccgccucuccgguacaugggagaagauggcuguugguaugggauggagauuagacccaucuccgaaaaggaggagaauauggugaaaagccugguuucugcgggaagcggcgaaguggacaacuucaccauggggguccugugccucgcuauucuguuugaggaagugaugcggggaaaguucggcaagaaacauaugaucgccggcguuuucuuuacauucgugcuucugcucuccgggcagauuaccuggcgcgauauggcccacacacugaucaugauuggaagcaaugcuucugacagaaugggcaugggggucaccuaccuggcccuuaucgcgacguuuaagauccagcccuuccuggcucucggauuuuuccugcggaaacucacauccagagagaaccugcuucugggcguggggcucgccauggccaccacacugcaacugccugaagauauugagcagauggcuaauggaaucgcccuuggccugauggcucucaagcugauuacccaguuugagaccuaucagcucuggacagcccugaucagccuuacguguuccaacaccauuuucacacugaccguggcguggcgcacagccacccucauccuggcuggcgucucucugcuuccgguuugccaaagcuccucuaugcggaaaacggacuggcugcccaugacaguggccgcuaugggggugccuccccucccucuguuuaucuucagccucaaggauacccugaagagacgcuccuggccccuuaaugaaggagucauggccgugggccugguuucuauucuggccagcucccuccugagaaacgacgugccuauggcugggccccuugucgcgggaggccugcucaucgccuguuacgugauuaccgggacaagcgcugaucugaccguugagaaagccgccgacgugacaugggaagaggaagcugagcagacgggagucucucauaaccucaugaucaccguggacgaugacggcacaaugcggauuaaggaugacgagaccgaaaauauccugacaguccuucugaaaaccgcccugcucaucguguccggcauuuuuccguacagcaucccugcgacgcugcuuguuuggcacaccuggcagaagcagacacaacgcucuggggugcugugggauguccccuccccucccgaggcucagaaagccgaacucgaggagggaguguauagaauuaagcagcagggcaucuucgggaaaacccaaguuggagugggcguccagaaggaagggguguuucauacaauguggcacgugacccggggagccguucugacauacaacggcaagcgccucgagccgaauugggcuagcgucaaaaaggaccugauuucuuauggcgggggauggagacuuuccgcccaguggcaaaaaggcgaagagguccaggugaucgcggucgaaccugggaagaaccccaaaaauuuccagacgaugccuggaaccuuccagacaaccaccggcgagauuggggcuaucgcccuggauuuuaagcccggaacaagcggcucccccaucauuaaccgggagggcaaggugguugggcuguacggaaauggcguggucacgaaaaacgggggauaugugagcggcaucgcccaaaccaaugcugaaccugacgggccgacacccgagcucgaagaggaaauguucaagaaacgcaaccugaccauuauggaucuucacccuggcucuggaaagacaagaaaauaccugcccgccaucguucgggaggcuauuaagcgcagacuccggacccugauccucgccccuacgagaguggucgcggccgagauggaagaggcucugaagggccuucccauccgcuaucagacaaccgccaccaaaagcgaacauacagggcgggagauuguggaccugaugugccacgcuaccuuuacaaugagacugcucuccccuguucgcgugccgaauuacaaccugaucauuauggaugaagcccauuucaccgaccccgccucuaucgcugcgcggggauacauuagcacgagagucggcaugggggaggccgcugccaucuuuaugacagccaccccucccggaacagcugaugccuucccucaguccaaugcgcccauccaggacgaggaacgcgacauuccggagcggucuuggaacagcggcaaugaauggaucaccgauuuugcugggaagacggugugguucgugccuuccauuaaagccggcaacgacaucgccaacugucuuagaaagaauggcaaaaaggucauucaacugucucgcaagaccuuugauacagaguaucagaaaaccaagcucaacgacugggauuucguugugacaaccgacaucagcgagaugggagcuaauuuuaaagccgaucgggugauugaccccagacggugccugaagcccgucauccugacagaugggccugaacgcgugauccucgcgggacccaugccuguuaccgccgcuuccgccgcucagagacggggccgcguggggagaaacccgcagaaagagaaugaccaauacauuuucacgggacagccccuuaacaaugaugaagaccacgcccauuggacagaggcuaagaugcugcuggacaacaucaauaccccugaaggcauuauccccgcccucuucgagccugagcgggaaaagagcgcggccauugauggggaguauagacugaaaggcgaaucucgcaagaccuuugucgagcuuaugcggagaggagaccugcccguguggcucgcucacaaaguugccuccgaaggcaucaaguacacagaucgcaaauggugcuucgacgggcagcggaacaaucagauccuggaggagaacauggauguggaaauuuggaccaaggagggagagaagaagaagcugagaccgcgcuggcucgacgcucggacauauagcgauccucuugcccugaaagaguuuaaggacuucgccgcuggcagaaaaucuaucgcgcuggaucucgucacggaaauugggcgcgugcccucccaccuggcccauagaacccggaaugcucuugacaaccuggucaugcuccacacaagcgagcauggaggcaaggccuaccgccacgccguggaggaacugccugagaccauggaaacacugcuccuucugggccugaugauccuccugaccgggggagcuaugcuuuuucugauuuccggcaaagggaucggaaagacgucuaucggccucauuuguguuaucgccagcuccgggaugcuguggauggcggagauuccccugcaauggaucgccagcgcuauugugcucgaguucuuuaugauggugcuucugaucccugaacccgagaagcagagaaccccgcaggauaaucaacuggccuaugucguuauuggaauccucacacuggcugccaucauugcggccaacgaaaugggccuucuggagaccacaaaacgggaccucggcaugucuaaggaaccugggguggugucccccaccagcuaccuggaugucgaccugcaccccgcuucugccuggacgcucuacgcuguggccacaaccguuaucacaccuaugcuucgccauaccauugagaauagcaccgcuaacgugucccuggccgcgaucgccaaccaggcugucgugcugaugggacucgacaaaggcuggccgauuucuaagauggaucugggggucccccuucuggcccucggaugcuauagccaggugaauccucugacacugacggcugccguucuccuucugaucacccacuacgccaucauuggccccgggcugcaggcgaaagcuacaagagaggcccaaaagcggaccgcugccggaaucaugaagaacccuacaguggacggcauuaugaccaucgaucucgaccccgucauuuaugauuccaaauucgaaaagcagcugggccaggugaugcuucugguucucugugccgugcagcugcugcucaugagaacgucuugggcucuuugcgaggcccugacacuggcgaccgggccuaucaccacacucugggaaggaagcccgggcaaauuuuggaauaccacaaucgccgucuccauggcuaacauuuuccgcgggagcuaccuggccggagcuggccuugccuuuucuaucaugaaguccguggggacgggaaaacggggcaccggcagccaaggggagacacugggagaaaaguggaagaaaaagcucaaucagcuguccagaaaagaguucgaccuguauaagaaaucuggcauuaccgagguggaucgcacagaagcgaaggaggggcucaaacggggagaaaucacccaucacgccguuagcagaggcuccgcuaaacuucagugguuugucgagcggaacauggugacgcccgaagggcgcgugauugaccugggauguggcagaggcggguggucuuacuauugcgccggacugaagaaagucaccgagguucggggcuacacaaaagggggaccuggccaugaggaacccgugccuaugagcaccuacggguggaauaucgugaaacucauguccggaaaggaugucuucuaucugcccccggagaaaugugacacacuucugugcgauauuggcgaaagcucuccuucccccaucguggaggagagccgcaccaucagaguucucaagaugguggaacccuggcugaagaacaaucaguucuguauuaaaguccugaacccuuacaugcccacagugaucgagcaccucgaacggcuucaacgcaagcacggcgggaugcugguuagaaauccucugucucggaacuccacccaugagauguauuggauuagcaauggaacgggcaacaucguggcuucugucaauauggugagccgccuccugcuuaacagauuuacaaugacccaccggagaccgaccauugaaaaagacguggaucugggggccggaacacgccaugucaacgcugagcccgagacgccuaauauggacguuaucggcgaacggaucaagagaauuaaagaggaacacaacuccaccuggcacuacgacgaugagaaucccuauaagacaugggccuaccaugggucuuaugaagugaaggcgaccggaagcgccuccagcaugaucaacggcguggucaaacuccugacaaagccuugggacgugguucccauggugacccagauggcuaugacagauaccacgccguucggccagcaacgcgucuuuaaagagaagguggacacccggacaccuagauccaugcccgggacccgccggguuaugggaauuacagccgaguggcuguggagaacccucggccgcaauaaaaagccucggcugugcacgagagaagaguucacaaagaaagugcgcaccaacgcugccaugggggccgucuuuacagaagagaaucagugggauucugcgaaggcugccguggaagacgaggauuucuggaaacuuguugaccgggagagagaacugcacaagcucggaaaauguggcagcugcguguacaacaugauggggaagcgcgagaaaaagcugggcgaauuuggaaaggccaaaggcuccagagcuaucugguacauguggcuuggggcccgguaucuggaguucgaggcucucggauuucugaaugaagaucauugguucucucgcgagaacagcuacuccggcgucgaaggggagggacugcacaagcucggcuauauucugagagacaucucuaaaauccccgggggcgccauguacgcggaugacaccgccggaugggacacgcggauuaccgaagaugaccuucauaaugaggagaagaucacacagcagauggauccugaacacagacaacuggcuaacgccauuuuuaaacucaccuaucagaauaagguggucaaggugcagcggcccacaccgaccggcacaguuauggacaucauuagccgcaaagaucagagaggguccggacaagugggcaccuacgggcugaacacguucacaaauauggaggcucagcuuauccggcagauggaaggagagggcguccugagcaaggccgaccucgaaaacccucaucugcccgagaaaaagaucacccaguggcuggagaccaaagggguggaacgccucaagagaauggcgauuucuggcgaugacugcgugguuaagcccaucgaugaccgguuugccaacgcucugcuugcccugaaugauaugggaaaagugcgcaaggacauuccucaauggcagccguccaaaggcuggcaugauuggcagcagguccccuucuguagccaccauuuccacgagcucaucaugaaggacgggagaaaacuggugguuccuugccggccccaagacgaacuuauuggacgcgcuagaaucucucagggcgccggguggucccugcgggagacagcuugucucggaaaggccuaugcgcagauguggagccugauguacuuucaccgcagagaucugcggcucgccucuaacgcuauuugcuccgccgugccuguccauugggugcccaccagccgcacaacgugguccauccacgcccaucaccaauggaugaccacagaagacaugcugaccgucuggaauagaguguggaucgaggauaacccuuggauggaggacaagacacccguuaccacgugggaaaaugugccguaccuuggcaaacgggaggaucaguggugugggagccugauuggccucaccucuagagcuacaugggcccagaacaucccuaccgcgauucagcaaguccgcagccugaucggaaaugaagaguuccuugacuauaugcccuccaugaagcgguuuagaaaagaggaagagucugaaggcgcuauuugguga

SEQ ID NO: 20449 - RNA, 9873 nt, Artificial Sequence
  derived and/or modified CDS sequence (opt5) from DENV-3__GQ868572__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggcggcaggucgaaaaaguugagacaugggcccuccgccaccccggcuucaccauccuggcgcuuuuucuggcccauuacaucgggacgucccucacacagaaggcugugauuuucauccugcuuaugcuggucaccccuucuaugacaaugagaugugugggaguuggcaaccgggacuuuguggaagggcucagcggagccaccugggucgauguggugcuggagcacggcgggugcgucaccacaauggcuaagaauaaacccacgcuggacauugagcuccagaagaccgaagccacacaacuggcgacccuucgcaaacuguguaucgagggaaagauuacaaacaucaccacggauuccagaugcccuacacagggcgaagccguucucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaagguucauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccacacaccuggcccauagaacccggaaugcucuugacaaccuggucaugcuccacacaucugagcauggaggcaaggccuaccgccacgccguggaggaacugccugagaccauggaaacgcugcuccuucugggccugaugauccuccugaccgggggagcuaugcuuuuucugauuuccggcaaagggaucggaaagacaagcaucggccucauuuguguuaucgccuccucugggaugcuguggauggcggagauuccccugcaauggaucgccagcgcuauugugcucgaguucuuuaugauggugcuucugaucccugaacccgagaagcagagaaccccgcaggauaaucaacuggccuaugucguuauuggaauccucacacuggcugccaucauugcggccaacgaaaugggccuucuggagaccacgaaacgggaccucggcauguccaaggaaccugggguggugagccccacaucuuaccuggaugucgaccugcaccccgcuuccgccuggacccucuacgcuguggccacaaccguuaucaccccuaugcuucgccauacaauugagaauagcacggcuaacgugucucuggccgcgaucgccaaccaggcugucgugcugaugggacucgacaaaggcuggccgauuagcaagauggaucugggggucccccuucuggcccucggaugcuauucccaggugaauccucugacccugacagcugccguucuccuucugaucacccacuacgccaucauuggccccgggcugcaggcgaaagcuacaagagaggcccaaaagcggaccgcugccggaaucaugaagaacccuacgguggacggcauuaugacaaucgaucucgaccccgucauuuaugauucuaaauucgaaaagcagcugggccaggugaugcuucugguucucugugccgugcagcugcugcucaugagaaccagcugggcucuuugcgaggcccugacccuggcgacagggccuaucaccacacucugggaaggauccccgggcaaauuuuggaauacgaccaucgccgucucuauggcuaacauuuuccgcgggagcuaccuggccggagcuggccuugccuuuuccaucaugaaaagcguggggacaggaaaacggggcaccggcucucaaggggagacacugggagaaaaguggaagaaaaagcucaaucagcuguccagaaaagaguucgaccuguauaagaaaagcggcauuaccgagguggaucgcacggaagcgaaggaggggcucaaacggggagaaaucacccaucacgccguuuccagaggcucugcuaaacuucagugguuugucgagcggaacauggugauucccgaagggcgcgugaucgaccugggauguggcagaggcggguggagcuacuauugcgccggacugaagaaagucacagagguucggggcuacaccaaagggggaccuggccaugaggaacccgugccuauguccacauacggguggaauauugugaaacucaugucuggaaaggaugucuucuaucugcccccggagaaaugugacacccuucugugcgauaucggcgaaagcuccccuagccccacaguggaggagucucgcaccaucagaguucucaagaugguggaacccuggcugaagaacaaucaguucuguauuaaaguccugaacccuuacaugcccacggugaucgagcaccucgaacggcuucaacgcaagcacggcgggaugcugguuagaaauccucugucccggaacagcacacaugagauguauuggauuucuaauggaaccggcaacaucguggcuuccgucaauauggugagccgccuccugcuuaacagauuuaccaugacacaccggagaccgacgauugaaaaagacguggaucugggggccggaacccgccaugucaacgcugagcccgagacaccuaauauggacguuaucggcgaacggaucaagagaauuaaagaggaacacaacucuaccuggcacuacgacgaugagaaucccuauaagacaugggccuaccaugggagcuaugaagugaaggcgaccggauccgccucuagcaugaucaacggcguggucaaacuccugacaaagccuugggacgugguucccauggugacccagauggcuaugacggauaccacaccguucggccagcaacgcgucuuuaaagagaagguggacacccggacaccuagauccaugcccgggacccgccggguuaugggaauuacggccgaguggcuguggagaacacucggccgcaauaaaaagccucggcugugcaccagagaagaguucacaaagaaagugcgcaccaacgcugccaugggggccgucuuuacggaagagaaucagugggauagcgcgaaggcugccguggaagacgaggauuucuggaaacuuguugaccgggagagagaacugcacaagcucggaaaauguggcuccugcguguacaacaugauggggaagcgcgagaaaaagcugggcgaauuuggaaaggccaaaggcucuagagcuaucugguacauguggcuuggggcccgguaucuggaguucgaggcucucggauuucugaaugaagaucauugguucagccgcgagaacuccuacucuggcgucgaaggggagggacugcacaagcucggcuauauucugagagacaucagcaaaauccccgggggcgccauguacgcggaugacaccgccggaugggacacacggauuaccgaagaugaccuucauaaugaggagaagaucacacagcagauggauccugaacacagacaacuggcuaacgccauuuuuaaacucaccuaucagaauaagguggucaaggugcagcggcccacaccgaccggcacgguuauggacaucauuucccgcaaagaucagagagggucuggacaagugggcacauacgggcugaacaccuucaccaauauggaggcucagcuuauccggcagauggaaggagagggcguccugagcaaggccgaccucgaaaacccucaucugcccgagaaaaagaucacacaguggcuggagaccaaagggguggaacgccucaagagaauggcgauuuccggcgaugacugcgugguuaagcccaucgaugaccgguuugccaacgcucugcuugcccugaaugauaugggaaaagugcgcaaggacauuccucaauggcagccgagcaaaggcuggcaugauuggcagcagguccccuucuguucucaccauuuccacgagcucaucaugaaggacgggagaaaacuggugguuccuugccggccccaagacgaacuuauuggacgcgcuagaaucucccagggcgccggguggagccugcgggagacagcuugucucggaaaggccuaugcgcagauguggucucugauguacuuucaccgcagagaucugcggcucgccuccaacgcuauuugcagcgccgugccuguccauugggugcccacgucucgcaccacaugguccauccacgcccaucaccaauggaugaccacagaagacaugcugaccgucuggaauagaguguggaucgaggauaacccuuggauggaggacaagacgcccguuaccacaugggaaaaugugccguaccuuggcaaacgggaggaucaguggugugggagccugauuggccucaccuccagagcuacaugggcccagaacaucccuaccgcgauucagcaaguccgcagccugaucggaaaugaagaguuccuugacuauaugcccucuaugaagcgguuuagaaaagaggaagagagcgaaggcgcuauuugguga

SEQ ID NO: 20450 - RNA, 9873 nt, Artificial Sequence
  derived and/or modified CDS sequence (opt5) from DENV-3__GQ868573__SS-prME
accagcuucugccugaugaugauccuccccgccgcucuggccuuucaccuuacaucccgggacggcgaaccucggaugauuguggggaagaacgaacgcggaaagucucugcuguucaagacggcgagcggcaucaauauguguacccugauugcuauggaucuuggggaaaugugcgacgauacagucaccuacaaguguccgcacaucacagaaguugagcccgaagacauugauugcugguguaaccugaccuccacaugggugaccuauggaacgugcaaucaggccggcgagcaccggcgggacaagcgcucuguggcccucgcuccucaugucgggaugggacuggauaccagaacacagaccuggaugagcgccgagggcgcuuggagacagguggaaaagguugagacaugggcccugcgccaccccggcuuuaccauccucgcgcuguuccuugcccauuacaucgggacgucccugacacagaaggcugugauuuuuauccuccugaugcuugucaccccuucuaugacaaugagaugugugggaguuggcaaccgggacuucguggaagggcugagcggagccaccugggucgauguggugcucgagcacggcgggugcgucaccacaauggcuaagaauaaacccacgcuggacauugagcugcagaagaccgaagccacacaacucgcgacccugcgcaaacuuuguaucgagggaaagauuacaaacaucaccacggauuccagaugcccuacacagggcgaagccguucugccggaggaacaggaccagaauuauguguguaaacacaccuacguggaucggggcugggggaacggaugcggccucuuugggaagggaagccuggugaccugcgcuaaguuccaaugucuugagcccauugagggcaaagugguucaguaugaaaaucugaaguacacagugaucaucaccguccauacaggggaccagcaccaggugggaaacgagacgcaaggcguuaccgccgaaauuacaccucaggcuucuaccacagaggccauccuccccgaauauggcacccuggggcuggagugcuccccucgcacgggacucgacuuuaaugagaugauucugcuuaccaugaaaaacaaggccuggauggugcauagacagugguucuuugaucugccccucccguggacaagcggcgcuaccacagaaaccccuacguggaaucggaaagagcugcuugucacauucaagaacgcgcacgccaaaaagcaagaaguggucgugcuggggucucaggagggagcuaugcacaccgcccucacaggcgccaccgaaauccaaaauuccgggggcaccagcauuuuugcuggacaucugaagugucgccugaaaauggacaagcucgagcugaaaggcaugucuuacgccaugugcacaaacacguucguucuuaagaaagagguguccgaaacccagcacgggacaauccugaucaaggucgaguacaagggagaagaugugcccuguaaaauuccuuucagcaccgaggacggccaagggaaggcgcauaacggaagacucaucacagcuaaucccguugugaccaaaaaggaggaacccgucaacauugaggccgaaccuccguuuggcgaguccaauaucgugauugggaucggcgauaacgcccugaaaaucaauugguauaagaagggaucuagcauuggcaaaauguucgaagcuacggccagaggggcuagacgcauggccauccugggagacacagcgugggauuuuggcuccgucgggggaguucuuaacagccucggcaagaugguccaccagauuuucgggucugccuacaccgcucuguuuuccggcgugagcugggugaugaaaaucggaauuggcguccugcucaccuggaucgggcucaauucuaagaacacaagcauguccuucucuugcauugccaucggaaucauuacccuuuaucugggcgcugugguucaggccgacauggggugugugaucaauuggaaaggaaaggagcucaagugcggcagcgggauuuuugucacaaacgaggugcauacguggaccgaacaguacaaauuccaagcggauucccccaagcggcuggccacagcuaucgccggcgcuugggagaauggaguuuguggcauuagaagcaccacacgcauggaaaaccugcuuuggaaacagaucgccaaugagcucaacuauauccugugggaaaauaacauuaagcugaccguggucgugggggacaucauuggaguucucgagcagggcaaacggacgcugaccccucagcccauggagcuuaaguacucuuggaaaacaugggggaaggccaagaucgugaccgcugaaacacaaaacuccagcuuuauuaucgauggaccuaauacccccgagugcccgucugcguccagagccuggaacgucugggaaguggaggacuauggcuucggcguguuuacaaccaauaucuggcugaaacuccgcgaagucuacacgcagcugugugaccaccggcugaugagcgcugccguuaaggaugagagagccgugcacgcugacaugggguacuggauugagucccagaaaaacggaucuuggaaacuugaaaaagccagccucaucgaggugaagacaugcaccuggccuaagucccauacccuguggucuaauggcguccuggaaagcgauaugauuauccccaaaucccucgcggggccuauuagccagcacaacuaucgccccggauaccauacacaaaccgcuggcccuuggcaccuggggaaacuugagcuggacuucaauuauugcgagggaacgacagugguuaucaccgaaaacuguggcacacggggccccucucucagaaccacaaccguguccgggaaacugauccacgaguggugcugucgcagcugcacgcugccgccucuucgguacaugggagaagauggcuguugguaugggauggagauuagacccaucucugaaaaggaggagaauauggucaaaucccucgugagcgccggaucuggcgaaguugacaacuuuaccaugggggugcugugccuggccauucucuucgaggaagucaugcggggaaaguucggcaagaaacauaugaucgcuggcguguuuuucacauuuguucugcuucugagcgggcagauuaccuggcgcgauauggcccacacacucaucaugauuggauccaaugcgagcgacagaaugggcaugggggugaccuaccuggcucugaucgccacguucaagauccagcccuuucuugcccugggauucuuucuccggaaacugacaucuagagagaaccuccugcuuggcgucgggcuggcuauggccaccacacuccaacugccugaagauauugagcagauggcuaauggaaucgcccugggccuuauggcgcugaagcucauuacccaguucgagaccuaucagcuguggacagcccucaucucccugacguguagcaacaccauuuuuacacuuaccguggcuuggcgcacagccacccugauccucgcuggcgugucccugcugccggucugccaaucuagcuccaugcggaaaacggacuggcuucccaugacaguugccgccauggggcugccuccccucccucuguucaucuuuucucucaaggauacccugaagagacgcagcuggccccuuaaugaaggagugauggcugugggccuggucuccauucuggcgucuagccuccugagaaacgacgugccuauggccgggccccuuguugcuggaggccugcucaucgccuguuacgugauuaccgggacauccgccgaucugaccgucgagaaagcugccgacgugacaugggaagaggaagcggagcagacgggaguuagccauaaccucaugaucaccguggacgaugacggcacaaugcggauuaaggaugacgagaccgaaaauauccugacaguccuucugaaaaccgcucugcucaucgugucuggcauuuucccguacuccaucccugccacgcugcuugucuggcacaccuggcagaagcagacacaacgcagcggggugcugugggauguucccucuccucccgagacccagaaagccgaacucgaggagggaguguauagaauuaagcagcagggcaucuuugggaaaacacaagucggagugggcguucagaaggaagggguguuccauaccauguggcacgucacacggggagcugugcugacguacaacggcaagcgccucgagccgaauugggccuccgugaaaaaggaccugauuagcuauggcgggggauggagacuuucugcgcaguggcaaaaaggcgaagagguucaggucaucgcuguggaaccugggaagaaccccaaaaauuuccagaccaugccuggaacauuucagaccaccacaggcgagauuggggccaucgcccuggauuucaagcccggaacguccggcagccccaucauuaaccgggagggcaagguggucgggcuguacggaaauggcgugguuaccaaaaacgggggauauguguccggcaucgcucaaacaaaugccgaaccugacgggccgacccccgagcucgaagaggaaauguuuaagaaacgcaaccugacaauuauggaucuucacccuggcagcggaaagaccagaaaauaccugcccgcuaucguccgggaggccauuaagcgcagacuccggacgcugauccucgcgccuacaagagugguugccgcugagauggaagaggcccugaagggccuucccauccgcuaucagaccaccgcuacaaaaucugaacauaccgggcgggagauuguggaccugaugugccacgccacauucaccaugagacugcucagcccuguccgcgugccgaauuacaaccugaucauuauggaugaagcccauuuuacggaccccgcuuccaucgcggcccggggauacauuucuacaagaguuggcaugggggaggcugccgccaucuucaugaccgcuacaccucccggaaccgccgaugcguuuccucagagcaaugcucccauccaggacgaggaacgcgacauuccggagcgguccuggaacucuggcaaugaauggaucacggauuucgccgggaagaccgugugguuugucccuagcauuaaagccggcaacgacaucgcuaacugucuuagaaagaauggaaagaaggugauucaacugucccgcaagacauucgauaccgaguaucagaaaacaaagcucaacgacugggauuuuguggucaccacagacaucucugagaugggcgccaauuucaaagcggaucggguuauugaccccagacggugccugaagcccgugauccugaccgaugggccugaacgcgugauccucgccggacccaugccugucacggcugccagcgcugcccagagacggggccgcguggggagaaacccgcagaaagagaaugaccaauacauuuucacaggacagccccuuaacaaugaugaagaccacgcucauuggaccgaggccaagaugcugcuggacaacaucaauaccccugaaggcauuauccccgcgcucuuugagccugagcgggaaaaguccgccgcuauugauggggaguauagacugaaaggcgaaagccgcaagacauucguugagcuuaugcggagaggagaccugcccguguggcucgcccacaaagucgcuucugaaggcaucaaguacaccgaucgcaaauggugcuuugacgggcagcggaacaaucagauccuggaggagaacauggauguggaaauuuggacaaaggagggagagaagaagaagcugagaccgcgcuggcucgacgcccggacguauuccgauccucuugcccugaaagaguucaaggacuuugcugcgggcagaaaaagcaucgcccuggaucucguuaccgaaauugggcgcgugcccacacaccuggcucauagaacccggaaugcccuugacaaccuggucaugcuccacacaucugagcauggaggcaaggccuaccgccacgcuguggaggaacugccugagaccauggaaacgcugcuccuucugggccugaugauccuccugaccgggggagccaugcuuuuccugauuuccggcaaagggaucggaaagacaagcaucggccucauuugugucaucgcguccucugggaugcuguggauggccgagauuccccugcaauggaucgcuagcgccauugugcucgaguuuuucaugaugguucuucugaucccugaacccgagaagcagagaaccccgcaggauaaucaacuggcuuauguggugauuggaauccucacacuggccgcgaucauugccgcuaacgaaaugggccuucuggagaccacgaaacgggaccucggcauguccaaggaaccuggggucguuagccccacaucuuaccuggauguggaccugcaccccgccuccgcuuggacccucuacgccguggcuacaaccgucaucaccccuaugcuucgccauacaauugagaauagcacggccaacgugucucuggcggccaucgcuaaccaggccguugugcugaugggacucgacaaaggcuggccgauuagcaagauggaucugggggucccccuucuggcucucggaugcuauucccaggugaauccucugacccugacagccgccguccuccuucugaucacccacuacgcgaucauuggccccgggcugcaggcuaaagccacaagagaggcucaaaagcggaccgccgccggaaucaugaagaacccuacgguggacggcauuaugacaaucgaucucgaccccguuauuuaugauucuaaauuugaaaagcagcugggccaggugaugcuucugguccucugugcugugcagcugcugcucaugagaaccagcugggcccuuugcgaggcgcugacccuggccacagggccuaucaccacacucugggaaggauccccgggcaaauucuggaauacgaccaucgcuguuucuauggccaacauuuuucgcgggagcuaccuggcuggagccggccuugcguucuccaucaugaaaagcguggggacaggaaaacggggcaccggcucucaaggggagacacugggagaaaaguggaagaaaaagcucaaucagcuguccagaaaagaguuugaccuguauaagaaaagcggcauuaccgaggucgaucgcacggaagccaaggaggggcucaaacggggagaaaucacccaucacgcuguguccagaggcucugccaaacuucagugguucguggagcggaacaugguuauucccgaagggcgcgucaucgaccugggauguggcagaggcggguggagcuacuauugcgcuggacugaagaaagugacagaggugcggggcuacaccaaagggggaccuggccaugaggaacccgucccuauguccacauacggguggaauauuguuaaacucaugucuggaaaggauguguucuaucugcccccggagaaaugugacacccuucugugcgauaucggcgaaagcuccccuagccccacaguggaggagucucgcaccaucagaguccucaagaugguggaacccuggcugaagaacaaucaguuuuguauuaaaguucugaacccuuacaugcccacggugaucgagcaccucgaacggcuucaacgcaagcacggcgggaugcuggucagaaauccucugucccggaacagcacacaugagauguauuggauuucuaauggaaccggcaacaucguggccuccguuaauauggugagccgccuccugcuuaacagauucaccaugacacaccggagaccgacgauugaaaaagacgucgaucugggggcuggaacccgccaugugaacgccgagcccgagacaccuaauauggacgugaucggcgaacggaucaagagaauuaaagaggaacacaacucuaccuggcacuacgacgaugagaaucccuauaagacaugggcguaccaugggagcuaugaagucaaggccaccggauccgcuucuagcaugaucaacggcguugugaaacuccugacaaagccuugggacgugguccccauggugacccagauggccaugacggauaccacaccguuuggccagcaacgcguuuucaaagagaagguggacacccggacaccuagauccaugcccgggacccgccgggucaugggaauuacggcugaguggcuguggagaacacucggccgcaauaaaaagccucggcugugcaccagagaagaguuuacaaagaaagugcgcaccaacgccgccaugggggcgguuuucacggaagagaaucagugggauagcgcuaaggccgccguggaagacgaggauuuuuggaaacuugucgaccgggagagagaacugcacaagcucggaaaauguggcuccugcguguacaacaugauggggaagcgcgagaaaaagcugggcgaguucggaaaggcuaaaggcucuagagccaucugguacauguggcuuggggcucgguaucuggaguuugaggcccucggauuccugaaugaagaucauugguuuagccgcgagaacuccuacucuggcguugaaggggagggacugcacaagcucggcuauauucugagagacaucagcaaaauccccgggggcgcgauguacgccgaugacaccgcuggaugggacacacggauuaccgaagaugaccuucauaaugaggagaagaucacacagcagauggauccugaacacagacaacuggccaacgcuauuuucaaacucaccuaucagaauaagguggucaaggugcagcggcccacaccgaccggcacggucauggacaucauuucccgcaaagaucagagagggucuggacaagugggcacauacgggcugaacaccuuuaccaauauggaggcccagcuuauccggcagauggaaggagagggcguucugagcaaggcggaccucgaaaacccucaucugcccgagaaaaagaucacacaguggcuggagaccaaagggguggaacgccucaagagaauggccauuuccggcgaugacugcgucgugaagcccaucgaugaccgguucgcuaacgcccugcuugcucugaaugauaugggaaaagugcgcaaggacauuccucaauggcagccgagcaaaggcuggcaugauuggcagcagguucccuucuguucucaccauuuucacgagcucaucaugaaggacgggagaaaacugguggucccuugccggccccaagacgaacuuauuggacgcgccagaaucucccagggcgcuggguggagccugcgggagacagccugucucggaaaggcguaugcccagauguggucucugauguacuuccaccgcagagaucugcggcucgcuuccaacgccauuugcagcgccgugccuguucauugggugcccacgucucgcaccacaugguccauccacgcucaucaccaauggaugaccacagaagacaugcugaccgucuggaauagaguguggaucgaggauaacccuuggauggaggacaagacgcccgucaccacaugggaaaaugugccguaccuuggcaaacgggaggaucaguggugugggagccugauuggccucaccuccagagccacaugggcgcagaacaucccuaccgcuauucagcaaguucgcagccugaucggaaaugaagaguuucuugacuauaugcccucuaugaagcgguucagaaaagaggaagagagcgaaggcgccauuugguga

SEQ ID NO: 20451 - RNA, 9873 nt, Artificial Sequence
  derived and/or modified CDS sequence (opt5) from DENV-3__GQ868574__SS-prME
accagccucugccucaugaugauccugcccgcggcucuugccuuccaccugacaucccgggacggcgaaccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaaggcugugauuuucauccugcuuaugcuggucaccccuucuaugacaaugagaugugugggaguuggcaaccgggacuuuguggaagggcucagcggagccaccugggucgauguggugcuggagcacggcgggugcgucaccacaauggcuaagaauaaacccacgcuggacauugagcuccagaagaccgaagccacacaacuggcgacccuucgcaaacuguguaucgagggaaagauuacaaacaucaccacggauuccagaugcccuacacagggcgaagccguucucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaacuaucgccccggauaccauacacaaaccgcuggcccuuggcaccuugggaagcuggagcucgacuuuucuuauugcgagggaacgacagugguuaucaccgaaaauuguggcacacggggccccucccugagaaccacaaccgugagcgggaaacugauccacgaguggugcugucgcucuugcacgcuuccgccucuccgguacaugggagaagauggcuguugguaugggauggagauuagacccaucuccgaaaaggaggagaacauggucaaaagccuggugucugccggaagcggcgaaguugacaauuucaccaugggggugcugugccucgccauucuguuugaggaagucaugcggggaaaguucggcaagaaacauaugaucgcuggcguguucuuuacauucguucuucugcucuccgggcagauuaccuggcgcgauauggcccacacacugaucaugauuggaagcaacgcgucugacagaaugggcaugggggugaccuaccuggcucuuaucgccacguuuaagauccagcccuuccuggcccucggauuuuuccugcggaaacucacauccagagagaaucugcuucugggcgucgggcucgcuauggccaccacacugcaacugccugaagauauugagcagauggcuaacggaaucgcccuuggccugauggcgcucaagcugauuacccaguuugagaccuaucagcucuggacagcccugaucagccuuacguguuccaauaccauuuucacacugaccguggcuuggcgcacagccacccucauccuggcuggcgugucucugcuuccggucugccaaagcuccucuaugcggaaaacggacuggcugcccaugacaguugccgccaugggggugccuccccucccucuguuuaucuucagccucaaggauacccugaagagacgcuccuggccccuuaacgaaggagugauggcugucggccuggugucuauucuggcgagcucccuccugagaaaugacguuccuauggccgggccccuuguggcuggaggccugcucaucgccuguuacgucauuaccgggacaagcgccgaucugaccguggagaaagcugccgacguuacaugggaagaggaagcggagcagacgggagugucucauaaccucaugaucaccgucgacgaugacggcacaaugcggauuaaggaugacgagaccgaaaacauccugacagugcuucugaaaaccgcucugcucaucgucuccggcauuuuuccguacagcaucccugccacgcugcuuguguggcacaccuggcagaagcagacacaacgcucugggguucugugggaugugcccuccccucccgagacccagaaagccgaacucgaggagggagucuauagaauuaagcagcagggcaucuucgggaaaacacaagugggaguuggcgugcagaaggaaggggucuuucauaccauguggcacgugacacggggagcugugcugacguacaauggcaagcgccucgagccgaacugggccagcguuaaaaaggaccugauuucuuauggcgggggauggagacuuuccgcgcaguggcaaaaaggcgaagagguccaggugaucgcuguggaaccugggaagaaucccaaaaacuuccagaccaugccuggaacauuccagaccaccacaggcgagauuggggccaucgcccuggauuuuaagcccggaacgagcggcucccccaucauuaaucgggagggcaaggucguggggcuguacggaaacggcguugugaccaaaaaugggggauaugucagcggcaucgcucaaacaaacgccgaaccugacgggccgacccccgagcucgaagaggaaauguucaagaaacgcaaucugacaauuauggaucuucacccuggcucuggaaagaccagaaaauaccugcccgcuaucgugcgggaggccauuaagcgcagacuccggacgcugauccucgcgccuacaagaguuguggccgcugagauggaagaggcccugaagggccuucccauccgcuaucagaccaccgcuacaaaaagcgaacauaccgggcgggagauugucgaccugaugugccacgccacauuuaccaugagacugcucuccccugugcgcguuccgaacuacaaucugaucauuauggaugaagcccauuucacggaccccgcuucuaucgcggcccggggauacauuagcacaagagugggcaugggggaggcugccgccaucuuuaugaccgcuacaccucccggaaccgccgaugcguucccucaguccaacgcucccauccaggacgaggaacgcgacauuccggagcggucuuggaauagcggcaacgaauggaucacggauuuugccgggaagaccgucugguucgugccuuccauuaaagccggcaaugacaucgcuaacugucuuagaaagaacggcaaaaaggugauucaacugucucgcaagacauuugauaccgaguaucagaaaacaaagcucaaugacugggauuucgucguuaccacagacaucagcgagaugggagccaacuuuaaagcggaucgggugauugaccccagacggugccugaagcccgugauccugaccgaugggccugaacgcgucauccucgccggacccaugccugugacggcugccuccgcugcccagagacggggccgcguugggagaaauccgcagaaagagaacgaccaauacauuuucacaggacagccccuuaauaacgaugaagaccacgcucauuggaccgaggccaagaugcugcuggacaauaucaacaccccugaaggcauuauccccgcccucuucgagccugagcgggaaaagagcgccgcuauugauggggaguauagacugaaaggcgaaucucgcaagacauuuguggagcuuaugcggagaggagaccugcccgucuggcucgcccacaaaguggcuuccgaaggcaucaaguacaccgaucgcaaauggugcuucgacgggcagcggaauaaccagauccuggaggagaauauggauguugaaauuuggacaaaggagggagagaagaagaagcugagaccgcgcuggcucgacgcccggacguauagcgauccucuugcccugaaagaguuuaaggacuucgcugcgggcagaaaaucuaucgcccuggaucucgugaccgaaauugggcgcguccccacacaccuggcucauagaacccggaacgcccuugacaaucuggugaugcuccacacauccgagcauggaggcaaggccuaccgccacgcugucgaggaacugccugagaccauggaaacgcugcuccuucugggccugaugauccuccugaccgggggagccaugcuuuuucugauuagcggcaaagggaucggaaagacauccaucggccucauuugugugaucgcgucuagcgggaugcuguggauggccgagauuccccugcaauggaucgcuuccgccauuguucucgaguucuuuaugauggugcuucugaucccugaacccgagaagcagagaaccccgcaggauaaccaacuggcuuauguggucauuggaauccucacacuggccgcgaucauugccgcuaaugaaaugggcaugcuugagaccacgaaacgggaccugggcaugagcaaggaaccugggguugccucucccacauccuaccucgauguggaccugcaccccgcuagcgccuggacccuguacgcuguggccacaaccgucaucaccccuaugcuccgccauacaauugagaacucuacggcgaaugugagccuugccgcuaucgccaaccaggcuguugugcugaugggacuggacaaaggcuggccgauuuccaagauggaucucggggucccccugcuugcccugggaugcuauucucaggugaacccucucacccugacagccgcgguccugcuccuuaucacccacuacgcuaucauuggccccgggcugcaggccaaagcuacaagagaggcccaaaagcggaccgccgcuggaaucaugaagaauccuacgguggacggcauuaugacaaucgaucuggaccccguuauuuaugauagcaaauucgaaaagcagcucggccaggugaugcugcuuguccugugugccgugcagcuccugcugaugagaaccuccugggcgcucugcgaggcccuuacccuggcuacagggccuaucaccacacugugggaaggaucuccgggcaaauuuuggaacacgaccaucgccguuagcauggcuaauauuuuccgcggguccuaccucgccggagcgggccuggccuuuagcaucaugaagucuguggggacaggaaaacggggcaccggcucccaaggggagacacuuggagaaaaguggaagaaaaagcugaaccagcucagcagaaaagaguucgaccuguauaagaaauccggcauuaccgaggucgaucgcacggaagcuaaggaggggcugaaacggggagaaaucacccaucacgccgugucuagaggcagcgcuaagcuccagugguuuguggagcggaauaugguuauucccgaagggcgcgucaucgaccuuggauguggcagaggcgggugguccuacuauugcgccggacugaagaaagugacagaggugcggggcuacaccaaagggggaccuggccaugaggaacccgucccuaugucuacauacggguggaacauuguuaaacugaugagcggaaaggauguguucuaucugcccccggagaaaugugacacccugcuuugcgauaucggcgaauccagcccuucucccacaguggaggagucccgcaccaucagaguccugaagaugguggaacccuggcucaagaauaaccaguucuguauuaaaguucugaauccuuacaugcccacggugaucgagcaccuggaacggcuccaacgcaagcacggcgggaugcuugucagaaacccucugagcagaaauucuacacaugagauguauuggauuuccaacggaaccggcaauaucguggcuagcguuaacauggugucucgccugcuccugaauagauuuaccaugacacaccggagaccgacgauugaaaaagacgucgaucuuggggccggaacccgccaugugaacgcggagcccgagacaccuaacauggacgugaucggcgaacggaucaagagaauuaaagaggaacacaauagcaccuggcacuacgacgaugagaaccccuauaagacaugggccuaccauggguccuaugaagucaaggcuaccggaucugccagcuccaugaucaauggcguugugaaacugcucacaaagccuugggacgugguccccauggugacccagauggcuaugacggauaccacaccguucggccagcaacgcguuuuuaaagagaagguggacacccggacaccuagaagcaugcccgggacccgccgggucaugggaauuacggccgaguggcuguggagaacacugggccgcaacaaaaagccucggcucugcaccagagaagaguucacaaagaaagugcgcaccaaugccgcgaugggggcuguuuuuacggaagagaaccagugggauuccgccaaggccgcuguggaagacgaggauuucuggaaacuggucgaccgggagagagaacuucacaagcugggaaaauguggcucuugcguguacaauaugauggggaagcgcgagaaaaagcucggcgaauuuggaaaggccaaaggcagcagagcuaucugguacauguggcugggggcccgguaucuugaguucgaggcgcugggauuucucaacgaagaucauugguucucccgcgaaaauucuuacagcggcguugagggggagggacugcacaagcugggcuauauucucagagacaucuccaaaauccccgggggcgccauguacgcugaugacaccgccggaugggacacacggauuaccgaagaugaccugcauaacgaggagaagaucacacagcagauggauccugaacacagacaacuugcuaaugccauuuuuaaacugaccuaucagaacaagguggucaaggugcagcggcccacaccgaccggcacggucauggacaucauuucucgcaaagaucagagagggagcggacaagugggcacauacgggcucaauaccuucaccaacauggaggcgcagcugauccggcagauggaaggagagggcguucuuuccaaggccgaccuggaaaauccucaccuccccgagaaaaagaucacacaguggcuggagaccaaagggguggaacgccugaagagaauggcuauuagcggcgaugacugcgucgugaagcccaucgaugaccgguuugccaacgcucuccuggcccuuaacgauaugggaaaagugcgcaaggacauuccucaauggcagccgucuaaaggcuggcaugauuggcagcagguucccuucuguucccaccauuuccacgagcugaucaugaaggacgggagaaaacucguggucccuugccggccccaagacgaacugauuggacgcgcuagaaucagccagggcgccggguggucucuucgggagacagcgugucugggaaaggccuaugcucagauguggucccucauguacuuucaccgcagagaucugcggcuggccagcaaugccauuugcucugcugugccuguucauugggugcccacgucccgcaccacauggagcauccacgcccaucaccaauggaugaccacagaagacaugcucaccgucuggaacagaguguggaucgaggauaauccuuggauggaggacaagacgcccgucaccacaugggaaaacgugccguaccugggcaaacgggaggaucaguggugugggucccuuauuggccugaccagcagagcgacaugggcucagaauaucccuaccgccauucagcaaguucgcucucucaucggaaacgaagaguuccuggacuauaugcccagcaugaagcgguuuagaaaagaggaagaguccgaaggcgccauuugguga

SEQ ID NO: 20452 - RNA, 9873 nt, Artificial Sequence
  derived and/or modified CDS sequence (opt5) from DENV-3__GQ868575__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaaggcugugauuuucauccugcuuaugcuggucaccccuucuaugacaaugagaugugugggaguuggcaaccgggacuuuguggaagggcucagcggagccaccugggucgauguggugcuggagcacggcgggugcgucaccacaauggcuaagaauaaacccacgcuggacauugagcuccagaagaccgaagccacacaacuggcgacccuucgcaaacuguguaucgagggaaagauuacaaacaucaccacggauuccagaugcccuacacagggcgaagccguucucccggaggaacaggaccagaauuauguguguaaacacaccuacguggaucggggcugggggaacggaugcggccuguucgggaagggaagccuugucaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccagaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggcccggggggcuagacgcauggccauccuuggagacacagcgugggauuucggcuccguggggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuucuccuuuauuaucgauggaccuaauacccccgagugcccgagcgcgucuagagccuggaacgucugggaaguggaggacuauggcuucggcguguuuacaaccaauaucuggcucaaacugcgcgaagucuacacgcagcugugugaccaccggcuuauguccgcugccguuaaggaugagagagccgugcacgcugacaugggguacuggauugagagccagaaaaacggauccuggaagcucgaaaaagccucucugaucgaggugaagacaugcaccuggccuaagagccauacccugugguccaauggcguccucgaaucugauaugauuauccccaaaagccuggcggggccuauuucccagcacaacuaucgccccggauaccauacacaaaccgcuggcccuuggcaccuugggaagcuggagcucgacuucaauuauugcgagggaacgacagugguuaucaccgaaaacuguggcacacggggccccagccugagaaccacaaccgugucugggaaacugauccacgaguggugcugucgcuccugcacgcuuccgccucuccgguacaugggagaagauggcuguugguaugggauggagauuagacccaucagcgaaaaggaggagaauauggucaaaucucugguguccgccggaagcggcgaaguugacaacuuuaccaugggggugcugugccucgccauucuguucgaggaagucaugcggggaaaguucggcaagaaacauaugaucgcuggcguguuuuucacauuuguucuucugcucucugggcagauuaccuggcgcgauauggcccacacacugaucaugauuggaagcaaugcguccgacaagaugggcaugggggugaccuaccuggcucuuaucgccacguucaaaauccagcccuuucuggcccucggauucuuucugagaaagcucacaagccgggagaaccugcuucugggcgucgggcucgcuauggccaccacacugcaacugccugaagauauugagcagauggcuaauggaaucgcccuuggccugauggcgcucaaacugauuacccaguucgagaccuaucagcucuggacagcccugaucucucuuacguguuccaacaccauuuuuacacugaccguggcuuggagaacagccacccucauccuggcuggcgugagccugcuuccggucugccaauccucuagcaugcgcaagacggacuggcugcccaugacaguugccgccaugggggugccuccccucccucuguucaucuuuggacucaaggauacccugaaacggagauccuggccccuuaaugaaggcgugauggcugucgggcuggugucuauucuggcgagcucccuccugcgcaacgacguuccuauggccggaccccuuguggcuggcgggcugcucaucgccuguuacgucauuaccggaacaucugccgaucugaccguggagaaggcugccgacguuacaugggaagaggaagcggagcagacgggcgugagccauaaccucaugaucaccgucgacgaugacggcacaaugagaauuaaagaugacgagaccgaaaauauccugacagugcuucugaagaccgcucugcucaucgucuccgggauuuucccguacagcaucccugccacgcugcuuguguggcacaccuggcagaaacagacacaacggucuggaguucugugggaugugcccuccccucccgagacccagaaggccgaacucgaggagggcgucuaucgcauuaaacagcaggggaucuuuggaaagacacaagugggcguuggggugcagaaggaaggagucuuccauaccauguggcacgugacaagaggcgcugugcugacguacaacggcaaacggcucgagccgaauugggccagcguuaagaaagaccugauuucuuaugggggaggcuggcgccuuuccgcgcaguggcaaaagggggaagagguccaggugaucgcuguggaaccuggaaaaaaccccaagaauuuccagaccaugccuggcacauuucagaccaccacaggggagauuggagccaucgcccuggauuucaagcccggcacgagcggcucucccaucauuaacagagaggggaaagucgugggacuguacggcaaugggguugugaccaagaacggaggcuaugucuccgggaucgcucaaacaaaugccgaaccugacggcccgacccccgagcucgaagaggaaauguuuaaaaagcggaaccugacaauuauggaucuucacccuggaagcggcaaaacccgcaaguaccugcccgcuaucgugagagaggccauuaagcggcgccucagaacgcugauccucgcgccuacacggguuguggccgcugagauggaagaggcccugaaagggcuucccaucagauaucagaccaccgcuacaaaguccgaacauaccggacgcgagauugucgaccugaugugccacgccacauucaccaugcggcugcucagcccugugagaguuccgaauuacaaccugaucauuauggaugaagcccauuuuacggaccccgcuucuaucgcggcccgcggcuacauuagcacacggguggggaugggagaggcugccgccaucuucaugaccgcuacaccucccggcaccgccgaugcguuuccucaguccaaugcucccauccaggacgaggaaagagacauuccggagcgcucuuggaacagcgggaaugaauggaucacggauuucgccggcaaaaccgucugguuugugccuuccauuaaggccggaaacgacaucgcuaacugucuucggaaaaauggcaagaaggugauucaacugucuagaaaaacauucgauaccgaguaucagaagacaaaacucaacgacugggauuuugucguuaccacagacaucagcgagaugggggccaauuucaaggcggaucgcgugauugacccccggagaugccugaaacccgugauccugaccgauggaccugaacgggucauccucgccggccccaugccugugacggcugccuccgcugcccagcgcagagggcggguuggacgcaacccgcagaaggagaaugaccaauacauuuucacaggccagccccuuaacaaugaugaagaccacgcucauuggaccgaggccaagaugcugcuggacaacaucaauaccccugaagggauuauccccgcgcucuuugagccugagagagaaaaaucugccgcuauugauggcgaguaucggcugaagggagaaagcagaaaaacauucguggagcuuaugcgccggggcgaccugcccgucuggcucgcccacaagguggcuuccgaagggaucaaauacaccgauagaaaguggugcuuugacggacagcgcaacaaucagauccuggaggagaacauggauguugaaauuuggacaaaagagggcgaaaagaagaaacugcggccgagauggcucgacgcccgcacguauagcgauccucuugcccugaaggaguucaaagacuuugcugcggggcggaagucuaucgcccuggaucucgugaccgaaauuggaagaguccccacacaccuggcucaucgcaccagaaaugcccuugacaaccuggugaugcuccacacauccgagcauggcggcaaagccuaccggcacgcugucgaggaacugccugagaccauggaaacgcugcuccuucuggggcugaugauccuccugaccggaggcgccaugcuuuuccugauuagcgggaagggaaucggcaagacaucuaucgggcucauuugugugaucgcguccagcggaaugcuguggauggccgagauuccccugcaauggaucgcuuccgccauuguucucgaguuuuucaugauggugcuucugaucccugaacccgagaaacagcgcaccccgcaggauaaucaacuggcuuauguggucauuggcauccucacacuggccgcgaucauugccgcuaacgaaaugggccuucuggagaccacgaagagagaccucgggaugucucgggaaccuggaguugugagccccacauccuaccuggauguggaccugcaccccgccagcgcuuggacccucuacgccgucgcuacaaccgugaucaccccuaugcuucgccauacaauugagaauucuacggccaacguuucccuggcggccaucgcuaaccaggccgugguccugaugggccucgacaaaggguggccgauuagcaagauggaucugggagugccccuucuggcucucggcugcuauucucaggucaauccucugacccugacagccgccgugcuccuucugaucacccacuacgcgaucauugggcccggacugcaggcuaaagccacaagagaggcucaaaagcggaccgccgccggcaucaugaagaacccuacgguugacggcauuaugacaaucgaucucgaccccgugauuuaugauagcaaauuugaaaagcagcuggggcaggucaugcuucuggugcucugugcuguucagcugcugcucaugagaaccuccugggcccuuugcgaggcgcugacccuggccacaggaccuaucaccacacucugggaaggcucuccggggaaauucuggaauacgaccaucgcugugagcauggccaacauuuuucgcggauccuaccuggcuggcgccgggcuugcguucucuaucaugaagagcgucggaacaggcaaacggggcaccgggucccaaggagagacacugggcgaaaaguggaagaaaaagcucaaucagcugagcagaaaagaguuugaccuguauaagaaaucugggauuaccgagguggaucgcacggaagccaaggagggacucaaacggggcgaaaucacccaucacgcuguguccagagggagcgccaagcuucagugguucguugagcggaacauggucauucccgaaggacgcgugaucgaccugggcuguggcagagggggaugguccuacuauugcgcuggccugaagaaagugacagagguccggggguacaccaagggaggcccugggcaugaggaacccguuccuaugucuacauacggauggaauauugugaaacucaugagcggcaaggauguguucuaucugcccccggagaaaugugacacccuucugugcgauaucggcgaauccucuccuagccccacagucgaggagucccgcaccaucagagugcucaagaugguugaacccuggcugaagaacaaucaguuuuguauuaaagugcugaacccuuacaugcccacggucaucgagcaccucgaacggcuucaacgcaagcacgggggaaugcuggugagaaauccucugagccggaacucuacacaugagauguauuggauuuccaauggcaccgggaacaucguugccagcgugaauauggucucucgccuccugcuuaacagauucaccaugacacaccggagaccgacgauugaaaaagacguggaucugggagcuggcacccgccaugugaacgccgagcccgagaucccuaauauggacgucaucggggaacggauuaagagaaucaaagaggaacacaacuccacauggcacuacgacgaugagaaucccuauaagaccugggcguaccauggaagcuaugaaguuaaggccacaggcucugcuagcuccaugauuaacggcguggugaaacuccugaccaagccuugggacgucgugcccaugguuacacagauggccaugaccgauacgaccccguuugggcagcaacgcguguucaaagagaaggucgacacacggaccccuagaucuaugcccggaacacgccgggugaugggcaucaccgcugaguggcuguggagaacgcucgggcgcaauaaaaagccucggcugugcacaagagaagaguuuaccaagaaaguucgcacaaacgccgccaugggagcgguguucaccgaagagaaucagugggauagcgcuaaggccgccgucgaagacgaggauuuuuggaaacuuguggaccgggagagagaacugcacaagcucggcaaauguggguccugcguuuacaacaugaugggcaagcgcgagaaaaagcugggagaauucggcaaggcuaaagggagcagagccauuugguacauguggcuuggagcucgguaucuggaguuugaggcccucggcuuccugaaugaagaucauugguuuucccgcgagaacucuuacagcgggguggaaggagagggccugcacaagcucggguauauccugagagacaucuccaaaauucccggcggagcgauguacgccgaugacacggcuggcugggacacccggaucacagaagaugaccuucauaaugaggagaagauuacccagcagauggauccugaacacagacaacuggccaacgcuaucuucaaacucacauaucagaauaaggucgugaagguccagcggcccaccccgacagggaccgugauggacauuaucucucgcaaagaucagagaggaagcggccaaguugggacguacggacugaacacauuuaccaauauggaggcccagcuuauccggcagauggaaggcgagggggugcuguccaaggcggaccucgaaaacccucaccugcccgagaaaaagauuacccaguggcuggagacaaaaggcgucgaacgccucaagagaauggccaucucuggagaugacugcguggugaagcccauugaugaccgguucgcuaacgcccugcuugcucugaaugauaugggcaaaguucgcaaggacaucccucaauggcagccgagcaaaggguggcaugauuggcagcaggugcccuucuguucccaccauuuucacgagcucauuaugaaggacggaagaaaacuggucgugccuugccggccccaagacgaacuuaucggccgcgccagaauuagccagggggcuggauggucucugcgggagaccgccugucucggcaaggcguaugcccagauguggucccugauguacuuccaccgcagagaucugcggcucgcuagcaacgccaucugcucugccguuccugugcauuggguccccacaucccgcacgaccuggagcauccacgcucaucaccaauggaugacaaccgaagacaugcugacaguguggaauagagucuggauugaggauaacccuuggauggaggacaagacccccgugacgaccugggaaaauguuccguaccuugggaaacgggaggaucagugguguggcucucugaucggacucacauccagagccaccugggcgcagaacauuccuacagcuauccagcaagugcgcagccugauuggcaaugaagaguuucuugacuauaugcccuccaugaagcgguucagaaaagaggaagagagcgaaggggccaucugguga

SEQ ID NO: 20453 - RNA, 9873 nt, Artificial Sequence
  derived and/or modified CDS sequence (opt5) from DENV-3__GU131953__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaaggcugugauuuucauccugcuuaugcuggucaccccuucuaugacaaugagaugugugggaguuggcaaccgggacuuuguggaagggcucagcggagccaccugggucgauguggugcuggagcacggcgggugcgucaccacaauggcuaagaauaaacccacgcuggacauugagcuccagaagaccgaagccacacaacuggcgacccuucgcaaacuguguaucgagggaaagauuacaaacaucaccacggauuccagaugcccuacacagggcgaagccguucucccggaggaacaggaccagaauuauguguguaaacacaccuacguggaucggggcugggggaacggaugcggccuguucgggaagggaagccuugucaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccagaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggcccggggggcuagacgcauggccauccuuggagacacagcgugggauuucggcuccguggggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaaugcgguccucgaaagcgauaugauuauccccaaaucccuggcuggcccuauuagccagcacaacuaucgccccggguaccauacacaaaccgccggaccuuggcaccuuggcaagcuggagcucgacuuuaauuauugcgaggggacgacagugguuaucaccgaaaacuguggaacacggggccccucucugagaaccacaaccguguccggcaaacugauccacgaguggugcugucgcagcugcacgcuuccgccucuccgguacaugggggaagauggauguugguauggcauggagauuagacccaucucugaaaaggaggagaauauggucaaaucccuggugagcgccgggucuggagaaguugacaacuucaccaugggcgugcugugccucgcuauucuguuugaggaagucaugcgggggaaguucggaaagaaacauaugaucgccggcguguucuuuacauucguucuucugcucagcggccagauuaccuggcgcgauauggcgcacacacugaucaugauuggguccaaugcuagcgacagaaugggaaugggcgugaccuaccuggcccuuaucgccacguuuaagauccagcccuuccuggcucucggguuuuuccugcggaaacucacaucuagagagaaccugcuucugggagucggccucgccauggcuaccacacugcaacugccugaagauauugagcagauggccaaugggaucgcgcuuggacugauggcccucaagcugauuacccaguuugagaccuaucagcucuggacagcucugaucucccuuacguguagcaacaccauuuucacacugaccguggccuggcgcacagcuacccucauccuggccggcgugucccugcuuccggucugccaaucuagcuccaugcggaaaacggacuggcugcccaugacaguugccgcuaugggcgugccuccccucccucuguuuaucuucucucucaaggauacccugaagagacgcagcuggccccuuaaugaaggggugauggcggucggacugguguccauucuggccucuagccuccugagaaacgacguuccuauggcuggcccccuuguggccgggggacugcucaucgccuguuacgucauuaccggcacauccgcugaucugaccguggagaaagccgcggacguuacaugggaagaggaagcugagcagacgggggugagccauaaccucaugaucaccgucgacgaugacggaacaaugcggauuaaggaugacgagaccgaaaauauccugacagugcuucugaaaaccgcccugcucaucgucucuggcauuuuuccguacuccaucccugccacgcugcuuguguggcacaccuggcagaagcagacacaacgcagcggcguucugugggaugugcccucuccucccgagacccagaaagcugaacucgaggagggggucuauagaauuaagcagcagggaaucuucggcaaaacacaaguggggguuggagugcagaaggaaggcgucuuucauaccauguggcacgugacacggggggccgugcugacguacaacggaaagcgccucgagccgaauugggcguccguuaaaaaggaccugauuagcuauggcggcggguggagacuuucugcucaguggcaaaaaggagaagagguccaggugaucgccguggaaccuggcaagaaccccaaaaauuuccagaccaugccugggacauuccagaccaccacaggagagauuggcgccaucgcucuggauuuuaagcccgggacguccggaagccccaucauuaaccgggagggcaaggucgugggccuguacgggaauggaguugugaccaaaaacggcggguaugucuccggaaucgcccaaacaaaugcugaaccugacggcccgacccccgagcucgaagaggaaauguucaagaaacgcaaccugacaauuauggaucuucacccugggagcggcaagaccagaaaauaccugcccgccaucgugcgggaggcgauuaagcgcagacuccggacgcugauccucgccccuacaagaguuguggcugccgagauggaagaggcucugaagggacuucccauccgcuaucagaccaccgccacaaaaucugaacauaccggccgggagauugucgaccugaugugccacgccacauuuaccaugagacugcucagcccugugcgcguuccgaauuacaaccugaucauuauggaugaagcucauuucacggaccccgcguccaucgccgcucggggguacauuucuacaagagugggaaugggcgaggccgccgcuaucuuuaugaccgccacaccucccgggaccgcggaugcuuucccucagagcaaugcccccauccaggacgaggaacgcgacauuccggagcgguccuggaacucuggaaaugaauggaucacggauuuugccggcaagaccgucugguucgugccuagcauuaaagcugggaacgacaucgccaacugucuuagaaagaauggcaaaaaggugauucaacugucccgcaagacauuugauaccgaguaucagaaaacaaagcucaacgacugggauuucgucguuaccacagacaucucugagaugggagcgaauuuuaaagccgaucgggugauugaccccagacggugccugaagcccgugauccugaccgauggcccugaacgcgucauccucgcugggcccaugccugugacggccgcuagcgccgcucagagacggggacgcguuggcagaaacccgcagaaagagaaugaccaauacauuuucacagggcagccccuuaacaaugaugaagaccacgcccauuggaccgaggcgaagaugcugcuggacaacaucaauaccccugaaggaauuauccccgcccucuucgagccugagcgggaaaaguccgcugccauugauggcgaguauagacugaaaggggaaagccgcaagacauuuguggagcuuaugcggagaggcgaccugcccgucuggcucgcucacaaaguggccucugaaggaaucaaguacaccgaucgcaaauggugcuucgacggccagcggaacaaucagauccuggaggagaacauggauguugaaauuuggacaaaggagggggaaaaaaagaagcugagaccgcgcuggcucgacgcccggacguauuccgauccucuugcucugaaagaguuuaaggacuucgcggccggaagaaaaagcaucgcucuggaucucgugaccgaaauuggccgcguccccacacaccuggcccauagaacccggaaugcccuugacaaccuggugaugcuccacacaucugagcaugggggaaaggcuuaccgccacgccgucgaggaacugccugagaccauggaaacgcugcuccuucugggccugaugauccuccugaccggcggggcgaugcuuuuucugauuuccggaaaaggcaucgggaagacaagcaucggacucauuugugugaucgccuccucuggcaugcuguggauggcugagauuccccugcaauggaucgccagcgcuauuguucucgaguucuuuaugauggugcuucugaucccugaacccgagaagcagagaaccccgcaggauaaucaacuggccuauguggucauugggauccucacacuggcggccaucauugcugccaacgaaaugggacuucuggagaccacgaaacgggaccucggcauguccaaggaaccuggcguugugagccccacaucuuaccuggauguggaccugcaccccgcuuccgccuggacccucuacgcugucgccacaaccgugaucaccccuaugcuucgccauacaauugagaauagcacggcgaacguuucucuggccgcuaucgccaaccaggcugugguccugauggggcucgacaaaggauggccgauuagcaagauggaucugggcgugccccuucuggcccucgggugcuauucccaggucaauccucugacccugacagccgcggugcuccuucugaucacccacuacgcuaucauuggacccggccugcaggccaaagcuacaagagaggcccaaaagcggaccgccgcugggaucaugaagaacccuacgguugacggaauuaugacaaucgaucucgaccccgugauuuaugauucuaaauucgaaaagcagcugggccaggucaugcuucuggugcucugugccguucagcugcugcucaugagaaccagcugggcgcuuugcgaggcccugacccuggcuacaggcccuaucaccacacucugggaaggguccccgggaaaauuuuggaauacgaccaucgccgugucuauggcuaacauuuuccgcggcagcuaccuggccggggcgggacuugccuuuuccaucaugaagagcgucggcacagggaaacggggaaccggcucucaaggcgagacacugggggaaaaguggaagaaaaagcucaaucagcuguccagaaaagaguucgaccuguauaagaaaagcggaauuaccgagguggaucgcacggaagcuaaggagggccucaaacggggggaaaucacccaucacgccguguccagaggaucugcuaagcuucagugguuuguugagcggaacauggucauucccgaaggccgcgugaucgaccugggguguggaagaggcggcuggagcuacuauugcgccgggcugaagaaagugacagagguccggggauacaccaagggcgggccuggacaugaggaacccguuccuauguccacauacggcuggaauauugugaaacucaugucugggaaggauguguucuaucugcccccggagaaaugugacacccuucugugcgauaucggagaaagcuccccuagccccacagucgaggagucucgcaccaucagagugcucaagaugguugaacccuggcugaagaacaaucaguucuguauuaaagugcugaacccuuacaugcccacggucaucgagcaccucgaacggcuucaacgcaagcacggcggcaugcuggugagaaauccucugucccggaacagcacacaugagauguauuggauuucuaaugggaccggaaacaucguugcuuccgugaauauggucagccgccuccugcuuaacagauuuaccaugacacaccggagaccgacgauugaaaaagacguggaucugggcgccgggacccgccaugugaacgcggagcccgagacaccuaauauggacgucaucggagaacggaucaagagaauuaaagaggaacacaacucuaccuggcacuacgacgaugagaaucccuauaagacaugggccuaccauggcagcuaugaaguuaaggcuaccggguccgccucuagcaugaucaacggaguggugaaacuccugacaaagccuugggacgucgugcccaugguuacccagauggcuaugacggauaccacaccguucggccagcaacgcguguuuaaagagaaggucgacacccggacaccuagauccaugcccggcacccgccgggugauggagauuacggccgaauggcuguggagaacacucgggcgcaauaaaaagccucggcugugcaccagagaggaauucacaaagaaaguucgcaccaacgccgcgaugggagcuguguuuacggaggaaaaucagugggauagcgccaaggccgcugucgaggacgaggauuucuggaaacuuguggaccgggaaagagagcugcacaagcucggcaaauguggguccugcguuuacaacaugaugggaaagcgcgaaaaaaagcugggcgaguuugggaaggccaaaggcucuagagcuaucugguacauguggcuuggagcccgguaucuggaguucgaagcgcucggcuuucugaaugaggaucauugguucagccgcgaaaacuccuacucugggguggagggagaaggccugcacaagcucggguauauucugagagacaucagcaaaauccccggaggcgccauguacgcugaugacaccgccgggugggacacacggauuaccgaggaugaccuucauaaugaggaaaagaucacacagcagauggauccugagcacagacugcucgcuaacgccauuuuuaaacugaccuaucaaaauaaggucgugaagguccagcggcccacaccgaccggcacggugauggacaucauuucccgcaaagaucagagaggaucuggccagguugggacauacggacuuaacaccuucaccaauauggaagcgcaacugauccggcagauggagggcgaaggggugcucagcaaggccgaccuggagaacccucaccuguccgagaaaaaggucacacaguggcucgaaaccaaaggaguggagcgccugaagagaauggcuaucagcggcgaugacugcgugguuaagcccauugaugaccgguuugccaacgcucuucuggcccucaaugauauggggaaagugcgcaaggacaucccccaguggcaaccuucuaaaggcuggcaugauuggcagcaggucccguucuguucccaccauuuccacgaacugauuaugaaggacggaagaaaacuugugguucccugccggccucaggacgagcugaucggccgcgcuagaauuagccaaggggccggauggucucuccgggaaacagcgugucugggcaaggccuaugcucagauguggucccugauguacuuucaccgcagagaucuccggcuggccagcaacgccaucugcucugcugugcccguccauugggugccuacgucccgcaccacauggagcauucacgcccaucaccaguggaugaccacagaggacaugcuuaccgucuggaauagaguguggaucgaggauaaccccuggauggaagacaagacgccuguuaccacaugggagaaugugcccuaccuggggaaacgggaagaucaaugguguggaucccucaucggccugaccagcagagcgacaugggcucagaacauuccgaccgccauccagcagguccgcucucuuauugggaaugaggaguuccuggacuauaugccuagcaugaagcgguuuagaaaagaagaggaauccgagggcgccaucugguga

SEQ ID NO: 20454 - RNA, 9873 nt, Artificial Sequence
  derived and/or modified CDS sequence (opt5) from DENV-3__GQ868577__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaagaucguggggcuguacggaaauggcguugugaccaaaaacgggggauaugucuccggcauugcccaaacaaaugcugaaccugacgggccgacccccgagcucgaagaggaaauguucaagaaacgcaaccugacaaucauggaucuucacccuggcagcggaaagaccagaaaauaccugcccgccauugugcgggaggcuaucaagcgcagacuccggacgcugauccucgccccuacaagaguuguggcggccgagauggaagaggcucugaagggccuucccauucgcuaucagaccaccgccacaaaaucugaacauaccgggcgggagaucgucgaccugaugugccacgcuacauuuaccaugagacugcucagcccugugcgcguuccgaauuacaaccugauuaucauggaugaagcccauuucacggaccccgccuccauugcugcgcggggauacaucucuacaagagugggcaugggggaggccgcugccaucuuuaugaccgccacaccucccggaaccgcugaugccuucccucagagcaaugcgcccauucaggacgaggaacgcgacaucccggagcgguccuggaacucuggcaaugaauggauuacggauuuugcugggaagaccgucugguucgugccuagcaucaaagccggcaacgacauugccaacugucuuagaaagaauggcaaaaaggugauccaacugucccgcaagacauuugauaccgaguaucagaaaacaaagcucaacgacugggauuucgucguuaccacagacauuucugagaugggagcuaauuuuaaagccgaucgggugaucgaccccagacggugccugaagcccgugauccugaccgaugggccugaacgcgucauucucgcgggacccaugccugugacggccgcuagcgccgcucagagacggggccgcguugggagaaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagcgggaaaaguccgcggccaucgauggggaguauagacugaaaggcgaaagccgcaagacauuuguggagcuuaugcggagaggagaccugcccgucuggcucgcuuacaaaguggccucugaaggcaucaaguauaccgaucgcaaauggugcuucgacgggcagcggaacaaucagauucuggaggagaacauggauguugaaaucuggacaaaggagggagagaagaagaagcugagaccgcgcuggcucgacgcucggacguacuccgauccucuugcccugaaagaguuuaaggacuucgccgcuggcagaaaaagcauugcgcuggaucucgugaccgaaaucgggcgcguccccacacaccuggcccacagaacccggaaugcucuugacaaccuggugaugcuccauacaucugagcacggaggcaaggccuaucgccaugccgucgaggaacugccugagaccauggaaacgcugcuccuucugggccugaugauucuccugaccgggggagcuaugcuuuuucugaucuccggcaaagggaucggaaagacaagcauuggccucaucugugugauugccuccucugggaugcuguggauggcggagaucccccugcaauggauugccagcgcuaucguucucgaguucuuuaugauggugcuucugauuccugaacccgagaagcagagaaccccgcaggauaaucaacuggccuacguggucaucggaauccucacacuggcugccauuaucgcggccaacgaaaugggccuucuggagaccacgaaacgggaccucggcauguccaaggaaccugggguugugagccccacaucuuaccuggauguggaccugcaccccgcuuccgccuggacccucuaugcugucgccacaaccgugauuaccccuaugcuucgccacacaaucgagaauagcacggcuaacguuucucuggccgcgauugccaaccaggcugugguccugaugggacucgacaaaggcuggccgaucagcaagauggaucugggggugccccuucuggcccucggaugcuacucccaggucaauccucugacccugacagcugccgugcuccuucugaucacccauuaugccauuaucggccccgggcugcaggcgaaagcuacaagagaggcccaaaagcggaccgcugccggaauuaugaagaacccuacgguugacggcaucaugacaauugaucucgaccccgugaucuacgauucuaaauucgaaaagcagcugggccaggucaugcuucuggugcucugugccguucagcugcugcucaugagaaccagcugggcucuuugcgaggcccugacccuggcgacagggccuaucaccacacucugggaaggauccccgggcaaauuuuggaauacgaccauugccgugucuauggcuaacaucuuccgcgggagcuaucuggccggagcuggccuugccuuuuccauuaugaaaagcgucgggacaggaaaacggggcaccggcucucaaggggagacacugggagaaaaguggaagaaaaagcucaaucagcuguccagaaaagaguucgaccuguacaagaaaagcggcaucaccgagguggaucgcacggaagcgaaggaggggcucaaacggggagaaauuacccaccaugccguguccagaggcucugcuaaacuucagugguuuguugagcggaacauggucauccccgaagggcgcgugauugaccugggauguggcagaggcggguggagcuauuacugcgccggacugaagaaagugacagagguccggggcuacaccaaagggggaccuggccacgaggaacccguuccuauguccacauauggguggaauaucgugaaacucaugucuggaaaggauguguucuaccugcccccggagaaaugugacacccuucugugcgauaucggcgaaagcuccccuagccccacagucgaggagucucgcaccauuagagugcucaagaugguugaacccuggcugaagaacaaucaguucuguaucaaagugcugaacccuuauaugcccacggucauugagcaucucgaacggcuucaacgcaagcacggcgggaugcuggugagaaauccucugucccggaacagcacacacgagauguacuggaucucuaauggaaccggcaacauuguugcuuccgugaauauggucagccgccuccugcuuaacagauuuaccaugacacaucggagaccgacgaucgaaaaagacguggaucugggggccggaacccgccacgugaacgcugagcccgagacaccuaauauggacgucaucggcgaacggauuaagagaaucaaagaggaacauaacucuaccuggcacuaugacgaugagaaucccuacaagacaugggccuaucacgggagcuacgaaguuaaggcgaccggauccgccucuagcaugauuaacggcguggugaaacuccugacaaagccuugggacgucgugcccaugguuacccagauggcuaugacggauaccacaccguucggccagcaacgcguguuuaaagagaaggucgacacccggacaccuagauccaugcccgggacccgccgggugaugggaaucacggccgaguggcuguggagaacacucggccgcaauaaaaagccucggcugugcaccagagaagaguucacaaagaaaguucgcaccaacgcugccaugggggccguguuuacggaagagaaucagugggauagcgcgaaggcugccgucgaagacgaggauuucuggaaacuuguggaccgggagagagaacugcauaagcucggaaaauguggcuccugcguuuacaacaugauggggaagcgcgagaaaaagcugggcgaauuuggaaaggccaaaggcucuagagcuauuugguauauguggcuuggggcccgguaccuggaguucgaggcucucggauuucugaaugaagaucacugguucagccgcgagaacuccuauucuggcguggaaggggagggacugcauaagcucggcuacauccugagagacaucagcaaaauucccgggggcgccauguaugcggaugacaccgccggaugggacacacggaucaccgaagaugaccuucacaaugaggagaagauuacacagcagauggauccugaacauagacaacuggcuaacgccaucuuuaaacucaccuaccagaauaaggucgugaagguccagcggcccacaccgaccggcacggugauggacauuaucucccgcaaagaucagagagggucuggacaaguuggcacauaugggcugaacaccuucaccaauauggaggcucagcuuauccggcagauggaaggagagggcgugcugagcaaggccgaccucgaaaacccucaucugcccgagaaaaagauugcgcaguggcuggagacaaaaggggucgaacgccucaagagaauggccaucuccggcgaugacugcguggugaagcccauugaugaccgguuugcuaacgcccugcuugcucugaaugauaugggaaaaguucgcaaggacaucccucaauggcagccgagcaaaggcuggcacgauuggcaacaggugcccuucuguucucaucacuuccaugagcucauuaugaaggacgggagaaaacuggucgugccuugccggccccaagacgaacuuaucggacgcgccagaauuucccagggcgcuggguggagccugcgggagaccgccugucucggaaaggcguacgcccagauguggucucugauguacuuucaccgcagagaucugcggcucgcuuccaacgccaucugcagcgccguuccugugcacuggguccccacaucucgcacgaccugguccauccaugcucaccaucaauggaugacaaccgaagacaugcugacaguguggaauagagucuggauugaggauaacccuuggauggagaauaagacccccgugacgaccugggaaaacguuccguaucuuggcaaacgggaggaccaguggugugggagccugaucggccucacauccagagccaccugggcgcagaauauuccuacagcuauccagcaagugcgcagccugauuggaaacgaagaguuccuugauuacaugcccucuaugaagcgguuuagaaaagaggaagagagcgaaggcgccaucugguga

SEQ ID NO: 20455 - RNA, 9873 nt, Artificial Sequence
  derived and/or modified CDS sequence (opt5) from DENV-3__GU131954__SS-prME
accagccugugccucaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcuuacaaaguugccucugaaggcaucaaguauaccgaucgcaaauggugcuucgacgggcagcggaacaaucagauccuggaggagaacauggauguggaaauuuggacaaaggagggagagaagaagaagcugagaccgcgcuggcucgacgcucggacguacuccgauccucuugcccugaaagaguuuaaggacuucgccgcuggcagaaaaagcaucgcgcuggaucucgucaccgaaauugggcgcgugcccacacaccuggcccacagaacccggaaugcucuugacaaccuggucaugcuccauacaucugagcacggaggcaaggccuaucgccaugccguggaggaacugccugagaccauggaaacgcugcuccuucugggccugaugauccuccugaccgggggaguuaugcuuuuucugauuuccggcaaagggaucggaaagacaagcaucggccucauuugugugaucgcuuccucugggaugcuguggauggccgagauuccccugcaauggaucgcgagcgccauugugcucgaguucuuuaugaugguccuucugaucccugaacccgagaagcagagaaccccgcaggauaaucaacuggcuuacguugugauuggaauccucacacuggccgcuaucauugccgcgaacgaaaugggccuucuggagaccacgaaacgggaccucggcaugacaaaggaaccuggggccgugucccccaccagcuaccuggaugucgaccugcaccccgcuucugccuggacacucuaugcuguggccaccaccguuaucacaccuaugcuucgccacacgauugaaaauuccaccgcuaacgugagccuggccgcgaucgccaaccaggcugucgugcugaugggacucgacaaaggcuggccgauuucuaagauggaucugggggucccccuucuggcccucggaugcuacagccaggugaauccucugacacugaccgcugccguucuccuucugaucacacauuaugccaucauuggccccgggcugcaggcgaaagcuaccagagaggcccaaaagcggacggcugccggaaucaugaagaacccuacaguggacggcauuaugaccaucgaucucgaccccgucauuuacgauuccaaauucgagaagcagcugggccaggugaugcuucugguucucugugccgugcagcugcugcucaugagaaccucuugggcucuuugcgaggcccugacacuggcgaccgggccuaucacaacgcucugggaaggaagcccgggcaaauuuuggaauaccacaaucgccgucuccauggcuaacauuuuccgcgggucuuaucuggccggagcuggccuugccuuuagcaucaugaaguccguggggaccggaaaacggggcacaggcagccaaggggagacccugggagaaaaguggaagaaaaagcucaaucagcugucuagaaaagaguucgaccuguacaagaaauccggcauuacggagguggaucgcaccgaagcgaaggaggggcucaaacggggagaaaucacacaccaugccguuagcagaggcuccgcuaaacuucagugguuugucgagcggaacauggugauucccgaagggcgcgugaucgaccugggauguggcagaggcggguggucuuauuacugcgccggacugaagaaagucaccgagguucggggcuacacaaaagggggaccuggccacgaggaacccgugccuaugagcaccuauggguggaauauugugaaacucauguccggaaaggaugucuucuaccugcccccggagaaaugugacacacuucugugcgauaucggcgaaucuagcccuucccccaccguggaggagagccgcacgaucagaguucucaagaugguggaacccuggcugaagaacaaucaguucuguauuaaaguccugaacccuuauaugcccacagugaucgagcaucucgaacggcuucaacgcaagcacggcgggaugcugguuagaaauccucugucucggaacuccacccacgagauguacuggauuagcaauggaaccggcaacaucguggcuucugucaauauggugucccgccuccugcuuaacagauuuacaaugacgcaucggagaccgaccauugaaaaagacguggaucugggggccggaacacgccacgucaacgcugagcccgagaccccuaauauggacguuaucggcgaacggaucaagagaauuaaagaggaacauaacagcacauggcacuaugacgaugagaaucccuacaagaccugggccuaucacgggucuuacgaagugaaggcgacaggaagcgccuccucuaugaucaacggcguggucaaacuccugaccaagccuugggacgugguucccauggugacgcagauggcuaugaccgauacaaccccguucggccagcaacgcgucuuuaaagagaagguggacacacggaccccuagaagcaugcccgggacgcgccggguuaugggaauuacagccgaguggcuguggagaacccucggccgcaauaaaaagccucggcugugcacaagagaagaguucaccaagaaagugcgcacgaacgcugccaugggggccgucuuuaccgaagagaaucagugggauuccgcgaaggcugccguggaagacgaggauuucuggaaacuuguugaccgggagagagaacugcauaagcucggaaaauguggcagcugcguguacaacaugauggggaagcgcgagaaaaagcugggcgaauuuggaaaggccaaaggcuccagagcuaucugguauauguggcuuggggcccgguaccuggaguucgaggcucucggauuucugaaugaagaucacugguucucucgcgagaacagcuauuccggcgucgaaggggagggacugcauaagcucggcuacauucugagagacaucucuaaaauccccgggggcgccauguaugcggaugacacagccggaugggacacccggauuacagaagaugaccuucacaaugaggagaagaucacccagcagauggauccugaacauagacaacuggcuaacgccauuuuuaaacucacauaccagaauaagguggucaaggugcagcggcccaccccgacgggcacaguuauggacaucauuagccgcaaagaucagagaggguccggacaagugggcaccuaugggcugaacaccuucacaaauauggaggcucagcuuauccggcagauggaaggagagggcguccugucuaaggccgaccucgaaaacccucaucugcccgagaaaaaggugacccaguggcuggagacaaaagggguggaacgccucaagagaauggcgaucagcggcgaugacugcguugugaagcccauugaugaccgguuugccaacgcucugcuugcccugaaugauaugggaaaaguccgcaaggacaucccucaauggcagccguccaaaggcuggcacgauuggcaacaggugcccuucuguagccaucacuuccaugagcucauuaugaaggacgggagaaaacugguugugccuugccggccccaagacgaacuuaucggacgcgcuagaauuucucagggcgccggguggucccugcgggagacggcuugucucggaaaggccuacgcgcagauguggagccugauguacuuucaccgcagagaucugcggcucgccucuaacgcuaucugcuccgccgucccugugcacuggguccccaccagccgcacaaccuggucuauucaugcccaccaucaauggaugacaaccgaagacaugcugacgguguggaauagaguuuggaucgaggauaacccuuggauggaggacaagacccccgugacaaccugggaaaaugucccguaucuuggcaaacgggaggaucaguggugugggucccugaucggccucacaagcagagcuaccugggcccagaacauuccuacggcgauccagcaagugcgcucccugauuggaaaugaagaguuccuugacuacaugcccagcaugaagcgguuuagaaaagaggaagagucugaaggcgcuaucugguga

SEQ ID NO: 20456 - RNA, 9873 nt, Artificial Sequence
  derived and/or modified CDS sequence (opt5) from DENV-3__GQ868578__SS-prME
accagccugugccucaugaugauccugcccgccgcucuugccuuccaccugaccucccgggacggcgaaccucggaugauuguggggaagaacgaacgcggaaaaucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagucuauugagggcaaaguugugcaguaugaaaaucucaaguacacagucaucaucaccgugcauacaggggaccagcaccagguuggaaacgagacgcaaggcgugaccgcugaaauuacaccccaggccuccaccacagaggcuauccugccugaauauggcacccuggggcucgagugcagcccccgcacgggacuggacuucaaugagaugauucuucugaccaugaaaaacaaggccuggaugguccauagacagugguuuuucgaucucccucugcccuggacaucuggcgccaccacagaaaccccgacguggaaucggaaagagcuucuggugacauuuaagaacgcucacgcgaaaaagcaagaagucgugguucucgggucccaggagggagccaugcacaccgcucugacaggcgccaccgaaauccagaauagcgggggcaccucuauuuucgccggacaucugaagugucgccucaaaauggacaagcuggagcuuaaaggcauguccuacgcuaugugcacaaacacguuugugcugaagaaagaggucagcgaaacccagcacgggacaauccucaucaagguggaguacaagggagaagauguuccuuguaaaauucccuucuccaccgaggacggccaagggaaggcccauaacggaagacugaucacagcgaauccuguggucaccaaaaaggaggaacccgugaacauugaggcugaacccccuuucggcgagucuaauaucgugauugggaucggcgauaacgcccugaaaaucaauugguauaagaagggaagcuccauuggcaaaauguuugaagccacggcuagaggggccagacgcauggcuauccuuggagacacagccugggauuucggcagcguugggggaguccucaacucucugggcaagauggugcaccagauuuuuggguccgcguacaccgcccuguucagcggcgugucuugggucaugaaaaucggaauuggcgugcuccugaccuggaucgggcuuaauagcaagaacacauccaugucuuuuagcugcauugcuaucggaaucauuacccuguaucucggcgccguugugcaggcugacauggggugugucaucaauuggaaaggaaaggagcugaagugcggcuccgggauuuucgugacaaacgagguucauacguggaccgaacaguacaaauuucaagccgauagcccgaagcggcuggcgacagccaucgcuggcgccugggagaauggaguguguggcauuagaucuaccacacgcauggaaaaccuucucuggaaacagaucgcuaaugagcugaacuauauccugugggaaaauaacauuaagcucaccgucgugguuggggacaucauuggagugcuggagcagggcaaacggacgcuuacaccccagccuauggagcugaaguacuccuggaaaacaugggggaaggccaagaucgucaccgccgaaacacaaaacagcucuuucauuaucgauggacccaauaccccugagugccccuccgcuagcagagcguggaacgugugggaaguggaggacuauggcuuuggcgucuucacaaccaauaucuggcucaaacugcgcgaaguuuacacgcagcugugugaccaccggcuuauguccgccgcugugaaggaugagagagccgugcacgccgacaugggguacuggauugagucucagaaaaacggaagcuggaagcucgaaaaggcuucccugaucgaggucaagacaugcaaguggccgaaaucucauacccuguggagcaauggcgugcucgaauccgauaugauuaucccuaagagccuggccgggcccauuucucagcacaacuaucgcccuggauaccauacccaaacagcgggccccuggcaccuugggaaacuggagcucgacuuuaauuauugcgagggaaccacgguugugaucacagaaaacuguggcacccggggcccuucccugagaacaaccacagucagcgggaagcugauccacgaguggugcugucgcucuugcacccuucccccgcuccgguacaugggagaagauggcuguugguaugggauggagauuagaccuacguccgaaaaagaggagaauauggugaaaagccugguuucugcuggaagcggcgaaguggacaacuucaccauggggguccugugccucgccauccuguuugaggaagugaugcggggaaaguucggcaaaaagcauaugauugccggcguucuuuucacauuugugcugcuccuguccgggcagaucaccuggcgcgauauggcucacacacugauuaugaucggaagcaaugccucugacagaaugggcaugggggucaccuaccuugcgcugauugcuacguucaaaauccagcccuuucucgcccugggauucuuucuccggaagcugacauccagagagaaccuucugcucggcguggggcuggccauggcuaccacacugcaacuucccgaagauaucgagcagauggccaauggaauugcucugggccucauggcccugaaacucaucacccaguucgagaccuaucagcuguggacagcgcuuauuagccugacguguuccaacaccaucuuuacacucaccguggccuggcgcacagcuacccugauucuggccggcgucucucuucugccuguuugccaaagcuccucuaugcggaagacggacuggcucccgaugacaguggcugccaugggggugcccccucugccccucuucaucuuuagccugaaggauacccuuaaaagacgcuccuggccucugaaugaaggagucauggccgugggccugguuucuauccucgcuagcucccugcuuagaaacgacgugcccauggcggggccucuggucgccggaggccuccugauugcuuguuacgugaucaccgggacaagcgccgaucucaccguugagaaggccgcugacgugacaugggaagaggaagccgagcagacgggagucucucauaaccugaugauuaccguggacgaugacggcacaaugcggaucaaagaugacgagaccgaaaauauucuuacaguccugcugaagaccgcgcuccugaucguguccggcaucuuccccuacagcauuccggcuacgcuucugguuuggcacaccuggcagaaacagacacaacgcucuggggugcucugggaugucccuucucccccugagacccagaaggccgaacuggaggagggaguguauagaaucaaacagcagggcauuuuugggaagacacaaguuggagugggcguccagaaggaagggguguuccauaccauguggcacgugacacggggagccguucucacguacaacggcaaacgccuggagcccaauugggcuagcgucaagaaagaccuuaucagcuauggcgggggauggagacuguccgcccaguggcaaaagggcgaagagguccaggugauugcggucgaaccggggaaaaacccuaagaauuuucagaccaugcccggaacauuccagaccaccacaggcgagaucggggcuauugcccuggauuucaagccuggaacgagcggcucccccaucaucaaccgggagggcaaaauuguggggcucuacggaaauggcguugugaccaagaacgggggauaugucagcggcaucgcccaaacaaaugcugaacccgacgggccuaccccggagcuggaagaggaaauguuuaaaaagcgcaaccuuacaauuauggaucugcaccccggcucuggaaaaaccagaaaguaccucccugccaucgugcgggaggcuauuaagcgcagacugcggacgcucauccuggcccccacaagaguuguggcggccgagauggaagaggcucuuaaaggccugccuauccgcuaucagaccaccgccacaaagagcgaacauaccgggcgggagauugucgaccugaugugccacgcuacauucaccaugagacuccugucccccgugcgcguuccuaauuacaaccuuaucauuauggaugaagcccauuuuacggacccggccucuaucgcugcgcggggauacauuagcacaagagugggcaugggggaggccgcugccaucuucaugaccgccacacccccuggaaccgcugaugccuuuccccaguccaaugcgccuauccaggacgaggaacgcgacauucccgagcggucuuggaacagcggcaaugaauggaucacggauuucgcugggaaaaccgucugguuugugccguccauuaaggccggcaacgacaucgccaacugucugcgcaaaaauggaaagaaggugauucaacucucuagaaaaacauucgauaccgaguaucagaagacaaaacugaacgacugggauuuugucguuaccacagacaucagcgagaugggcgcuaauuucaaggccgaucgggugauugacccuagacggugccugaaacccgugauccucaccgaugggcccgaacgcgucauccuugcgggaccuaugcccgugacggccgcuuccgccgcucagagacggggccgcguugggagaaacccucagaaggagaaugaccaauacauuuuuacaggacagccgcugaacaaugaugaagaccacgcccauuggaccgaggcuaagaugcugcucgacaacaucaauacccccgaaggcauuaucccugcccuguucgagcccgagcgggagaaguccgcggccauugauggggaguauagacuuaagggcgaaucucgcaaaacauucguggagcugaugcggagaggagaccucccugucuggcuggcuuacaagguggccuccgaaggcaucaaauauaccgaucgcaaguggugcuuugacgggcagcggaacaaucagauccuggaggagaacauggauguugaaauuuggacaaaagagggagaaaagaagaaacucagaccccgcuggcuugacgcucggacguacagcgauccgcuggcccugaaggaguucaaagacuuugccgcuggcagaaagucuaucgcgcucgaucuggugaccgaaauugggcgcgucccuacacaccuugcccacagaacccggaaugcucuggacaaccucgugaugcugcauacauccgagcacggaggcaaagccuaucgccaugccgucgaggaacugcccgagaccauggaaacgcuccuucugcugggccucaugauccugcuuaccgggggagcuaugcuguuccucauuagcggcaaggggaucggaaagacauccaucggccugauuugugugaucgccucuagcgggaugcuguggauggcggagauuccucuccaauggaucgccuccgcuauuguucuugaguuuuucaugauggugcugcugauccccgaaccugagaaacagagaacaccccaggauaaucaacucgccuacguggucauuggaauccugacacuugcugccaucauugcggccaacgaaaugggccugcucgagaccacgaagcgggaccugggcaugagcaaagaaccggggguugugucuccuacauccuaccuggauguggaccuccaccccgcuagcgccuggacccuuuaugcugucgccacaaccgugaucacccccaugcugcgccacacaauugaaaauucuacggcuaacguuagccuggccgcgaucgccaaccaggcugugguccucaugggacuggacaagggcuggccuauuuccaaaauggaucuuggggugccgcugcucgcccugggaugcuacucucaggucaauccccugacccucacagcugccgugcuucugcugaucacccauuaugccaucauuggcccugggcuccaggcgaaggcuacaagagaggcccaaaagcggaccgcugccggaaucaugaaaaaccccacgguugacggcauuaugacaaucgaucuggacccugugauuuacgauagcaaguuugaaaaacagcuuggccaggucaugcugcucgugcugugugccguucagcugcuccuuaugagaaccuccugggcucugugcgaggcccugacccucgcgacagggcccaucaccacacugugggaaggaucuccuggcaaguucuggaauacgaccaucgccgugagcauggcuaacauuuuucgcggguccuaucuugccggagcuggccuggccuucagcaucaugaaaucugucgggacaggaaagcggggcaccggcucccaaggggagacacucggagaaaaguggaaaaagaaacugaaucagcugagcagaaaggaguuugaccucuacaaaaaguccggcauuaccgagguggaucgcacggaagcgaaagaggggcuuaagcggggagaaaucacccaccaugccgugucuagaggcagcgcuaagcugcagugguucguugagcggaacauggucauuccggaagggcgcgugaucgaccugggauguggcagaggcgggugguccuauuacugcgccggacucaaaaaggugacagagguccggggcuacaccaaagggggacccggccacgaggaaccuguucccaugucuacauauggguggaauauugugaagcugaugagcggaaaagauguguuuuaccuuccucccgagaagugugacacccugcucugcgauaucggcgaauccagcccgucuccuacagucgaggagucccgcaccaucagagugcugaagaugguugaacccuggcugaaaaacaaucaguucuguauuaaggugcucaaccccuauaugccuacggucaucgagcaucuugaacggcugcaacgcaaacacggcgggaugcuggugagaaauccccucagccggaacucuacacacgagauguacuggauuuccaauggaaccggcaacaucguugcuagcgugaauauggucucucgccugcuucugaacagauucaccaugacacaucggagaccuacgauugaaaaggacguggaucucggggccggaacccgccacgugaacgcugagccggagacacccaauauggacgucaucggcgaacggaucaaaagaauuaaggaggaacauaacagcaccuggcacuaugacgaugagaauccuuacaagacaugggccuaucacggguccuacgaaguuaaagcgaccggaucugccagcuccaugaucaacggcguggugaagcugcugacaaaacccugggacgucgugccuaugguuacccagauggcuaugacggauaccacacccuuuggccagcaacgcguguucaaggagaaagucgacacccggacaccgagaagcaugccugggacccgccgggugaugggaauuacggccgaguggcucuggagaacacugggccgcaauaagaagccccggcuuugcaccagagaagaguuuaccaagaagguucgcaccaacgcugccaugggggccguguucacggaagagaaucagugggauuccgcgaaagcugccgucgaagacgaggauuuuuggaagcugguggaccgggagagagaacuccauaaacugggaaaguguggcucuugcguuuacaacaugauggggaaacgcgagaagaaacuuggcgaguucggaaaagccaagggcagcagagcuaucugguauauguggcugggggcccgguaccucgaguuugaggcucugggauuccugaaugaagaucacugguuuucccgcgagaacucuuauagcggcguggaaggggagggacuccauaaacugggcuacauucuuagagacaucuccaagaucccugggggcgccauguaugcggaugacaccgccggaugggacacacggauuaccgaagaugaccugcacaaugaggagaaaaucacacagcagauggaucccgaacauagacaacucgcuaacgccauuuucaagcugaccuaccagaauaaggucgugaaaguccagcggccuacacccaccggcacggugauggacaucauuucucgcaaggaucagagagggagcggacaaguuggcacauaugggcuuaacaccuuuaccaauauggaggcucagcugauccggcagauggaaggagagggcgugcucuccaaagccgaccuggaaaacccgcaucugccugagaagaaaaucgcgcaguggcucgagacaaagggggucgaacgccugaagagaauggccauuagcggcgaugacugcguggugaaacccaucgaugaccgguucgcuaacgcccuucuggcucucaaugauaugggaaagguucgcaaagacauuccccaauggcagccuucuaagggcuggcacgauuggcaacaggugccguuuuguucccaucacuuccaugagcugaucaugaaagacgggagaaaacuugucgugcccugccggccucaagacgaacugauuggacgcgccagaaucagccagggcgcuggguggucucuccgggagaccgccugucugggaaaggcguacgcccagauguggucccugauguacuuccaccgcagagaucuccggcuggcuagcaacgccauuugcucugccguucccgugcacugggucccuacaucccgcacgaccuggagcauccaugcucaccaucaauggaugacaaccgaagacaugcuuacaguguggaauagagucuggaucgaggauaaccccuggauggaggacaaaaccccugugacgaccugggaaaauguucccuaucugggcaagcgggaggaucaguggugugggucccucauuggccugacaagcagagccaccugggcgcagaacaucccgacagcuauucagcaagugcgcucucuuaugggaaaugaagaguuucuggacuacaugccuagcaugaaacgguucagaaaggaggaagaguccgaaggcgccaucugguga

SEQ ID NO: 20457 - RNA, 9873 nt, Artificial Sequence
  derived and/or modified CDS sequence (opt5) from DENV-3__FJ898457__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcagcaugaaaaucucaaguauacagucaucaucaccgugcacacaggggaccagcaucagguuggaaacgagacgcaaggcgugaccgcugaaauuacaccucaggccucuaccacagaggcuauccugcccgaauacggcacccuggggcucgagugcuccccucgcacgggacuggacuucaaugagaugauucuucugaccaugaaaaacaaggccuggaugguccacagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcauaccgcucugacaggcgccaccgaaauccaaaauuccgggggcaccagcauuuucgccggacaccugaagugucgccucaaaauggacaagcuggagcuuaaaggcaugucuuaugcuaugugcacaaacacguuugugcugaagaaagaggucuccgaaacccagcaugggacaauccucaucaagguggaguacaagggagaagaugcccccuguaaaauuccuuucagcaccgaggacggccaagggaaggcgcacaacggaagacugaucacagcuaaucccguugugaccaaaaaggaggaacccgucaacauugaggccgaaccuccguucggcgaguccaauaucgugauugggaucggcgauaacgcccugaaaaucaauugguacaagaagggaucuagcauuggcaaaauguuugaagcuacggccagaggggcuagacgcauggccauccuuggagacacagcgugggauuucggcuccgucgggggaguucucaacagccugggcaagaugguccaucagauuuuugggucugccuauaccgcucuguucuccggcgugagcuggaucaugaaaauuggaaucggcgugcuccugaccuggauugggcuuaauucuaagaacacaagcauguccuuuucuugcaucgccaucggaauuaucacccuguaccucggcgcugucgugcaggccgacaugggguguguuauuaauuggaaaggaaaggagcugaagugcggcagcgggaucuucgugacaaacgagguccacacguggaccgaacaguauaaauuucaagcggauucccccaagcggcuggccacagcuauugccggcgcuugggagaauggaguguguggcaucagaagcaccacacgcauggaaaaccuucucuggaaacagaucgccaaugagcugaacuacauucugugggaaaauaacaucaagcucaccguuguggucggggacauuaucggagugcuggagcagggcaaacggacgcuuaccccucagcccauggagcugaaguauucuuggaaaacaugggggaaggccaagauuguuaccgcugaaacacaaaacuccagcuucaucaucgauggaccuaauacccccgagugcccgucugcguccagagccuggaacgugugggaagucgaggacuacggcuuuggcguguucacaaccaauauuuggcucaaacugcgcgaaguguauacgcagcugugugaccaccggcuuaugagcgcugccgucaaggaugagagagccguucaugcugacaugggguacuggaucgagucccagaaaaacggaucuuggaagcucgaaaaagccagccugauugaggugaagacaugcaccuggccuaagucccacacccuguggucuaauggcgugcucgaaagcgauaugaucauucccaaaucccuggcggggccuaucagccagcauaaccaccgccccggauaccacacacaaaccgcuggcccuuggcaucuugggaagcuggagcucgacuuuaauuauugcgagggaacgacagucgugaucaccgaaaacuguggcacacggggccccucucugagaaccacaaccguuuccgggaaacugauucacgaguggugcugucgcagcugcacgcuuccgccucuccgguacaugggagaagauggcuguugguaugggauggagaucagacccauuucugaaaaggaggagaauauggugaaaucccuggucagcgccggaucuggcaagguggacaacuucaccauggggguucugugccucgccauccuguuugaagaggugaugcggggaaaguucggcaaaaagcauaugauugcuggcgucuucuuuacauucgugcuucugcucagcgggcagaucaccuggcgcgauauggcccacacacugauuaugaucggauccaaugcgagcgacagaaugggcauggggguuaccuaccuggcucuuaucgccacguuuaaaauucagcccuuccuggcccucggauuuuuccugcggaagcucacaucuagagaaaaccugcuucugggcguggggcucgcuauggccaccacacugcaacugccugaggauaucgaacagauggcuaauggaauugcccuuggccugauggcgcucaaacugaucacccaguuugagaccuaucagcucuggacagcccugauuucccuuacguguagcaacaccaucuucacacugaccgucgcuuggcgcacagccacccucauccuggcuggcgugucccugcuuccggugugccaaucuagcuccaugcggaagacggacuggcugcccauggccgucgccgcuauggggguuccuccccucccucuguuuauuuucucucucaaggauacacugaaaagacgcagcuggccccuuaaugagggagugauggcggugggccuggucuccauccuggccucuagccuccugagaaacgacgugccuauggcugggccccuuguugccggaggccugcucauugccuguuacgugaucaccgggaccuccgcugaucugacagucgaaaaggccgcggacauuaccugggaggaagaggcugaacagacaggagugagccauaaccucaugaucacgguugacgaugacggcaccaugcggaucaaagaugacgagacagagaauauucugaccgugcuucugaagacagcccugcucaucgucucuggcauuuuuccguauuccaucccugccacccugcuuguguggcacacguggcagaaacagacccaacgcagcgggguccugugggaugugcccucuccucccgaaacacagaaggcugagcucgaagagggaguuuacagaauuaaacagcagggcaucuucgggaagacccaagugggagucggcgugcagaaggaggggguuuuucacacaauguggcaugugacccggggagccguccugacauacaacggcaaacgccucgaaccgaauugggcguccgugaagaaagaccugauuagcuauggcgggggauggagacuuucugcucaguggcaaaagggcgaggaagugcagguuaucgccgucgagccugggaaaaaccccaagaauuuccagacgaugccuggaaccuuccagacaaccaccggcgaaaucggggccauugcucuggauuuuaagcccggaacauccggcagccccaucauuaaccgggagggcaaagugguggggcuguacggaaauggcgucgugacgaagaacgggggauauguuuccggcaucgcccaaaccaaugcugagccugacgggccgacacccgaacucgaggaagagauguucaaaaagcgcaaccugaccauuauggaucuucacccuggcagcggaaaaacaagaaaguaccugcccgccaucgugcgggaagcgaucaagcgcagacuccggacccugauucucgccccuacgagagucguggcugccgagauggaggaagcucugaaaggccuucccauccgcuaucagacaaccgccaccaagucugagcauacagggcgggaaauuguugaccugaugugccacgccaccuuuacaaugagacugcucagcccugugcgcgucccgaauuacaaccugaucauuauggaugaggcucauuucaccgaccccgcguccaucgccgcucggggauauaucucuacgagagugggcaugggggaagccgccgcuauuuuuaugacagccaccccucccggaacagcggaugcuuucccucagagcaaugcccccauccaggacgaggagcgcgacauuccggaacgguccuggaacucuggcaaugaguggaucaccgauuuugccgggaaaacgguuugguucgugccuagcauuaaggcuggcaacgacaucgccaacugucuucgcaaaaauggaaagaaggucauucaacuguccagaaaaaccuuugauacagaauaccagaagaccaaacucaacgacugggauuucguggugacaaccgacaucucugagaugggcgcgaauuuuaaggccgaucgggucaucgaccccagacggugccugaaacccguuauucugacagaugggccugagcgcgugauccucgcuggacccaugccugugaccgccgcuagcgccgcucagagacggggccgcgucgggagaaacccgcagaaggaaaaugaccaauacauuuucacgggacagccccuuaacaaugaugaggaccacgcccacuggacagaagcgaagaugcugcuggacaacaucaauaccccugagggcauuauccccgcccucuucgaaccugagcgggagaaauccgcugccaucgauggggaauauagacugaagggcgagagccgcaaaaccuuuguggaacuuaugcggagaggagaccugcccguuuggcucgcucauaagguggccucugagggcauuaaauacacagaucgcaaguggugcuucgacgggcagcggaacaaucagauccuggaagagaacauggaugucgagauuuggaccaaagaaggagagaagaagaaacugagaccgcgcuggcucgacgcccggacauauuccgauccucuugcucugaaggaauuuaaagacuucgcggccggcagaaagagcaucgcucuggaucucgugacggagauugggcgcguucccucucaccuggcccauagaacccggaaugcccuugacaaccuggugaugcuccacacauccgaacacggaggccgcgcuuacagacaugccgucgaggagcugccugaaaccauggagacacugcuccuucugggccugaugauccuccugaccgggggagcgaugcuuuuucugaucagcggcaaagggauuggaaagacguccaucggccucauuugugugaucgccucuagcgggaugcuguggauggcugaaauuccccugcaauggaucgccuccgcuauuguccucgaguucuuuaugauggugcuucugaucccugagcccgaaaagcagcggaccccgcaggauaaucaacuggccuauguugugaucggcauucucacacuggcggccaucauugcugccaacgagaugggccuucuggaaaccacaaaacgcgaccucggcaugagcaaggagccugggguggucucucccaccuccuaccuggauguugaccugcaccccgcuagcgccuggacgcucuaugcuguggccacaaccgugaucacaccuaugcuuagacauaccauugaaaauucuaccgcgaacgucagccuggccgcuaucgccaaccaggcugugguucugaugggacucgacaaaggcuggccgaucuccaagauggaucugggggugccccuucuggcccucggaugcuacucucaggucaauccucugacacugacggccgcggugcuccuucugauuacccacuacgcuaucauuggccccgggcugcaggccaaagcuacacgggaggcccaaaagagaaccgccgcuggaaucaugaagaacccuacagucgacggcauuaugaccaucgaucucgaccccgugaucuaugauagcaaauucgagaagcagcugggccagguuaugcuucuggugcucugugccguccagcugcugcucaugcgcacguccugggcgcuuugcgaagcccugacacuggcuaccgggccuauuaccacacucugggagggaucuccgggcaaauuuuggaauaccacaaucgccgugagcauggcuaacauuuuccggggguccuaccuggccggagcgggccuugccuuuagcaucaugaagacgguugggaccggaaaaagaggcacaggcucucaaggggaaacccugggagagaaguggaagaaaaagcucaaucagcugucccgcaaagaguucgaccuguauaagaaaagcggcauuacagagguggaucggaccgaggcuaaggaagggcucaaaagaggagagaucacgcaucacgccgucucccggggcucugcuaaacuucagugguuuguggaacgcaacauggugauucccgaggggagaguuaucgaccugggauguggccggggcggguggagcuacuauugcgccggacugaagaaagucaccgaagugcgcggcuacacaaaagggggaccuggccacgaggagcccgugccuauguccaccuauggguggaauaucgucaaacucaugucuggaaaggauguuuucuaccugcccccggaaaaaugugacacacuucugugcgauauuggcgagagcuccccuagccccaccguggaagagucuagaacaauccgggugcucaagauggucgagcccuggcugaagaacaaucaguucuguauuaaagugcugaacccuuacaugcccaccguuaucgaacaucucgagcgccuucaaagaaagcacggcgggaugcuggugcggaauccucugucccgcaacagcacgcaugaaauguauuggauuucuaauggaacaggcaacaucgucgcuuccgugaauaugguuagcagacuccugcuuaaccgguuuaccaugacccacagacgcccgacaaucgagaaagacguggaucugggggccggaacgcggcacgucaacgcggaacccgagaccccuaauauggacgugauuggcgagagaaucaagcgcauuaaagaagaacacaacucuacauggcacuacgacgaugaaaaucccuauaagaccugggccuaccaugggagcuaugaggugaaggcuacaggauccgccucuagcaugaucaacggcgucguuaaacuccugaccaagccuugggacguggugcccauggucacacagauggcuaugaccgauacgaccccguucggccagcaacggguguuuaaagaaaagguugacacaagaaccccucgcuccaugcccgggacacggagagugaugggaauuaccgccgaguggcuguggcgcacgcucggccggaauaaaaagccuagacugugcacacgcgaggaguucaccaagaaaguccggacaaacgccgcgaugggggcuguguuuaccgaggaaaaucagugggauagcgccaaggccgcuguugaggacgaagauuucuggaaacuuguggacagagagcgcgagcugcacaagcucggaaaauguggcuccugcgucuacaacaugauggggaagagagagaagaagcugggcgaguuuggaaaggccaaaggcucucgggcuaucugguauauguggcuuggggcccgcuaccuggaguucgaggcgcucggauuucugaaugaggaucauugguucagcagagaaaacuccuacucuggcguggagggggaaggacugcacaagcucggcuauauccugcgggacauuagcaaaauccccgggggcgccauguacgcugaugacacggccggaugggacaccagaauuacagaggaugaccuucacaaugaagagaagaucacccagcagauggauccugagcaucggcaacuggcuaacgccauuuuuaaacucacauaucagaauaagguugugaagguccagcgccccaccccgacaggcaccgugauggacaucaucuccagaaaagaucagcgggggucuggacaagucggcacguacgggcugaacacauucaccaauauggaagcgcagcuuauucgccagauggagggagaaggcgugcugagcaaggccgaccucgagaacccucaucugcccgagaagaagaucacccaguggcuggagacaaaagggguugagagacucaagcggauggcuauuuccggcgaugacugcguggucaagcccaucgaugaccgcuuugccaacgcucugcuugcccugaaugauaugggaaaagugagaaaggacauuccucaauggcagccgagcaaaggcuggcaugauuggcaacaggugcccuucuguucucaccacuuccaugaacucaucaugaaggacgggcggaaacugguugugccuugccgcccccaagacgagcuuauuggacgggcucggaucucccagggcgccggguggagccugcgcgaaaccgcgugucucggaaaggccuaugcucagauguggucucugauguacuuucacagacgggaucugcgccucgccuccaacgccaucugcagcgcugucccugugcauuggguucccacaucuagaacgaccugguccauucacgcccaucaccaauggaugacaaccgaggacaugcugacaguguggaaucgggucuggaucgaagauaacccuuggauggaggacaagacccccgugacgaccugggagaaugucccguaucuuggcaaaagagaagaucaguggugugggagccugauuggccucacaucccgcgcgaccugggcucagaacaucccuacagccauucagcaagugcggagccugaucggaaaugaggaguuccuugacuacaugcccucuaugaagagauuucgcaaagaggaggaaagcgagggcgccaucugguga

SEQ ID NO: 20458 - RNA, 9873 nt, Artificial Sequence
  derived and/or modified CDS sequence (opt5) from DENV-3__KF955505__SS-prME
accagccugugccucaugaugauccugcccgccgcucuugccuuccaccugacaucccggaauggagaaccucggaugauuguggggaagaaugaacgcggaaaaucucuccuguuuaagacggcgagcggcaucaacauguguacccuuauugcuauggaccugggggaaaugugcgaugacacagugaccuacaaauguccgcauaucacagaaguugaacccgaagauauugacugcugguguaaucucaccuccacaugggugaccuauggaacgugcaaccaggccggcgaacacagacgggauaagcgcucuguggcccuggcuccucaugucgggaugggacuggacaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaucgggauuuugucgaagggcucagcggagcuaccuggguggacgugguccuggagcacggcgggugcguuaccacaauggccaagaacaaacccacgcuggauauugagcuccagaagaccgaagcuacacaacuggccacccuucgcaaacuguguaucgagggaaagauuacaaauaucaccacggacuccagaugcccuacacagggcgaagcggugcucccggaggaacaggaucagaacuauguguguaaacacaccuacgucgaccggggcugggggaauggaugcggccuguucgggaagggaagccuugugaccugcgccaaguuucaaugucuggagcccauugagggcaaaguugugcaguaugaaaaccucaaguacacagucaucaucaccgugcauacaggggaucagcaccagguuggaaaugagacgcaaggcgugaccgcugaaauuacaccucaggccucuaccacagaggcuauccugcccgaauauggcacccuggggcucgagugcuccccucgcacgggacuggacuucaacgagaugauucuucugaccaugaaaaauaaggccuggaugguccauagacagugguuuuucgaccucccccugccguggacaagcggcgccaccacagaaaccccuacguggaaccggaaagagcuucuggugacauuuaagaaugcucacgcgaaaaagcaagaagucgugguucucgggucucaggagggagccaugcacaccgcucugacaggcgccaccgaaauccagaacuccgggggcaccagcauuuucgccggacaucugaagugucgccucaaaauggauaagcuggagcuuaaaggcaugucuuacgcuaugugcacaaacacguuugugcugaagaaagaggucuccgaaacccagcacgggacaauccucaucaagguggaguacaagggagaagacgcccccuguaaaauuccuuucagcaccgaggauggccaagggaaggcgcauaauggaagacugaucacagcuaaccccguugugaccaaaaaggaggaacccgucaauauugaggccgaaccuccguucggcgaguccaacaucgugauugggaucggcgacaaugcccugaaaaucaacugguauaagaagggaucuagcauuggcaaaauguuugaagcuacggccagaggggcuagacgcauggccauccuuggagauacagcgugggacuucggcuccgucgggggaguucucaauagccugggcaagaugguccaccagauuuuugggucugccuacaccgcucuguucuccggcgugagcugggugaugaaaaucggaauuggcguccuccugaccuggaucgggcuuaacucuaagaauacaagcauguccuuuucuugcauugccaucggaaucauuacccuguaucucggcgcugugguucaggccgauauggggugugugaucaacuggaaaggaaaggagcugaagugcggcagcgggauuuucgucacaaaugaggugcauacguggaccgaacaguacaaauuucaagcggacucccccaagcggcuggccacagcuaucgccggcgcuugggagaacggaguuuguggcauuagaagcaccacacgcauggaaaaucuucucuggaaacagaucgccaacgagcugaauuauauccugugggaaaacaacauuaagcucaccguggucgugggggauaucauuggaguucuggagcagggcaaacggacgcuuaccccucagcccauggagcugaaguacucuuggaaaacaugggggaaggccaagaucgugaccgcugaaacacaaaauuccagcuucauuaucgacggaccuaacacccccgagugcccgucugcguccagagccuggaaugucugggaaguggaggauuauggcuuuggcguguucacaaccaacaucuggcucaaacugcgcgaagucuacacgcagcugugugaccaccggcuuaugagcgcugccguuaaggacgagagagccgugcacgcugauaugggguacuggauugagucccagaaaaauggaucuuggaagcucgaaaaagccagccugaucgaggugaagacaugcaccuggccuaagucccauacccuguggucuaacggcguccucgaaagcgacaugauuauccccaaaucccuggcggggccuauuagccagcacaaucaucgccccggauaucacacacaaaccgcuggcccuuggcaccuugggaagcuggagcucgauuuuaacuacugcgagggaacgacagugguuaucaccgaaaauuguggcacacggggccccucucugagaaccacaaccguguccgggaaacugauccaugaguggugcugucgcagcugcacgcuuccgccucuccgguauaugggagaagacggcuguugguacgggauggagauuagacccaucucugaaaaggaggagaacauggucaaaucccuggugagcgccggaucuggcaagguugauaauuucaccaugggggugcugugccucgccauucuguuugaagaggucaugcggggaaaguucggcaaaaagcacaugaucgcuggcguguucuuuacauucguucuucugcucagcgggcagauuaccuggcgcgacauggcccauacacugaucaugauuggauccaacgcgagcgauagaaugggcaugggggugaccuaucuggcucuuaucgccacguuuaaaauccagcccuuccuggcccucggauuuuuccugcggaagcucacaucuagagaaaaucugcuucugggcgucgggcucgcuauggccaccacacugcaacugccugaggacauugaacagauggcuaacggaaucgcccuuggccugauggcgcucaaacugauuacccaguuugagaccuaccagcucuggacagcccugaucucccuuacguguagcaauaccauguucacacugaccguggcuuggcgcacagccacccucauucuggcuggcgugucccugcuuccggucugccaaucuagcuccaugcggaagacggauuggcugcccauggccguugccgcuaugggggugccuccccucccucuguuuaucuucucucucaaggacacacugaaaagacgcagcuggccccuuaacgagggagugauggcggucggccugguguccauccuggccucuagccuccugagaaacgauguuccuauggcugggccccuuguggccggaggccugcucauugccuguuaugucaucaccgggaccuccgcugaccugacaguggaaaaggccgcggauauuaccugggaggaagaggcugaacagacaggaguuagccacaaucucaugaucacgguggacgacgauggcaccaugcggauuaaagacgaugagacagagaacauccugaccguccuucugaagacagcccugcucaucgugucuggcgucuuuccguacuccauuccugccacccugcuuguguggcauacguggcagaaacagacccaacgcagcgggguucugugggacgugcccucuccucccgaaacacagaaggcugagcucgaagagggagucuacagaaucaaacagcagggcauuuucgggaagacccaagugggaguuggcgugcagaaggagggggucuuucacacaauguggcacgugacccggggagccgugcugacauauaauggcaaacgccucgaaccgaacugggcguccguuaagaaagaucugaucagcuacggcgggggauggagacuuucugcucaguggcaaaagggcgaggaaguccaggugauugccguggagccugggaaaaaucccaagaacuuccagacgaugccuggaaccuuccagacaaccaccggcgaaaucggggccauugcucuggacuuuaagcccggaacauccggcagccccaucaucaaucgggagggcaaagucguggggcuguauggaaacggcguugugacgaagaaugggggauacgucuccggcauugcccaaaccaacgcugagccugaugggccgacacccgaacucgaggaagagauguucaaaaagcgcaaucugaccaucauggaccuucauccuggcagcggaaaaacaagaaaguaucugcccgccauugugcgggaagcgaucaagcgcagacuccggacccugauucucgccccuacgagaguuguggcugccgagauggaggaagcucugaaaggccuucccauccgcuaccagacaaccgccaccaagucugagcacacagggcgggaaaucgucgaucugaugugccaugccaccuuuacaaugagacugcucagcccugugcgcguuccgaacuauaaucugauuaucauggacgaggcucacuucaccgaucccgcguccauugccgcucggggauacaucucuacgagagugggcaugggggaagccgccgcuauuuuuaugacagccaccccucccggaacagcggacgcuuucccucagagcaacgcccccauccaggaugaggagcgcgacaucccggaacgguccuggaacucuggcaacgaguggauuaccgacuuugccgggaaaacggucugguucgugccuagcaucaaggcuggcaacgauauugccaauugucuucgcaaaaacggaaagaaggugauccaacuguccagaaaaaccuuugacacagaauaccagaagaccaaacucaaugauugggacuucgucguuacaaccgauauuucugagaugggcgcgaacuuuaaggccgaccgggugaucgaucccagacggugccugaaacccgugauucugacagacgggccugagcgcgucauccucgcuggacccaugccugugaccgccgcuagcgccgcucagagacggggccgcguugggagaaauccgcagaaggaaaacgaucaauauaucuucacgggacagccccuuaauaacgacgaggaucaugcccacuggacagaagcgaagaugcugcuggacaauauuaacaccccugagggcaucauucccgcccucuucgaaccugagcgggagaaauccgcugccaucgacggggaauacagacugaagggcgagagccgcaaaaccuuuguggaacuuaugcggagaggagaucugcccgucuggcucgcucacaagguggccucugagggcauuaaauauacagaccgcaaguggugcuucgaugggcagcggaauaaccagauccuggaagagaauauggacguugagaucuggaccaaagaaggagagaagaagaaacugagaccgcgcuggcucgaugcccggacauacuccgacccucuugcucugaaggaauuuaaagauuucgcggccggcagaaagagcauugcucuggaccucgugacggagaucgggcgcguccccucucaucuggcccacagaacccggaacgcccuugauaaucuggugaugcuccauacauccgaacacggaggccgcgcuuauagacacgccgucgaggagcugccugaaaccauggagacacugcuccuucugggccugaugauucuccugaccgggggagcgaugcuuuuucugaucagcggcaaagggauuggaaagacguccaucggccucaucugugugauugccucuagcgggaugcuguggauggcugaaaucccccugcaauggauugccuccgcuaucguucucgaguucuuuaugauggugcuucugauuccugagcccgaaaagcagcggaccccgcaggacaaccaacuggccuacguggucaucggcauucucacacuggcggccaucaucgcugccaaugagaugggccuucuggaaaccacaaaacgcgaucucggcaugagcaaggagccugggguugugucucccaccuccuaucuggacguggaucugcaucccgcuagcgccuggacgcucuacgcugucgccacaaccgugauuacaccuaugcuuagacacaccaucgaaaacucuaccgcgaacguuagccuggccgcuauugccaaucaggcugugguccugaugggacucgacaaaggcuggccgaucuccaagauggaccugggggugccccuucuggcccucggaugcuacucucaggucaacccucugacacugacggccgcggugcuccuucugauuacccauuaugcuaucaucggccccgggcugcaggccaaagcuacacgggaggcccaaaagagaaccgccgcuggaauuaugaagaauccuacaguugauggcaucaugaccauugaccucgaucccgugaucuacgacagcaaauucgagaagcagcugggccaggucaugcuucuggugcucugugccguucagcugcugcucaugcgcacguccugggcgcuuugcgaagcccugacacuggcuaccgggccuauuaccacacucugggagggaucuccgggcaaauuuuggaacaccacaaucgccgugagcauggcuaauaucuuccggggguccuaucuggccggagcgggccuugccuuuagcauuaugaagucugucgggacgggaaaaagaggcaccggcucccaaggggaaacacugggagagaaguggaagaaaaagcucaaccagcugagccgcaaagaguucgaucuguacaagaaauccggcaucaccgagguggaccggacagaggcuaaggaagggcucaaaagaggagagaccacgcaccaugccgugucucggggcagcgcuaaacuucagugguuuguugaacgcaauauggucauucccgaggggagagugaucgaucugggauguggccggggcgggugguccuauuacugcgccggacugaagaaagugaccgaaguccgcggcuauacaaaagggggaccuggccacgaggagcccguuccuaugucuaccuacggguggaacauugugaaacucaugagcggaaaggacguguucuaccugcccccggaaaaaugugauacacuucugugcgacaucggcgaguccagcccuucucccaccgucgaagaguccagaacaauucgggugcucaagaugguugagcccuggcugaagaauaaccaguucuguaucaaagugcugaauccuuauaugcccaccgucaucgaacaccucgagcgccuucaaagaaagcauggcgggaugcuggugcggaacccucugagccgcaauucuacgcacgaaauguacuggauuuccaacggaacaggcaauaucguugcuagcgugaacauggucucuagacuccugcuuaaccgguuuaccaugacccauagacgcccgacaauugagaaagauguggaccugggggccggaacgcggcacgugaaugcggaacccgagaccccuaacauggaugucaucggcgagagaauuaagcgcaucaaagaagaacacaauagcacauggcauuaugacgacgaaaaccccuacaagaccugggccuaucacggguccuacgagguuaaggcuacaggaucugccagcuccaugaucaauggcguggugaaacuccugaccaagccuugggaugucgugcccaugguuacacagauggcuaugaccgacacgaccccguucggccagcaacggguguuuaaagaaaaggucgauacaagaaccccucgcagcaugcccgggacacggagagugaugggaauuaccgccgaguggcuguggcgcacgcucggccggaacaaaaagccuagacugugcccccgcgaggaguucacaaagaaaguucggaccaaugccgcgaugggggcuguguuuacagaggaaaaccagugggacuccgccaaggccgcugucgaggaugaagacuucuggaaacuuguggauagagagcgcgagcugcauaagcucggaaaauguggcucuugcguuuauaauaugauggggaagagagagaagaagcugggcgaguuuggaaaggccaaaggcagccgggcuaucugguacauguggcuuggggcccgcuaccuggaguucgaggcgcucggauuucugaacgaggaccacugguucuccagagaaaauucuuauagcggcguggagggggaaggacugccuaagcucggcuacauucugcgggauaucuccaaaauucccgggggcgccauguaugcugacgauaccgccggaugggacacgagaaucaccgaggacgaucuucauaacgaagagaagaucccgcaccagauggacccugagcacucucggcuggcuaaugccauuuuuaaacucacauaccagaacaaggucgugaagguccaacgccccacccccacaggcaccgugauggauaucauuagcagaaaagcgcagcggggguccggacagguuggcacauaugggcugaauaccuucacgaacauggaagcccagcuuauccgccaaauggagggagaaggcgugcugagcaaggcugaccucgagaacccucaucugccggagaagaagauuacacaguggcuggagaccaaaggggucgagagacucaagcggauggccaucaccggcgaugacugcguggugaagcccaucgaugaccgcuuugcuaaugcccugcuugcucugaacgauaugggaaaaguuagaaaggacauuccucaguggcagcccucuaaaggcuggcacgauuggcaacaggugccuuucuguucccaucacuuccacgaacucaucaugaaggacgggcggaaacuggucgugcccugccgcccucaggaugagcuuauuggacgggcccggaucagccagggcgcgggguggucucugcgcgaaacagccugucucggaaaggcuuacgcccaaauguggucccugauguauuuucauagacgggaccugcgccucgccagcaaugcuauuugcucugccguucccgugcacugggucccgaccuccagaacaacguggagcauccaugcgcaccaucaguggaugaccacagaggacaugcugaccguguggaaccgggucuggauugaagauaauccuuggauggaggacaagacacccgugaccacgugggagaacguuccuuaccuuggcaaaagagaagaucaguggugugggucccugaucggccucaccagccgcgcuacaugggcccaaaauauccccaccgccauucaacaggugcggucucugaucggaaacgaggaguuccuugacuacaugccgagcaugaagagauuucgcaaagaggaggaauccgagggcgcuauuugguga

SEQ ID NO: 20459 - RNA, 9873 nt, Artificial Sequence
  derived and/or modified CDS sequence (opt5) from DENV-3__FJ898464__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaaccaucgccccggauaucacacacaaaccgcuggcccuuggcaccuugggaagcuggagcucgacuuuaauuacugcgagggaacgacagugguuaucaccgaaaacuguggcacacggggccccucucugagaaccacaaccguguccgggaaacugauccaugaguggugcugucgcagcugcacgcuuccgccucuccgguauaugggagaagauggcuguugguacgggauggagauuagacccaucucugaaaaggaggagaauauggucaaaucccuggugagcgccggaucuggcaagguugacaacuucaccaugggggugcugugccucgccauucuguuugaagaggucaugcggggaaaguucggcaaaaagcacaugaucgcuggcguguucuuuacauucguucuucugcucagcgggcagauuaccuggcgcgauauggcccauacacugaucaugauuggauccaaugcgagcgacagaaugggcaugggggugaccuaucuggcucuuaucgccacguuuaaaauccagcccuuccuggcccucggauuuuuccugcggaagcucacaucuagagaaaaccugcuucugggcgucgggcucgcuauggccaccacacugcaacugccugaggauauugaacagauggcuaauggaaucgcccuuggccugauggcgcucaaacugauuacccaguuugagaccuaccagcucuggacagcccugaucucccuuacguguagcaacaccauguucacacugaccguggcuuggcgcacagccacccucauucuggcuggcgugucccugcuuccggucugccaaucuagcuccaugcggaagacggacuggcugcccauggccguugccgcuaugggggugccuccccucccucuguuuaucuucucucucaaggauacacugaaaagacgcagcuggccccuuaaugagggagugauggcggucggccugguguccauccuggccucuagccuccugagaaacgacguuccuauggcugggccccuuguggccggaggccugcucauugccuguuaugucaucaccgggaccuccgcugaucugacaguggaaaaggccgcggacauuaccugggaggaagaggcugaacagacaggaguuagccacaaccucaugaucacgguggacgaugacggcaccaugcggauuaaagaugacgagacagagaauauccugaccguccuucugaagacagcccugcucaucgugucuggcgucuuuccguacuccauuccugccacccugcuuguguggcauacguggcagaaacagacccaacgcagcgggguucugugggaugugcccucuccucccgaaacacagaaggcugagcucgaagagggagucuacagaaucaaacagcagggcauuuucgggaagacccaagugggaguuggcgugcagaaggagggggucuuucacacaauguggcacgugacccggggagccgugcugacauauaacggcaaacgccucgaaccgaauugggcguccguuaagaaagaccugaucagcuacggcgggggauggagacuuucugcucaguggcaaaagggcgaggaaguccaggugauugccguggagccugggaaaaaccccaagaauuuccagacgaugccuggaaccuuccagacaaccaccggcgaaaucggggccauugcucuggauuuuaagcccggaacauccggcagccccaucaucaaccgggagggcaaagucguggggcuguauggaaauggcguugugacgaagaacgggggauacgucuccggcauugcccaaaccaaugcugagccugacgggccgacacccgaacucgaggaagagauguucaaaaagcgcaaccugaccaucauggaucuucauccuggcagcggaaaaacaagaaaguaucugcccgccauugugcgggaagcgaucaagcgcagacuccggacccugauucucgccccuacgagaguuguggcugccgagauggaggaagcucugaaaggccuucccauccgcuaccagacaaccgccaccaagucugagcacacagggcgggaaaucgucgaccugaugugccaugccaccuuuacaaugagacugcucagcccugugcgcguuccgaauuauaaccugauuaucauggaugaggcucacuucaccgaccccgcguccauugccgcucggggauacaucucuacgagagugggcaugggggaagccgccgcuauuuuuaugacagccaccccucccggaacagcggaugcuuucccucagagcaaugcccccauccaggacgaggagcgcgacaucccggaacgguccuggaacucuggcaaugaguggauuaccgauuuugccgggaaaacggucugguucgugccuagcaucaaggcuggcaacgacauugccaacugucuucgcaaaaauggaaagaaggugauccaacuguccagaaaaaccuuugauacagaauaccagaagaccaaacucaacgacugggauuucgucguuacaaccgacauuucugagaugggcgcgaauuuuaaggccgaucgggugaucgaccccagacggugccugaaacccgugauucugacagaugggccugagcgcgucauccucgcuggacccaugccugugaccgccgcuagcgccgcucagagacggggccgcguugggagaaacccgcagaaggaaaaugaccaauauaucuucacgggacagccccuuaacaaugaugaggaccaugcccacuggacagaagcgaagaugcugcuggacaacauuaauaccccugagggcaucauucccgcccucuucgaaccugagcgggagaaauccgcugccaucgauggggaauacagacugaagggcgagagccgcaaaaccuuuguggaacuuaugcggagaggagaccugcccgucuggcucgcucacaagguggccucugagggcauuaaauauacagaucgcaaguggugcuucgacgggcagcggaacaaucagauccuggaagagaacauggauguugagaucuggaccaaagaaggagagaagaagaaacugagaccgcgcuggcucgacgcccggacauacuccgauccucuugcucugaaggaauuuaaagacuucgcggccggcagaaagagcauugcucuggaucucgugacggagaucgggcgcguccccucucaucuggcccacagaacccggaaugcccuugacaaccuggugaugcuccauacauccgaacacggaggccgcgcuuauagacacgccgucgaggagcugccugaaaccauggagacacugcuccuucugggccugaugauucuccugaccgggggagcgaugcuuuuucugaucagcggcaaagggauuggaaagacguccaucggccucaucugugugauugccucuagcgggaugcuguggauggcugaaaucccccugcaauggauugccuccgcuaucguucucgaguucuuuaugauggugcuucugauuccugagcccgaaaagcagcggaccccgcaggauaaucaacuggccuacguggucaucggcauucucacacuggcggccaucaucgcugccaacgagaugggccuucuggaaaccacaaaacgcgaccucggcaugagcaaggagccugggguugugucucccaccuccuaucuggauguggaccugcaucccgcuagcgccuggacgcucuacgcugucgccacaaccgugauuacaccuaugcuuagacacaccaucgaaaauucuaccgcgaacguuagccuggccgcuauugccaaccaggcugugguccugaugggacucgacaaaggcuggccgaucuccaagauggaucugggggugccccuucuggcccucggaugcuacucucaggucaauccucugacacugacggccgcggugcuccuucugauuacccauuaugcuaucaucggccccgggcugcaggccaaagcuacacgggaggcccaaaagagaaccgccgcuggaauuaugaagaacccuacaguugacggcaucaugaccauugaucucgaccccgugaucuacgauagcaaauucgagaagcagcugggccaggucaugcuucuggugcucugugccguucagcugcugcucaugcgcacguccugggcgcuuugcgaagcccugacacuggcuaccgggccuauuaccacacucugggagggaucuccgggcaaauuuuggaauaccacaaucgccgugagcauggcuaacaucuuccggggguccuaucuggccggagcgggccuugccuuuagcauuaugaagucugucgggacgggaaaaagaggcaccggcucccaaggggaaacacugggagagaaguggaagaaaaagcucaaucagcugagccgcaaagaguucgaccuguacaagaaauccggcaucaccgagguggaucggacagaggcuaaggaagggcucaaaagaggagagaccacgcaccaugccgugucucggggcagcgcuaaacuucagugguuuguugaacgcaacauggucauucccgaggggagagugaucgaccugggauguggccggggcgggugguccuauuacugcgccggacugaagaaagugaccgaaguccgcggcuauacaaaagggggaccuggccacgaggagcccguuccuaugucuaccuacggguggaauauugugaaacucaugagcggaaaggauguguucuaccugcccccggaaaaaugugacacacuucugugcgauaucggcgaguccagcccuucucccaccgucgaagaguccagaacaauucgggugcucaagaugguugagcccuggcugaagaacaaucaguucuguaucaaagugcugaacccuuauaugcccaccgucaucgaacaccucgagcgccuucaaagaaagcauggcgggaugcuggugcggaauccucugagccgcaacucuacgcacgaaauguacuggauuuccaauggaacaggcaacaucguugcuagcgugaauauggucucuagacuccugcuuaaccgguuuaccaugacccauagacgcccgacaauugagaaagacguggaucugggggccggaacgcggcacgugaacgcggaacccgagaccccuaauauggacgucaucggcgagagaauuaagcgcaucaaagaagaacacaacagcacauggcauuaugacgaugaaaaucccuacaagaccugggccuaucacggguccuacgagguuaaggcuacaggaucugccagcuccaugaucaacggcguggugaaacuccugaccaagccuugggacgucgugcccaugguuacacagauggcuaugaccgauacgaccccguucggccagcaacggguguuuaaagaaaaggucgacacaagaaccccucgcagcaugcccgggacacggagagugaugggaauuaccgccgaguggcuguggcgcacgcucggccggaauaaaaagccuagacugugcacacgcgaggaguucaccaagaaaguucggacaaacgccgcgaugggggcuguguuuaccgaggaaaaucagugggauuccgccaaggccgcugucgaggacgaagauuucuggaaacuuguggacagagagcgcgagcugcauaagcucggaaaauguggcucuugcguuuauaacaugauggggaagagagagaagaagcugggcgaguuuggaaaggccaaaggcagccgggcuaucugguacauguggcuuggggcccgcuaccuggaguucgaggcgcucggauuucugaaugaggaucacugguucuccagagaaaacucuuauagcggcguggagggggaaggacugcauaagcucggcuacauucugcgggacaucuccaaaauucccgggggcgccauguaugcugaugacacggccggaugggacaccagaaucacagaggaugaccuucacaaugaagagaagaucacccagcagauggauccugagcaccggcaacuggcuaacgccauuuuuaaacucacauaccagaauaaggucgugaagguccagcgccccaccccgacaggcaccgugauggacaucauuucuagaaaagaucagcgggggagcggacaaguuggcacguaugggcugaacacauucaccaauauggaagcgcagcuuauccgccagauggagggagaaggcgugcuguccaaggccgaccucgagaacccucaucugcccgagaagaagauuacccaguggcuggagacaaaaggggucgagagacucaagcggauggcuaucagcggcgaugacugcguggugaagcccaucgaugaccgcuuugccaacgcucugcuugcccugaaugauaugggaaaaguuagaaaggacauuccucaauggcagccgucuaaaggcuggcacgauuggcaacaggugcccuucuguucccaucacuuccacgaacucaucaugaaggacgggcggaaacuggucgugccuugccgcccccaagacgagcuuauuggacgggcucggaucagccagggcgccggguggucucugcgcgaaaccgcgugucucggaaaggccuacgcucagauguggucccugauguauuuucauagacgggaucugcgccucgccagcaacgccauuugcucugcuguuccugugcacuggguccccacauccagaacgaccuggagcauccaugcccaccaucaauggaugacaaccgaggacaugcugacaguguggaaucgggucuggauugaagauaacccuuggauggaggacaagacccccgugacgaccugggagaauguuccguaccuuggcaaaagagaagaucaguggugugggucccugaucggccucacaagccgcgcgaccugggcucagaacaucccuacagccauucagcaagugcggucucugaucggaaaugaggaguuccuugacuacaugcccagcaugaagagauuucgcaaagaggaggaauccgagggcgccauuugguga

SEQ ID NO: 20460 - RNA, 9873 nt, Artificial Sequence
  derived and/or modified CDS sequence (opt5) from DENV-3__JQ922556__SS-prME
accagccugugccucaugaugauccugcccgccgcucuugccuuccaccugaccucccgggacggcgaaccucggaugauuguggggaagaacgaacgcggaaagucucuccuguuuaagacggcgagcggcaucaauauguguacccuuauugcuauggaucugggggaaaugugcgacgauaccgugaccuacaaauguccccauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcucccgccagaggggcuagacgcauggccauccuuggagacacggcguggguguucggcuccguugggggaguccucaacagccugggcaagauggugcaccagauuuuugggucugccuacacagcucuguucuccggcgugagcugggucaugaaaaucggaauuggcgugcuccugaccuggaucgggcuuaauucuaagaacaccagcauguccuuuucuugcauugccaucggaaucauuacacuguaucucggcgcuguugugcaggccgauauggggugugucaucaauuggaaaggaaaggagcugaagugcggcagcgggauuuucgugaccaacgagguucauacauggacggaacaguacaaauuucaagcggacuccccuaagcggcuggccaccgcuaucgccggcgcuugggagaauggaguguguggcauuagaagcacaacccgcauggaaaaccuucucuggaaacagaucgccaaugagcugaacuauauccugugggaaaauaacauuaagcucacagucgugguuggggauaccaucggagugcuggagcagggcaaacggacgcuuacaccccagccuauggagcugaaguacucuuggaaaacaugggggaaggccaagauugucaccgcugaaacacaaaacuccagcuucaucauugacggacccucuaccccggagugcccuuccgcgagcagagccuggaaugugugggaaguggaggauuauggcuuuggcgucuucacaaccaacaucuggcucaaacugcgcgaaguuuacacgcagaugugugaccaccggcugaugucccccgcugugaaggacgagagagccgugcacgccgauaugggguacuggaucgagucucagaaaaauggaagcuggaaacuugaaaaggcuucccucauugaggucaagacaugcaccuggccuaagucucauacccuguggagcaacggcgugcuggaauccgacaugaucauucccaaaagccucgccgggccuaucucucagcacaauuaucgccccggauaccauacacaaaccgcgggcccguggcaccuggggaaacuugagcuggauuuuaacuauugcgagggaacgacaguugugauuaccgaaaauuguggcacacggggcccuucccucagaaccacaaccgucagcgggaaacugauccacgaguggugcugucgcucuugcacgcugccgccccuucgguacaugggagaagacggcuguugguaugggauggagaucagaccuauuuccgaaaaggaggagaacauggugaaaagccucguuucugcuggaagcggcaagguggauaauuucaccauggggguccugugccuggccauccucuuugaagaggugaugcggggaaaguucggcaaaaagcauaugauugccggcguuuucuuuacauucgugcugcuucuguccgggcagaucaccuggcgcgacauggcucacacacucauuaugaucggaagcaacgccucugauagaaugggcaugggggucaccuaccuggcgcugauugcuacguuuaaaauccagccguuccuugcccugggauuuuuccuccggaagcugacauccagagaaaaucuccugcuuggcguggggcuggccauggcuaccacacuccaacugcccgaggacaucgaacagauggccaacggaauugcucugggccuuauggccuuuaaacugaucacccaguucgagaccuaucagcucuggacagcgcugauuagccucacguguuccaauaccaucuuuacacugaccguggccuggcgcacagcuacccuuauucuggccggcgucucucuccugccuguuugccaaagcuccucuaugcggaagacggauuggcugcccaugacaguggcugccaugggggugccuccccuuccucuguucaucuuuagccucaaggacacccugaaaagacgcuccuggccccucaacgagggagucauggccgugggccugguuucuauccuugcuagcucccugcugagaaaugaugugccgauggcggggccucucgucgccggaggccugcuuauugcuuguuacguggggaccggaacaagcgccgaccugaccguugaacaggccgcugaugugacaugggaggaagaggccgaacagacgggcgucucucauaaccucaugaucaccguggacgacgauggcacaaugcggauuaaggacgaugagaccgagaacauccugacaguccuccugaaaaccgcgcuucugauuguguccgggaucuuccccuacagcaucccugcuacgcugcucguuuggcacaccuggcagaagcaaacacagcgcucuggagugcugugggacguccccuccccgccugaaacccagaaagccgagcuugaagagggcguguauagaauuaagcagcaagggauccugggaaaaacacagguuggcguggggguccagaaggagggaguguuucauaccauguggcacgugacacggggcgccguucucacgcacaauggcaagcgccuggaacccaacugggcuagcgucaaaaaggaucucauuucuuacgggggaggcuggagacuguccccucaauggcagaaaggggaggaaguccaggugaucaccgucgagcccggaaagaaucccaaaaacuuccagacaaugccuggcaccuuccaaaccacaacgggggaaauuggagccaucgcgcuugacuuuaagccgggcaccagcggcucccccauuaucaaucgggaggggaaggugguuggacuguauggcaacgggguggucaccaagaauggaggcuacgugagcgggaucgcucagaccaacgccgagccugauggccccacaccugaacuggaggaagagauguucaagaaacgcaaucucaccauuauggaccugcaucccggaucuggcaagacgagaaaauaucuuccugccaucguucgggaagcuauuaaccgcagacugcggacacucauccuggccccgaccagaguggucgcugccgagauggaggaagcgcucaaggggcugcccauucgcuaccagaccacagccaccaagagcgagcacacaggacgggaaaucguggaucuuaugugccaugcuaccuuuacgaugagacugcuguccccuguucgcgugcccaauuauaaccucaucauuauggacgaggcccacuucacagauccugcuucuaucgccgcccggggcuacauuagcaccagagucgggaugggagaagcugcggccaucuuuaugacagcuacaccucccggcacggccgacgccuucccccaguccaaugcucccauucaagaugaggagcgcgacauccccgaacggucuuggaacagcgggaaugaguggaucaccgacuuugccggcaaaacagugugguucgugccuuccauuaaggcgggaaacgauaucgcuaacugucugcgcaaaaauggcaagaaagucauucagcuuucuagaaagaccuuugaaacagaguaccagaagaccaaacugaacgacugggauuucguugggacaaccgacaucagcgagaugggagccaauuuuaaggccgaucgggugauugaccccagacggugccucaaaccuggcauccugacggaugggccggaaggagugauucuggcuggccccaugccugucacagccgcguccgccgcucagcgcagagggcgggugggccgcaacccccaaaaggagaaugaccaguauaucuucaccggacagccucucaacaaugaugaagaccaugcccacuggaccgaggcuaaaaugcuucuggauaacaucaauacacccgaaggcauuaucccggcccuguucgagccugagagagaaaagagcgcugccauugacggggaguaccggcucaagggagaaucuagaaaaaccuuuguugagcugaugcgccggggcgaccuucccguguggcuggcgcacaaggucgccuccgaagggaucaaauauacagauagaaaguggugcuucgacggacagcgcaacaaucaaauucucgaggagaacauggauguggaaaucuggacgaaagagggcgaaaagaucaaacugcggccuagauggcuggacgcucgcaccuacagcgauccccucgcccuuaaggaguuuaaggacuucgcugccggccggaaaucuauugcccuggaucugguuacagaaaucgggagagugccuucccaucucgcucaccgcaccagaaaugcgcuggacaaccuugucaugcugcauacaagcgagcacggaggccgggccuaucgccacgcuguggaggaacuccccgagaccauggaaacgcugcugcuccuugggcugaugauucugcucaccggaggcgccaugcuguuucuuaucuccgggaagggaauuggcaaaacaucuaucggccugaucugugucauugccagcuccgggaugcucuggauggcugagaucccgcugcaguggauugccagcgcgaucgugcuggaguucuuuaugaugguucuccuuauuccugaacccgagaagcagagaacaccccaggauaaucagcuggccuacguggugaucgggauucugacacucgcugccaucaucgcugccaacgaaaugggccugcuugagaccacgaaacgggaccugggggucucuaaggaaccuggaguuguguccccgacaagcuaucucgauguggaccugcaucccgcgucugccuggacccuguacgcugucgccacaaccgugauuaccccuaugcuccgccacacaaucgagaauagcacggcuaacguuucccuugccgcuauugccaaccaggcggugguccugaugggccuggauaagggguggcccaucucuaaaauggaccucggagugccucugcuugcccugggcugcuacagccaggucaauccccucacccugacagcugccgugcugcuccuuauuacccauuaugcuaucaucggcccugggcugcaagccaaggccacaagagaggcgcagaaacggaccgcugccggaauuaugaagaacccgacgguugacggcaucauuacaaucgaucuggaccccgugauuuacgauuccaaauucgaaaagcagcucgggcaggucaugcugcuugugcugugugcuguucaacuccugcugaugagaaccucuugggcccucugcgaggcccuuacccuggcuacaggaccuaucaccacacugugggaaggcagccccgggaaguuuuggaauacgaccaucgccguguccauggcgaacauuuuccgcggaagcuaucucgccggcgcuggccuggccuuuucuaucaugaaauccgucgggacaggaaagcggggcaccgggagccagggagagacacuuggcgaaaaauggaagaaaaagcugaaucagcucuccagaaaggaguucgaccuguacaaaaagucugggauuaccgagguggaucgcacggaagcuaaagagggacugaagcggggcgaacucacccaccaugccgugagcagaggcuccgcgaaacuucagugguuuguugagcggaacauggucaucccugaagggcgcgugauugaccugggauguggcagagggggauggucuuauuacugcgccggccugaagaaagugacagagguccggggguauaccaagggaggccccggccacgaggaaccgguuccuaugagcacauacggguggaauaucgugaagcucauguccggaaaagauguguucuaccugccgcccgagaagugugacacccuucugugcgauauuggcgaaagcucuccuucccccacagucgaggagagccgcaccaucagagugcucaaaaugguugaaccuuggcugaagaacaaucaauucuguaucaaagugcugaacccguauaugcccgcugucauugagcaccucgaacggcuucagcgcaagcaugggggaaugcuggugagaaauccucugucucggaacuccacgcacgagauguacuggaucagcaauggcacagggaacauuguuucuagcgugaauauggucucccgccuccugcuuaacagauuuaccaugacccaucggagacccacaaucgaaaaggacguggaucugggagccggcacgcgccacgugaacgcugagccugagacccccaauauggacgucauuggcgaacggaucaaaagaaucaaggaggaacacaacucuacauggcauuaugaugacgagaauccguacaaaaccugggccuaucacgggagcuacgaaguuaaggcuacaggauccggcagcuccaugauuaacgggguggugaaacuccugaccaagccuugggacgucgugcccaugguuacacagauggccaugaccgauacgaccccuuucggacaacagcgcguguuuaaggagaaagucgacacacggacccccagaccuaugcccggcacacgcaaggugauggagaucaccgcggaauggcuguggcggacgcucgggagaaauaaacgcccgcggcugugcacaagagaggaguucaccaagaaaguucgcacaaacgccgcuaugggcgccguguuuaccgaggaaaaucagugggauucugcuaaggccgccgucgaggacgaggaguucuggaaacuuguggaucgggagagagaacugcauaaacucggaaaguguggcagcugcguuuauaacaugaugggaggacgcgagaaaaagcugggcgaguuugggaaagcgaagggauccagagcuauuugguacauguggcuuggcgcccgguaccuggaguucgaggcccucggguuucugaaugaagaccacugguucucucgcgagaacagcuauuccggcguggaaggagagggccugcauaaacucggguacauccugagagauauuucuaagaucccuggaggcgcuauguaugccgacgauacggcugggugggacacccggaucacagaggaugaccuucacaaugaagagaagauuacccagcaaauggaccccgaacacagacugcucgccaacgcgaucuuuaaacugacauaccagaauaaggucgugaaaguccagcggcccaccccuacaggaaccgugauggauauuaucagccgcaaggaccagagaggcuccgggcaaguuggcacguauggacuuaacacauucaccaauauggaggcccagcuggugcggcagauggaaggcgaggggguccucagcaaagcugaucuggagaacccgcaucugcccgaaaagaagauuacccaguggcucgagacaaaaggaguggaacgccugaagagaauggccaucucuggcgacgauugcgugguuaaaccuaucgacgaucgguuugcuaacgcccuucuggcgcucaaugacauggggaaggugcgcaaagauauuccccaauggcagccuuccaagggauggcacgacuggcagcagguccccuucuguagccaucacuuccacgagcugaucaugaaggauggcagaaaacuugugguuccuugccggccccaagacgaacugauugggcgcgccagaaucucucagggcgcuggauggucccuccgggagaccgccugucugggcaaggcuuacgcccagauguggagccugauguauuuucaucgcagagaucuccggcuggcuucuaacgccauuugcuccgcggugccgguccacugggugacaacgagccgcaccacaugguccauccaugcccaccaucaauggaugaccacagaggacaugcuuaccgucuggaauagaguguggauugaagacaacccuuggauggaggauaaaacgcccguuaccacaugggaaaaugugccuuaccuggggaagcgggaggaccagugguguggaagccucaucggccugaccucuagagcuacaugggcccagaacauccccaccgccauucagcaaguccgcagccuuaucgggaaugaggaguuccuggauuacaugccguccaugaaacgguuuagaaaggaggaagagucugaaggagcuauuugguga

SEQ ID NO: 20461 - RNA, 9873 nt, Artificial Sequence
  derived and/or modified CDS sequence (opt5) from DENV-3__JQ922557__SS-prME
accagccugugccucaugaugauccugcccgccgcucuugccuuccaccugacauccagagacggagagccucggaugauuguggggaagaacgaacgcggaaagucucuccuguuuaagacggcgagcggaaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaagguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaacgccucagcggggcuaccuggguggaugugguccuggagcacggaggcugcguuaccacaauggccaagaauaagcccacgcuggacauugagcuccagaagaccgaagcuacacaacuggccacccuuagaaaacuguguaucgaggggaagauuacaaacaucaccacggauucccggugcccuacacagggagaagcggugcucccggaggaacaggaccagaauuauguguguaaacacaccuacgucgaucgcggcuggggcaacgggugcggacuguucggcaaggggagccuugugaccugcgccaaguuucaaugucuggagcccauugagggaaaaguugugcaguaugaaaaucucaaguacacagucaucaucaccgugcauacaggcgaccagcaccagguugggaacgagacgcaaggagugaccgcugaaauuacaccucaggccucuaccacagaggcuauccugcccgaauauggcacccugggccucgagugcuccccuagaacggggcuggacuucaaugagaugauucuucugaccaugaaaaacaaggccuggaugguccaucggcagugguuuuucgaucucccccugccguggacaagcggagccaccacagaaaccccuacguggaaucgcaaagagcuucuggugacauuuaagaacgcucacgcgaaaaagcaagaagucgugguucucggcucucaggagggggccaugcacaccgcucugacaggagccaccgaaauccaaaauuccggcgggaccagcauuuucgccggccaucugaaguguagacucaaaauggacaagcuggagcuuaaaggaaugucuuacgcuaugugcacaaacacguuugugcugaagaaagaggucuccgaaacccagcacggcacaauccucaucaagguggaguacaagggggaagaugcccccuguaaaauuccuuucagcaccgaggacggacaaggcaaggcgcauaacgggcggcugaucacagcuaaucccguugugaccaaaaaggaggaacccgucaacauugaggccgaaccuccguucggagaguccaauaucgugauuggcaucggggauaacgcccugaaaaucaauugguauaagaagggcucuagcauuggaaaaauguuugaagcuacggccagaggcgcucgccggauggccauccuuggggacacagcgugggauuucggauccgugggcgggguucucaacagccugggaaagaugguccaccagauuuuuggcucugccuacaccgcucuguucuccggggugagcugggugaugaaaaucggcauuggaguccuccugaccuggaucggccuuaauucuaagaacacaagcauguccuuuucuugcauugccaucgggaucauuacccuguaucucggagcugugguucaggccgacaugggcugugugaucaauuggaaagggaaggagcugaagugcggaagcggcauuuucgucacaaacgaggugcauacguggaccgaacaguacaaauuucaagcggauucccccaagagacuggccacagcuaucgccggggcuugggagaauggcguuuguggcauucgcagcaccacacggauggaaaaccuucucuggaaacagaucgccaaugagcugaacuauauccugugggaaaauaacauuaagcucaccguggucgugggcgacacgaucgggguucuggagcagggaaaaagaacccuuacaccucagcccauggagcugaaguacucuuggaaaaccuggggcaaggccaagauugugacagcugaaacccaaaacuccagcuucaucauugaugggccuaauacacccgagugcccgucugcgucccgcgccuggaacgucugggaaguggaggacuauggauuuggcguguucaccacgaauaucuggcucaaacugcgggaagucuacacacagaugugugaccacagacugaugagcgcugccguuaaggaugagcgcgccgugcacgcugacaugggcuacuggaucgagucccagaaaaacgggucuuggaaacuugaaaaagccagccucauugaggugaagaccugcaccuggccuaagucccauacacuguggucuaauggaguccuggaaagcgauaugaucauucccaaaucccucgcgggcccuaucagccagcacaacuaucggcccggguaccauacccaaacggcuggaccuuggcaccugggcaaacuugagcuggacuuuaauuauugcgaggggacaaccgugguuauuacagaaaacuguggaaccagaggccccucucuccgcacaaccacgguguccggcaaacugauccacgaguggugcugucggagcugcacccugccgccucuuagauacaugggggaagauggauguugguauggcauggagauccggcccauuucugaaaaggaggagaauauggucaaaucccucgugagcgccgggaagucuaagcgcgacaacagcacaaugggaguucugugccuggccauccucuucgaagaggugaugagaggcaaauuugggaagaaacauaugauugcuggagucuucuucaccuuugugcugcuucuguccggccagaucacauggcgggauauggcccacacccucauuaugaucggcagcaaugcgucugacagaauggggaugggaguuacguaccuggcucugauugccacauucaagauccagcccuuucuugcccugggcuucuuucuccgcaaacugaccucccgggaaaaccucaugcugggggugggacuugcuauggccacaacccugcaacucccugaggauaucgaacagauggcuaauggcauugcccuggggcugauggcgcuuaagcugaucacccaguucgagacauaucagcucuggacggcccugauuagccucaccuguuccaacacaaucuuuacccugacagucgcuuggagaaccgccacgcuuauucuggcuggagugucucuccugccggugugccaaagcuccucuaugcgcaagacagacuggcugcccaugaccgucgccgccaugggcguuccuccccuuccucuguucaucuuuagccucaaagauacccugaagagacgguccuggccccucaaugagggcgugauggcuguggggcuggucucuauccuugcgagcucccugcugcgcaacgacgugccuauggccggaccccucguugcuggcgggcugcuuauugccuguuacgugaucacaggaaccagcgccgaucugacagucgaaaaagcugccgacgugacgugggaggaagaggcggaacagaccggcguuucucauaaccuccugauuacaguggacgauaaugggaccaugagaaucaaggacgaugagacagagauuauccucaccguccugcuuaaaacggcucugcagaucguguccggaauuuucccguacagcaucccugccacccugcucgucuggcacacauggcagaagcaaacccagcggucuggcgugcugugggacguucccuccccucccgaaacacagaaagccgagcuugaagagggcguguaucgcauuaagcagcaagggauccugggaaagacccaggucggcguggggguucagaaagagggaguguuucauacaauguggcacgucacgagaggcgcugugcucacccacaacgggaagcggcuggaaccgaauugggccagcgugaaaaaggaucucauuucuuacggaggcggcuggcgccuguccgcgcaauggcagaaaggggaggaaguucaggucaucgcuguggagccuggaaagaaccccaagaauuuccagacaaugccuggcaccuuucaaaccacaacgggggaaauuggagccaucgcccuugacuucaaacccggcaccagcgggucccccaucauuaacagagagggaaagguggucggccuguauggcaauggggugguuaccaagaauggagauuaccugagcggcaucgcucagaccaaugccgagccuuaugggccgucucccgaccucgaagaggaaauguucaagaaacggaagcugacaauuauggaucuucauccuggaagcggccagacccugaaguaccuccccgcuaucgugcgcgacgccauuaaaagacggcugagaauccucauccuggcgccuacgcgcgucguggccgcugagauggaagaggcccuuaaggggcugcccauucgguaucagacaaccgcuaccaaauccgagcacacaggcagagaaaucguugaucugaugugccaugccaccuuuacaaugcgccuccugucuccugugcgggucccgaacuacaaucuuauuaucauggacgaggcccacuucaccgaucccgcuagcauugcggccagaggauacaucuccacgcgcgugggcaugggggaagcugccgccaucuuuaugacagcuaccccucccggaacagccgacgcguucccucaaucuaacgcucccauucaggacgccgagcgggauaucccggaaagaagcuggaacuccggcaacgaguggauuaccgacuuugccgggaagacgguuugguucgugccuucuaucaaagcuggaaaugauauugccaacugucugcgcaagaacggcaagaaagucauccagcucagccggaagaccuuugagacagaauaucagaaaaccaagcugaaugacugggauuucguggugacaaccgacauuuccgagaugggggcgaacuuuaaagccgauagagucaucgacccccggcgcugccugaagcccguuauccucacagauggcccuaagagagugauucuugcuggacccaugccugacaccgccgcuagcgccgcucaacggcgcggcagaguggggcggaauccgcagaaagaaaacgaucaguacaucuuccccggacagccucugaauacggacgaggaccaugcccacuggcccgagacaaagcugcucauggaucuguuuaccaccccugaaggcauucuucccucucacuucgacccgcauggggagaacuucccugaaaucuccggagaguauagacugaaaggcgaaagccgcaagacauuugucgagcucaugcggagaggggaucugcccguguggcuggcgcacaaaguugccucugagggcauuaaguacaccgaccgcaaauggugcuucgauggacaacggaauaaccagauccucgaagagaauauggacguggaaaucuggacaaaggagggcgaaaagaagaaacuuagaccucgcuggcuggaugcucggacguauuccgacccccuggcccucaaagaguuuaaagauuucgcugccgggagaaaaagcauugcccuggaccuugucaccgagaucggacgcgugccuucccaucuggcucacagaacacggaacgcgcucgauaaucugguuaugcugcacaccucugaacauggcgggcgcgccuacagacacgcuguggaggaacuccccgagacaauggaaacccuucugcugcucggacugaugauucuucugacgggcggcgccaugcucuuucugaucagcgggaagggaauuggcaagaccuccaucgggcugaucugugucauugccagcucuggaaugcucuggauggcugagaucccgcuucaguggauugccuccgcgaucgugcuggaguucuuuaugaugguccugcucauuccugaacccgagaaacaacggacaccccaggacaaccagcuggccuaugugguuaucggcauucuuacccuggcugccaucaucgcugccaaugaaauggggcuccuggagacaaccaagcgcgaucugggaaugagcaaagagccuggcguggugucuccgacgagcuaccucgacgucgacucccaucccgcgucugccuggacacuuuacgcuguugccaccacagugauuaccccuaugcugagacacaccaucgaaaacagcacagcuaaugugucccuggccgcuauugccaaccaggcggucgugcucaugggccuggauaagggguggcccaucucuaaaauggaccuuggaguuccucugcucgcccugggcugcuauagccaagugaauccccugacgcucaccgcugccguccuucugcugauuacacauuacgcuaucaucgggccuggacuccaggccaaggccacccgggaggcgcagaagagaacagcugccggcauuaugaaaaacccgaccguggaugggaucauuacgaucgaccuggaucccgucauuuaugacuccaaguucgaaaaacagcuuggacaagugaugcugcucguucugugugcugugcagcugcuccuuaugcgcacaagcugggcccugugcgaggcccugacccucgcuaccggcccuaugacaacccugugggaaggcucucccgggaagaucuggaacacaacgaucgccgucuccauggcgaauauuuuucggggaagcuaccuugccggcgcugggcuggccuucuccaucaugaaaucugugggaaccggcaagagagggacaggaagccagggcgagacccucggcgagaaguggaaaaagaaacugaaccagcugucccgcaaggaauuugaucucuauaaaaagucugggauuacagagguugaccggaccgaagcuaaagagggacuuaagagaggcgaaacgacccaccacgccgugagccggggguccgcgaagcugcaaugguucgucgagcgcaauauggugaucccugagggaagagugauugaucugggcugugggcggggaggcuggagcuacuauugcgccggccucaaaaagguuacagaaguccgcggguacaccaaaggaggccccgggcaugaggaaccggugccuaugucuacauacggauggaacaucgugaagcugauguccggcaaagacgucuuuuaucuuccgcccgagaagugugauacccugcucugcgacauuggggaaagcucuccuucccccacaguugaggagagcagaaccauccgggugcugaagaugguggaaccuuggcugaaaaauaaccaguucuguaucaagguccucaauccguacaugcccgcugugauugagcaccuugaacgccugcagagaaaacauggaggcaugcugguucggaacccucucucucgcaauagcacgcacgagaugcacuggaucuccaacggcacagggaauauugugucuagcgucaacaugguguccagacugcuucugaaucgguucaccaugacccauagacgccccacaaucgagaaggauguugaccucggagccggcacgcggcacgugaacgcugaaccugagacccccaauauggacgucauuggggaaagaaucaaacgcaucaaggaggaacauaacagcacauggcacuaugaugacgagaacccguacaagaccugggccuaucauggauccuacgaggugaaagcuacaggcucugccagcuccaugauuaaugggguggucaagcugcugaccaaaccuugggauguugugcccauggugacacaaauggcgaugaccgacacgaccccuuuuggacagcagcgggucuucaaggaaaaaguggauacaagaacaccccgcccuaugcccggcacacggaagguuauggagaucaccgccgaauggcucuggagaacgcugggccgcaacaagcggccgagacuuugcacacgcgaggaauuuaccaaaaaggugcggacaaaugcugccaugggggcugucuucaccgaggagaaccagugggacucugccaaagccgcgguggaagaugaggaauuuuggaagcugguugacagagagcgcgaacuccacaaacugggaaaguguggcagcugcguguauaauaugauggggaaaagagagaagaaacuuggagaguucggcaaagcuaaggggucccgggccauuugguacauguggcugggcgcccgcuaccucgaauuugaggcucugggauuccugaacgaagaucacugguuuucuagagagaauagcuauuccggcgucgagggggaaggacuccauaaacugggcuacauccuucgggacauuagcaagaucccugggggagccauguaugcugaugacacggccggcugggacaccagaaucacagaggaugaccugcacaacgaagagaaaauuacccaacagauggaucccgaacaucggcuccuggcgaaugccaucuucaaacuuacauaccagaacaaggugguuaaagugcagcgccccaccccuacagggaccgucauggacauuaucucuagaaaggaucaacggggcuccggacaggugggcacguaugggcugaauacauuuaccaacauggaggcucagcucguccgccagauggagggagaaggcgugcugagcaaagccgaccuggagaauccgcaccuccccgaaaagaaaauuacccaauggcuggagacaaaggggguugaaagacuuaagcggauggcuaucucuggagaugacugcguggucaaaccuaucgaugaccgcuucgccaacgcgcugcucgcccugaaugauaugggcaaggugagaaaagacauuccccaguggcagccuuccaagggguggcacgauuggcagcaagugcccuuuuguagccaucacuuccaugagcuuaucaugaaagacggccggaagcugguugugccuugccgcccccaggacgagcucauuggccgggcucggaucucucagggcgccggguggucccugcgcgaaaccgcuugucugggaaaggccuacgcucaaauguggagccucauguauuuccacagacgggaucugcgccuugccuccaacgcgauuugcagcgccgucccggugcauuggguuccuacaucuagaacgaccuggagcauccacgcucaccaucaguggaugacaaccgaggacaugcugacaguguggaaccgggucuggauugaagauaaucccuggauggaggacaaaaccccugugacgaccugggaaaacccucccuaccucggcaagagagaggaucagugguguggguccaucaucggacugucuagccgcgccacaugggcccagaauauucccaccgcuauccaacagguccggucccuuauuggcaacgaggaauuucuggacuacaugcccucuaugaaaagauuccgcaaggaggaagagagcgagggggccaucugguga

SEQ ID NO: 20462 - RNA, 9873 nt, Artificial Sequence
  derived and/or modified CDS sequence (opt5) from DENV-3__JQ922555__SS-prME
accagccucugccucaugaugauccugcccgccgcucuugccuuccaccugacaucccgggacggcgaaccucggaugauuguggggaagaaugaacgcggaaaaucucuccuguuuaagacggcgagcggcaucaauauguguacccuuauugcuauggaucugggggagaugugcgacgauaccgucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagucuauugagggcaaaguugugcaguaugaaaaucucaaguacacagucaucaucaccgugcauacaggggaccagcaccagguuggaaacgagacgcaaggcgugaccgcugaaauuacaccccaggccuccaccgcugaggccauccugccugaauauggcacacuggggcucgagugcagcccccgcaccggacuggacuucaaugagaugauucuucugacgaugaaaaacaaggccuggaugggccauagacagaugcucuuugaucugccuacccccuggacaucugggaccacaaccgaaacguccgcuuggaaucggaaagagccguucgucacauuuaagaacgcgcacaccaaaaagcaagaaguggucgugcuuggaagccaggagggcgccaugcacacagcucugaccggggccaccgaaauccaaaauucuggcggaacauccauuuucgccggccaucucaagugucgccugaaaauggacaagcuggagcucaaagggaugagcuacgcuaugugcacgaacaccuuuguucugaagaaagagguguccgaaacacagcacggaaccauccuugucaagguggaguacaagggcgaagaugccccuuguaaaauccccuucucuacagaggacgggcaaggaaaggcgcauaacggcagacugauuaccgcuaauccuguugugacgaaaaaggaggaacccgucaacaucgaggccgaacccccuuucggggagagcaauauugugaucggcauuggagauaaagcccucaagaucaacugguaucggaagggcuccagcaucgggaaaauguuugaagcuacaucuagaggagcccgccggauggcuauucugggcgacaccgccugggauuucggguccgugggaggcguucugaauagccuugggaagaugguccaccagaucuuuggcucugcguacaccgcccucuucagcggaguguccugggugaugaaaauuggcaucgggguccugcugacauggauuggacucaacucuaagaauaccagcauguccuuuagcugcaucgcuauuggcaucaucacacuguaucuuggggccgugguucaggcugacaugggaugugugauuaacuggaaaggcaaggagcugaagugcgggucuggcaucuucgucacgaaugaggugcauaccuggacagaacaguacaaauuucaagccgauuccccgaagagacucgcgaccgccauugcuggagccugggagaacggcguuugugggauccgcagcacaacccggauggaaaaucugcuguggaaacagauugcuaacgagcuuaauuauauccucugggaaaacaauaucaagcugacgguggucgugggagacaccauuggcguucuggagcaggggaaaagaacacucacaccccagccuauggagcugaaguacucuuggaaaacauggggaaaggccaagaucgugaccgccgaaacacaaaacuccagcuucauuaucgauggccccaacaccccugagugccccuccgcuucucgcgcguggaaugucugggaaguggaggacuauggcuuugggguguucacgacaaacauuuggcuuaaacugcgggaagucuacacccagaucugugaccacagacucaugagcgccgcuguuaaggaugagcgcgccgugcacgccgacaugggauacuggaucgagucccagaaaaauggcucuuggaagcuggaaaaagcuagccugauugaggugaagaccuccacauggcccaagagccauacccuuuggucuaacgggguccaggaauccgauaugaucauuccuaaaagccucgccggacccaucucucaacacaauuaucggccuggcuaccauacgcagacagcggggcccuggcaccugggaaagcuggagcucgacuuuaacuauugcgagggcaccacagugguuauuaccgaaaauugcggcacaagagggccuucccugcgcaccacgaccgugagcggaaaacuuauccacgagugguguugccggucuuguacacugcccccgcucagauacaugggcgaagaugggugcugguauggaauggagauccggccuauuagcgaaaaggaggagaacauggucaaaucccuggcuagcgccggcucugggaagguggacaauuucaccaugggaguucugugucuugccauccucuuugaagaggugaugcgcggcaaguucggcaaaaagcauaugauugcugggguccuguucacauuugugcugcuccuguccggacagaucaccuggagagauauggcccggacgcuuauuaugaucggcagcaacgcguccgacagaauggggaugggaguuacauaccuggcucucauugccaccuucaaaauccaacccuuucuggcccugggcuucuuucuucgcaagcugacaucucgggaaaaucuccugcucggggugggacuggcuauggccaccacccuucagcugcccgaggauaucgaacagauggcuaacggcauugcccucggccugauggcgcugaaacuuaucacacaguucgagacguaucaacuguggaccgcccucgucagccugacaugcuccaauaccauuuuuacacucaccguggcuuggagaacggccacacugauccuugcuggggugucucugcucccugucugucagagcuccucuaugcgcaagaccgacuggcugccgaugaccguugccgccaugggagugcccccucugccccuuuucauuuuuagccugaaggauacacucaaaagacgguccuggccucugaacgagggcgugauggcugucgggcucgugagcauccuggcgucuucccuucugcgcaauggaguucccauggccggcccucugguggcugggggacuccugaucgccugcuacgucauuaccggcacaagcgccgaccuuacgguggaaaaggcugccgauguuaccugggaggaagaggcggaacagacaggcgugucucacaaccugaugaucaccgucgacgacgaugggacaaugagaauuaaagacgaugagaccgagaacauccucacggugcugcucaagaccgcucugcuuauugucuccggaaucuuccccuacagcaucccggccacacugcugguguggcauaccuggcagaaacaaacacagcggucuggcguucucugggacgugccuagcccgccugaaacccagaaggccgagcuggaagagggggucuaucgcauuaaacagcaaggaaucuuuggcaagacacagguggggguuggagugcagaaggagggcgucuuccacacgauguggcaugugaccagaggcgcugugcuuacacacaaugggaaacggcuggaacccaacugggccagcguuaagaaagaucucauuuccuacggaggcggguggcgccugagcgcgcaauggcagaagggagaggaaguccaggugaucgcuguggagccgggcaaaaauccuaagaacuuucagaccaugcccgggaccuuccaaacaacgucuggagaaauuggcgccaucgcccucgacuucaagccuggcaccagcgggucccccauuaucaauagagagggaaaagucgugggccuguaugggaacggaguugugacaaagaauggcggguacgucucuggcaucgcucagaccaacgccgagcccgauggaccuacaccggaacuugaggaagagauguuuaaaaagcggaaucugaccauuauggaccugcaccccggcagcgggaaaacgcgcaaguaucucccugcuaucgugagagaagccauuaagcggagacugcgcacacuuauccuggcgcccacccggguuguggccgcugagauggaggaagcccucaaaggacugccuauuagauaccagaccacagcuaccaaguccgagcauacaggccgcgaaaucgucgaucucaugugucacgccaccuucacgaugcggcugcuuucucccgugagaguuccuaacuauaaucugaucauuauggacgaggcccauuuuacagauccggcuagcaucgcggcccgcggguacauuuccacccgggugggaaugggcgaagcugccgccaucuucaugacagcuacacccccugggacggccgacgcguuuccccagucuaacgcuccuauucaagaugaggagagagacauccccgaacgcagcuggaacuccggcaacgaguggaucaccgacuucgccggaaaaacagucugguuugugccgagcauuaaggccggcaaugauaucgcuaacugccugcggaaaaacgggaagaaggugauucagcucucuagaaaaaccuucgacacagaauaccagaagaccaaacugaaugauugggacuuugucguuacaaccgauaucuccgagaugggagccaacuucaaggcggaccgggugauugauccucgcagaugucuuaaacccgugauccugacggacggccccgagcgggucauucucgccgggccuaugcccgugacagcugccagcgcugcccagcgcagaggacggguuggcagaaauccucaaaaggaaaacgaucaguauaucuuuaccgggcagccgcugaauaacgacgaggaucacgcucauuggaccgacgccaagaugcugcucgaaaauaucaacacacccgagggcauuaucccugcgcuuuucgaacccgagcgcgagaaaucugccggacuggacggcgaauaccggcugaagggggaguccagaaaaaccuucguggaacucaugcgccggggagaucugccugucuggcuugcucacaagguggccagcgagggcauucuguauacagacagaaaauggugcuuugaugggcagcgcaauaaccaaauccucgaagagaauauggacguugagauuuggacgaaggaaggagagaaaaagaagcugcggcccagauggcuggaugcucgcaccuacuccgacccgcucgcccuuaaagaguucaaggauuuugccgcuggcagaaaaucuaucgcgcuggaccuggugacagagaucggccgggucagcucccaccucgcccaucgcaccagaaacgcucuggauaauaagaugaugcuucacacaagcgaauaugggggacgggccuaccgccaugccguggaggagcugccugaaaccauggagacgcuccugcugcucggccuuaugauucugcugaccgggggagcuaugcuguuccugaucucuggcaaagggauuggaaagacauccaucggccuuauuugcgucaucgccagcucuggcaugcuguggauggcggacgugccccuccaguggaucgccagcgcuauuguucuggaauuuuucaugauggugcugcucaucccugagcccgagaagcagagaaccccucaagauaaccagcuugccuauguggucauugggauccugacacuggcugccauuaucgcggccaaugaaaugggacuccuggagaccacgaaacgggaccuuggcguuuccaaggaacccgggguggugucuccgacaagcuaccuggaugucgaccuccacccugcuuccgccuggacccuguacgcuguggccacaaccguuauugcucccaugcugagacacaccaucgagaacucuacagccaaugugagcauggcggccaucgcuaaccaggccgucgugcucaugggacuugacaaaggcuggcccauuuccaagauggaucugggggucccucugcucgcucugggauguuauuuuuacgugaacccgcuuacgcugaccgccgccguuuuccuccuggugacacauuaugcgaucauuggccccggccugcaggcuaaagccacccgcgaagcucacaagaagacagccgccgggaucaugaauccucccccuggagacggcauuaugaccaucgaucucgaccccgucaucuacgauagcaaauuugagaagcaacuuggacaggugaugcugcugguucucugcgcugugcagcugcuucugaugcggacgucuugggcccucugugaggcgcugacacuggccaccggaccuaccacaacccucugggaaggcuccccggggaaauucuggaacacaacgauugcugucagcauggccaauaucuuuagaggauccuaucuugcuggcgccggccuggcguucucuauuaugaaguccguggggaccggaaaacgcggcacagggucccagggagagacccugggcgaaaaguggaagaaaaagcucaaccaacugucucggaaagaguuugaccuuuacaagaaaagcgggaucacagaaguggauagaaccgaggccaaggagggacugaaacggggcgaaauuacgcaucacgcuguuucccgcggcagcgccaagcuccagugguucgucgagagaaauauggugauccccgaagggcgggugaucgaccugggaugcggcaaaggcggguggucuuauuacugugcugggcugaaaaaggucaccgagguucgcggguacacaaaaggaggcccuggccaugaagaacccgugccuauguccaccuauggguggaacauugugaagcucaugagcggaaaagaugucuucuaccuucccccggagaagugcgacacacugcugugugauaucggcgaaucuuccccuagccccaccguggaggaaucuagaacaauucggguucucaagaugguggagcccuggcugaaaaauaaccaguuuugcaucaagguccuuaauccuuauaugcccaccgugauugagcaccuggaacgccuccagagaaaacacgggggaaugcugguucggaacccucugagccgcaauuccagaaacgagauguacuggaucucuaauggcacggggaacauugugagcuccgucaauauggugagccggcuccuucugaacagauucacaaugacccaucgccggccgaccaucgaaaaggacguggaucugggagccggcacaagacacgucaacgcugagcccgaaacgccuaauauggacguuaucggcgagcgcauuaaacggaucaaggaggaacauaacuccaccuggcacuaugacgaugagaaucccuacaagacaugggccuaucacgggucuuacgaagugaaagcgaccggaagcgccuccucuaugauuaacggcguggucaagcuccugacaaaaccuugggacgugguucccauggugacccaaauggcuaugacagauaccacgccguuugggcagcagagagucuucaaggagaaaguggacacccgcacaccucggcuuaugcccagaacccgcaagguuauggaaaucacagccgaguggcuguggcggacccucggaagaaauaagcgcccucggcuguguacgagagaggaauuuaccaagaaggugcgccccauugcugccaugggcgccgucuucacccaaagagaucagugggacagcgcgaaagcugccguggaggaugaagaguuuuggaagccuguugaccgggaaugcaacucccaucagcuggggaaauguggcucuugcguguacaauaugaugggaaagcgcgagaaaaagcucggcgaguucgggaaggccaaaggaagcagagcuaucugguauauguggcugggcgcccgguaccuugaauuugaggcucugggguuccucaacgaagaucacugguuuuccagagagaauagcuauucuggagucgagggcgaagggcugcauaaacuuggcuacauccugcgggacauuuccaaaauccccggaggcgccauguaugcggaugacacagccgggugggacacccgcaacacggaggaugaccuccacaugaaggagaagauuacccagcaaaugggaccgggccauagcagacuggcuaaugccaucuucaagcugacauaccagaacaagguggucaaagugcagcggccuacccccacagggaccguuauggauauuaucucucgcaaggaccagagaggauccggccaaguggggacauauggccucaauaccuuuacgaacauggaggcucagcugguccggcagauggaaggagagggcgugcuuagcaaagccgaucuggagaauccccaccuccuggaaaagaaaaucacacaguggcuugagaccaaggggguggaacgccugaagagaauggcgauuucuggagacgauugcguugugaaaccuaucgacgaucgguucgccaacgcucuccuggcccugaacgacaugggcaagguccgcaaagauauuccgcaauggcagcccuccaagggguggcacgacuggcaacaggugccuuucuguagccaucacuuucaugagcucaucaugaaagauggaagaaagcugguugugcccugccggccucaagacgaacuuauuggccgcgcuagaaucucccagggggccggcuggagccugcgggagaccgcuugucucggaaaggccuacgcgcagauguggucucugauguacuuccaccgcagagaccuucggcuggccagcaaugcuaucugcuccgccguccccgugcacugggucccuacaucuagaaccacauggagcauucaugcccaccaucaauggaugacgaccgaggauaugcucacaguguggaaccgcguuuggaucgaagacaaucccuggauggaggauaaaaccccggugacaaccugggaaaacgucccuuaucugggcaagcgggaggaccaguggugugggucccugauuggacucacgucuagagcuaccugggcccagaauauccccacagcgauucagcaagugcgcagccugaucggcaacgaagaguuucuugauuacaugccuuccaugaaacgguucagaaaggaggaagagucugaaggggcuauuugguga

SEQ ID NO: 20463 - RNA, 9873 nt, Artificial Sequence
  derived and/or modified CDS sequence (opt5) from DENV-3__GU131903__SS-prME
accucccugugccugaugaugaugcugcccgccacccuugcuuuccaccugacgucccgggacggcgaaccucggaugaucguggggaagaacgaacgcgggaaaucucuccuguuuaagaccgccagcggcauuaauauguguacacuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucagcacgaaaaccugaaguauaccgugauuaucacaguccauacgggggaccagcaccaggugggaaaugacacccaaggcguuacaguggagaucaccccucaggcuuccacagucgaagccgugcugcccgaguacggcacccucgggcuggaaugcagcccucgcacgggacuugauuucaacgagaugauucugcucaccaugaaaaauaaggcuuggaugguccauagacagugguuuuucgaccugccccuuccguggacaucuggcgccaccacagagaccccuacguggaaccggaaagaacugcucgugacauuuaagaaugcccacgcuaaaaagcaagagguugugguccuggggucccaggaaggagcgaugcacaccgcccugacaggcgcuaccgagauccagaacagcgggggcaccucuauuuucgccggacaucucaagugucgccugaaaauggauaaacuugaacugaaaggcauguccuaugccaugugccucaauacauuugugcugaagaaagagguuagcgagacgcagcacgggaccauccugauuaagguggaauacaagggagaggacgcucccuguaaaaucccuuucuccacagaagauggccaagggaaggcccauucuggaagacuuaucaccgcgaaccccgucgugaccaagaaagaggagcccgugaacauugaagcugagccuccguucggcgaaagcaauaucguuauugggaucggcgacaaagcccucaagauuaacugguacaagaaaggauccagcaucggcaagauguuugaggccaccgcuagaggggccagacgcauggcuauccugggagauacggccugggacuucggcucugucgggggagugcucaauucccucggcaaaauggugcaccagauuuuugggagcgcguauacagcccuguucucuggcgucagcuggaucaugaagauuggaaucggcgugcuucugaccuggauugggcucaacuccaaaaauaccucuaugagcuuuuccugcaucguuauuggaaucaucacacuguaccugggcgcugugguccaggccgauauggggugugugauuaacuggaagggaaaggaacuuaaaugcggcagcgggaucuucguuaccaaugaggugcauacauggacggagcaguauaaguuucaagcugacucucccaaacggcucgccaccgcgauugccggcgcuugggaaaacggagucuguggcaucagauccacaacccgcauggagaaucugcuguggaagcagauugccaacgaacucaauuacauccugugggagaacaauaucaaacuuacagugguugugggggauauuaucggaguccuggaacagggcaagcggacccucacgccucagcccauggagcugaaauauagcuggaagaccugggggaaggcuaaaauugugacagccgagacccaaaacucuuccuucaucauugacggaccuaauacacccgaaugcccgaacgccagcagagcuuggaacgugugggaggucgaagacuacggcuuuggcguuuucaccacaaauaucuggcugaaacuucgcgagguguauacccaguccugugaucaccggcucaugucugcggccaucaaagacgaaagagcugugcacgccgauaugggguacuggauugagagccagaagaacggauccuggaaacuggagaaggccucuuuuaucgaagucaagacgugcacauggccuaaaagccauacccugugguccaauggcgugcucgagagcgacaugauuauccccaagucucuggcugggccuauuucccagcacaaccaucgccccggauaccacacccaaacagccggcccuuggcaccuugggaaacuggaacucgauuucaauuauugcgagggaaccacgguugugaucacagagaacuguggcacccggggccccagccugagaacaaccacagucucugggaagcugauccaugaauggugcugucgcuccugcacccuuccgccucuccgguacaugggagaggacggcuguugguaugggauggaaauuagacccaucaaugagaaagaagagaacaugguuaagagccuggugucugcgggaagcggcaagguggauaauuuuacgauggggguccugugccucgcuauucuguucgaggaagugaugcggggaaaauucggcaagaaacacaugaucgccggcguucuuuuuaccuucgugcugcuccuguccgggcagauuacauggcgcgacauggcccauacccugaucaugauuggaagcaacgcuucugauagaaugggcaugggggucacauaccuugcccugaucgcgaccuuuaagauccagcccuuccucgcucugggauuuuuccuccggaaacugacguccagagagaaucuucugcucggcguggggcuggccauggccacaacccugcaacuuccugaagacauugagcagauggcuaacggaaucgcccugggccucaugacacugaagcucauuacccaguuugaaaccuaucagcuguggacagcucuugugagccugacguguuccaauaccaucuucacacucaccgucgccuggcgcacagcgacccugauucuggccggcguuucucuucugccgcucugccaaagcuccucuaugcggaagacggauuggcugcccaugacaguggcugccaugggggugccuccccucccucuguuuaucuucagccuuaaagacacccccaagagacgcuccuggccucugaacgagggagucauggcugugggccugguuucuauccucgccagcucccugcuuagaaaugaugugcccauggccgggccgcuggucgcuggaggccuccugauugcguguuacgugaucaccgggacaagcgccgaccucaccguugagaaagcugccgacgugacaugggaagaggaagccgagcagacgggagucucucacaaccugaugauuaccguggaugacgauggcacaaugcggaucaaggacgaugaaaccgagaacauucuuacaguccugcugaaaaccgcucuccugaucguguccggcaucuuuccuuauagcauucccgccacgcuucugguuuggcauaccuggcagaagcagacacaacgcucuggggugcucugggacgucccuucucccccggagacccagaaagcggaacuggaggaaggaguguacagaaucaagcagcagggcauuuucgggaagacacaaguuggagugggcguccagaaagaggggguguuucacaccauguggcacgugacacggggagcuguucucacgcauaauggcaagcgccuggagccuaacugggccagcgucaaaaaggaucuuaucagcuacggcgggggauggagacugaaugcccaguggcaaaaaggcgaagagguccaggugauugcugucgaacccgggaagaacccuaagaauuuccagaccaugcccggaaucuuccagacaaccaccggcgagauuggggccaucgcgcuggacuuuaaacccggaacauccggcagcccuaucauuaaccgggaaggcaaggugguugggcucuauggaaauggcguggucacgaaaaacgggggauacguguccggcaucgcucaaaccaaugccgagccggaugggcccacaccugagcuggaagaggaaauguucaagaaacgcaaccuuaccauuauggaccugcaccccggcagcggaaagacaagaaaguaucucccugccaucguucgggaggcuauuaaacgcagacugcggacccucauccuggcccccacgagaguggucgcugccgaaauggaggaggcgcuuaagggccugccuauccgcuaccagacaaccgccaccaaaucugaacauacagggcgggagauuguggaucugaugugccacgcuaccuuuacaaugagacuccugagcccgguucgcgugcccaauuauaaccuugucaucauggacgaagcccauuucaccgauccugcuuccauugccgcccggggauacaucucuacgagagugggcaugggggaggcugcggccauuuuuaugacagcuacacccccuggaacagccgaagccuucccccagagcaaugcuccgauccaggacgaggagcgcgacaucccugaacgguccuggaacucuggcaaugaguggauuaccgauuuuguggggaagacggucugguucguucccagcaucaaagccggcaacgacauugcgaacugucugagaaagaauggaaagaaagugauccaacucucccgcaagaccuuugauacagaauaucagaaaacccggcugaacgacugggauuucguggucacaaccgacauuucugagaugggcgcuaauuuuaaggccgauagagugaucgacccccggcgcugccugaaaccuguuauucucacagaugggcccgagagagugauccuugccggaccuaugccggucaccgcugccagcgcggcccagcggcgcggcagaguggggcggaacccccagaaggaaaaugaccaauacaucuucacgggacagccucugaacaaugaugaggaccacgcucacuggacagaagccaagaugcugcucgacaacauuaauacccccgagggcaucauuccugcucuguucgaacccgagagagagaaauccgccgcuaucgauggggaauaccgccuuaagggcgagagccggaaaaccuuuguugaacugaugagacgcggagaccucccgguguggcuggcccauaaggucgcgucugagggcauuaaauauacagaucggaaguggugcuucgacggggaaagaaacaaucagauccuggaggagaacauggauguggaaaucuggaccaaagagggagaacgcaagaagcuccggccuagauggcuugacgcccgcacauacuccgauccccuggcucugaaagaguuuaaggacuucgccgcuggcagaaaaagcauugcccucgaucuggucacggaaaucgggcgggugccuucucaccuugcccaucgcaccagaaaugcucuggacaaccucguuaugcugcacacauccgagcacggaggccgggcguaucgccaugccguggaggaacugcccgagaccauggaaacacuccuucugcugggccucaugauucugcuuaccgggggagcuaugcuguuucucaucagcggcaaggggauuggaaaaacguccaucggccugaucugugugauugucucuagcgggaugcuguggauggccgauguuccucuccaguggaucgccuccgcuauugugcuugaguucuuuaugauggugcugcugauccccgagccggaaaagcaaagaaccccucaggacaaucagcucgccuacgucgugauuggaauccugacacuugcggccauuguugcugccaacgagaugggccugcucgaaaccacaaagcgggaucugggcaugagcaaagagcccgggguggucucucccaccuccuaucuggacguggaccuccacccugcuagcgccuggacgcuuuacgcggucgccacaaccgugaucacaccgaugcugagacauaccaucgaaaauucuaccgcuaacguuagccuggccgcuauugccaaccaagcugugguccucaugggacuggauaagggcuggcccaucuccaaaauggaccuuggggugccucugcucgcccugggaugcuauucucagguuaauccccugacacucacggcggccgugcuucugcuggucacccacuacgcuauuaucggcccugggcuccaggccaaggcuacacgcgaggcccagaaacggaccgccgcgggaauuaugaagaaccccacaguggauggcaucaugaccaucgaccuggauccugugauuuacgacagcaaguucgagaaacaacuuggccagguuaugcugcucguccugugugcugugcagcugcuccuuaugagaacguccugggcccugugcgaagcucugacacucgccaccgggccgaucaccacacugugggagggaucucccggcaaguuuuggaauaccacaauugccgugagcauggcuaacaucuuccgcggguccuaucuugccggagcgggccuggccuuuagcauuaugaaaucugucgggacgggacggagaggcaccggcucccagggggaaacacucggagagaaguggaaaaagaagcugaaucaacugagccggaaagaguucgaucucuacaagaaauccggcaucaccgagguugaccgcacagaggcuaaggaagggcuuaaaagaggagagaccacgcaucacgccgugucucggggcagcgcuaagcugcagugguuuguggaacgcaacauggucaucccugaggggagagugauugaucugggauguggccggggcgggugguccuauuacugcgccggacucaaaaagguuaccgaagugcgcggcuauacaaaggcggggcccggacacgaggagccuguccccaugucuaccuacggcuggaauaucgugaaacugaugagcgggaaggacguuuucuaucuuccgccugaaaaaugugauacacugcucugcgacauuggagaguccagccccucucccaccguggaagaguccagaacaauccggguccugaagaugguggagccuuggcugcgcaacaaucaguucuguauuaaagugcucaaccccuacauggccaccggcaucgaacaucuugagagacugcagcggaaguacggcgggaugcuggucagaaauccucucagccgcaacucuacgcacgaaauggauuggauuuccaauggaacaggcaacaucguuagcucugugaauauggugagccggcugcuucugaacagauuuaccaugacccaucgccggccgacaaucgagaaggacgucgaccucggggcuggaacgagacacgugaacgccgaacccgagaccccuaauauggauguuauuggcgagcgcaucaaacggauuaaggaagaacacuccucuacauggcauuaugacgaugaaaaccccuacaaaaccugggcuuaucacgggagcuacgaggugaaggccacaggauccgcuagcuccaugaucaauggcgucgugaaacugcugaccaagccuugggacguugugcccauggucacacaaauggccaugaccgauacgaccccguucggccagcagagaguguuuaaggaaaaaguugacacacgcaccccucggcccaugccugggacaagaaaggugauggagauuaccgcggaguggcucuggcgcacgcugggacggaacaaaaagcccagacuuugcacacgcgaagaguucaccaaaaaggucagaacaaaugccgcuaugggcgccguguuuaccgaagagaaccaaugggauucugcucgggccgccgucgaagacgaggaguucuggaagcugguggaucgcgaaagagagcuccauaaacuggggaaguguggaagcugcguuuauaauaugaugggcaaacgggaaaagaaacuuggggaguuuggcaaggcgaaaggauccagagcuaucugguacauguggcugggcgcccgguaucucgaguucgaagcccugggguuucugaacgaggaccacugguucucucgcgaaaauagcuacuccggaguggagggcgaagggcuccauaagcugggauacauccuuagagauauuucuaagaucccuggcggggcuauguaugccgacgacacggcuggcugggauacccggauuacagaggacgaucugcacaacgaggagaagaucacccagcagauggaccccgagcaccgccagcucgccaaugcgauuuuuaagcugacauaccaaaacaaagucgugaaggugcagagaccgaccccuaaaggaacaguuauggauaucaucagccggaaggaccagcgcggcuccggacaggugggaaccuauggccuuaauacguucacaaacauggaagcccaacuggucagacagauggagggggaaggagugcucagcaaggcugaucuggagaauccccaucugcucgagaaaaagauuacccaguggcuggaaaccaaaggcguugagcggcuuaagcgcauggccaucucuggggacgauugcguggucaaacccauugacgauagauuugcuaacgcccugcucgcgcugaacgacaugggcaaggugcggaaggauaucccucaguggcaaccguccaaaggauggcacgacuggcagcagguccccuucuguagccaucacuuccacgaacuuauuaugaaggacggccgcaaacuggugguuccuugcagaccccaggaugagcucaucgggcgggcccgcaucucucaaggagcuggcuggucccugaaggaaacagccugucuggggaaggcuuacgcccagauguggagccucauguauuuucauagacgggaccugagacuugcuucuaaugccauuugcuccgcggugccuguccacuggauccccaccagccgcacaacgugguccauucaugcccaccaucaguggaugaccacagaggauaugcugaccguguggaaccggguuuggaucgaggacaauccuuggauggaagauaagacacccgugaccacgugggaggacgucccguaccucggaaagagagaagaucaaugguguggcagccugauugggcuuaccucucgcgcuacaugggcccagaacauccugaccgccauucaacaggugcggagccucaucggcgacgaggaguuccuggauuauaugccuuccaugaaaagauuucgcaaggaagaggaaucugagggagcuaucugguga

SEQ ID NO: 20464 - RNA, 9873 nt, Artificial Sequence
  derived and/or modified CDS sequence (opt5) from DENV-3__GU131904__SS-prME
accagccugugccucaugaugaugcugcccgccacccuugcuuuccaccugacgucccgggacggcgagccucggaugaucguggggaagaacgaacgcggaaagucucuccuguuuaagaccgccagcggcauuaauauguguacacuuaucgcgauggaucugggggagaugugcgacgauaccgugacauacaaguguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcuccgggaucuucguuaccaacgaggugcacacauggacggagcaguacaaguuucaagcugacagccccaaacggcucgccaccgcgauugccggcgcuugggaaaauggagucuguggcaucagaucuacaacccgcauggagaaccugcuguggaagcagauugccaaugaacucaacuauauccugugggaaaauagcaucaaacuuacagugguugugggggauauuaucggaguccuggaacagggcaagcggacccucacgccucagcccauggagcugaaauacagcuggaagaccugggggaaggcuaaaauugugacagccgagacccaaaacucuuccuucaucauugacggaccuaauacacccgaaugcccgagcgccuccagagcuuggaacgugugggaggucgaagacuauggcuuuggcguuuucaccacaaacaucuggcugaaacuucgcgagguguacacccagucuugugaucaucggcucaugagcgcggccaucaaagacgaaagagcugugcacgccgauaugggguacuggauugagucccagaagaauggaucuuggaaacuggagaaggccagcuuuaucgaagucaagacgugcacauggccuaaaucccacacccuguggagcaacggcgugcucgagucugacaugauuauccccaagucccuggcugggccuauuagccagcauaaucaccgccccggauaucauacccaaacagccggcccuuggcaccuugggaaacuggaacucgauuucaacuacugcgagggaaccacgguugugaucacagagaauuguggcacccggggccccucucugagaacaaccacagucuccgggaagcugauccacgaauggugcugucgcagcugcacccuuccgccucuccgguauaugggagaggacggcuguugguacgggauggaaauuagacccaucaacgagaaagaagagaauauggugaagucucugguuagcgcgggauccggcaagguggauaacuuuacgauggggguccugugccucgcuauucuguucgaggaagugaugcggggaaaauucggcaagaaacauaugaucgccggcguucuuuuuaccuucgugcugcuccugagcgggcagauuacauggcgcgacauggcccacacccugaucaugauuggaucuaaugcuuccgauagaaugggcaugggggucacauaucuugcccugaucgcgaccuuuaagauccagcccuuccucgcucugggauuuuuccuccggaaacugacgagcagagagaaccuucugcucggcguggggcuggccauggccacaacccugcaacuuccugaagacauugagcagauggcuaauggaaucgcccugggccucaugacacugaagcucauuacccaguuugaaaccuaccagcuguggacagcucuugugucccugacguguucuaacaccaucuucacacucaccgucgccuggcgcacagcgacccugauucuggccggcguuagccuucugccgcucugccaauccucuagcaugcggaagacggauuggcugcccaugacaguggcugccaugggggugccuccccucccucuguuuaucuucucccuuaaagacacccccaagagacgcucuuggccucugaaugagggagucauggcugugggccugguuagcauccucgccuccagccugcuuagaaacgaugugcccauggccgggccgcuggucgcuggaggccuccugauugcguguuaugugaucaccgggacaucugccgaccucaccguugagaaagcugccgacgugacaugggaagaggaagccgagcagacgggagucucccauaaucugaugauuaccguggaugacgauggcacaaugcggaucaaggacgaugaaaccgagaacauucuuacaguccugcugaaaaccgcucuccugaucgugagcggcaucuuuccuuacucuauucccgccacgcuucugguuuggcacaccuggcagaagcagacacaacgcuccggggugcucugggacgucccuucucccccggagacccagaaagcggaacuggaggaaggaguguacagaaucaagcagcagggcauuuucgggaagacacaaguuggagugggcguccagaaagaggggguguuucauaccauguggcacgugacacggggagcuguucucacgcacaacggcaagcgccuggagccuaauugggccuccgucaaaaaggaucuuaucuccuauggcgggggauggagacugagcgcccaguggcaaaaaggcgaagagguccaggugauugcugucgaacccgggaagaacccuaagaauuuccagaccaugcccggaaucuuccagacaaccaccggcgagauuggggccaucgcgcuggacuuuaaacccggaacauccggcagcccuaucauuaaccgggaaggcaaggugguugggcucuacggaaauggcguggucacgaaaaacgggggauaugugucuggcaucgcucaaaccaaugccgagccggaugggcccacaccugagcuggaagaggaaauguucaagaaacgcaaccuuaccauuauggaccugcaucccggcagcggaaagacaagaaaguaccucccugccaucguucgggaggcuauuaaacgcagacugcggacccucauccuggcccccacgagaguggucgcugccgaaauggaggaggcgcuuaagggccugccuauccgcuaucagacaaccgccaccaaauccgaacacacagggcgggagauuguggaucugaugugccaugcuaccuuuacaaugagacuccugucuccgguucgcgugcccaauuacaaccuugucaucauggacgaagcccacuucaccgauccugcuagcauugccgcccggggauauaucuccacgagagugggcaugggggaggcugcggccauuuuuaugacagcuacacccccuggaacagccgaagccuucccccagucuaaugcuccgauccaggacgaggagcgcgacaucccugaacggagcuggaacuccggcaaugaguggauuaccgauuuuguggggaagacggucugguucguucccucuaucaaagccggcaacgacauugcgaauugucugagaaagaacggaaagaaagugauccaacucagccgcaagaccuuugauacagaauaccagaaaacccggcugaacgacugggauuucguggucacaaccgacauuuccgagaugggcgcuaauuuuaaggccgauagagugaucgacccccggcgcugccugaaaccuguuauucucacagaugggcccgagagagugauccuugccggaccuaugccggucaccgcugccagcgcggcccagcggcgcggcagaguggggcggaacccccagaaggaaaaugaccaauacaucuucacgggacagccucugaacaaugaugaggaccaugcucacuggacagaagccaagaugcugcucgacaacauuaauacccccgagggcaucauuccugcucuguucgaacccgagagagagaaaucugccgcuaucgauggggaauaucgccuuaagggcgagucccggaaaaccuuuguugaacugaugagacgcggagaccucccgguguggcuggcccacaaggucgcgagcgagggcauuaaauacacagaucggaaguggugcuucgacggggaaagaaacaaucagauccuggaggagaacauggauguggaaaucuggaccaaagagggagaacgcaagaagcuccggccuagauggcuugacgcccgcacauauucugauccccuggcucugaaagaguuuaaggacuucgccgcuggcagaaaauccauugcccucgaucuggucacggaaaucgggcgggugccuagccaucuugcccaccgcaccagaaaugcucuggacaaccucguuaugcugcauacauccgagcacggaggccgggcguaccgccacgccguggaggaacugcccgagaccauggaaacacuccuucugcugggccucaugauucugcuuaccgggggagcuaugcuguuucucaucucuggcaaggggauuggaaaaacgagcaucggccugaucugugugauugccuccagcgggaugcuguggauggccgaugucccucuccaguggaucgcuucugccauuguucuugaguucuuuaugauggugcugcugauccccgagccggaaaagcaaagaaccccucaggacaaucagcucgcguauguggucauuggaauccugacacuugccgcuauuguggccgcuaacgagaugggccugcucgaaaccacaaagcgggaucugggcauguccaaagagcccgggguugugagccccaccucuuaccuggacgucgaccuccauccugccagcgcguggacgcuuuaugccguggcuacaaccgucaucacaccgaugcugagacacaccaucgaaaauuccaccgccaacgugucucuggcugccauugcuaaucaagccguugugcucaugggacuggauaagggcuggcccaucagcaaaauggaccuuggggucccucugcucgcgcugggaugcuacucccaggugaacccccugacacucacggccgcuguucuucugcuggugacccauuacgccauuaucggcccugggcuccaggcuaaggccacacgcgaggcccagaaacggaccgcggcuggaauuaugaagaaccccacagucgauggcaucaugaccaucgaccuggauccugugauuuaugacucuaaguucgagaaacaacuuggccaggugaugcugcucguucugugugccguccagcugcuccuuaugagaacgagcugggcucugugcgaagcccugacacucgccaccgggccgaucaccacacugugggagggaucccccggcaaguuuuggaauaccacaauugcugugagcauggccaacaucuuccgcgggucuuaccuugcgggagccggccuggcuuuuuccauuaugaaaagcguggggacgggacggagaggcaccggcucccagggggaaacacucggagagaaguggaaaaagaagcugaaucaacugucucggaaagaguucgaucucuauaagaaaagcggcaucaccgaggucgaccgcacagaggccaaggaagggcuuaaaagaggagagaccacgcaccaugcuguuucccggggcucugccaagcugcagugguuuguggaacgcaacauggugaucccugaggggagagucauugaucugggauguggccggggcggguggagcuacuauugcgcgggacuccgcaaagugaccgaaguuagaggcuacacaaaaggcgggcccgggcacgaggagccugugcccauguccaccuauggguggaauaucgucaagcugaugagcggaaaagacguguucuaccuuccgccugaaaagugugauacacugcucugcgacauuggcgagucuucccccagccccaccguugaagagucucggacaauccgcgugcugaaaauggucgagccuuggcugagaaacaaucaguucuguauuaaggugcucaaccccuacaugccuaccgugaucgaacaccuugagcggcugcagagaaaauauggcgggaugcugguccgcaauccgcucucccggaacagcacgcaugaaauguacuggauuucuaauggaacaggcaacaucguuagcuccgugaauauggugucuagacugcuucugaaccgcuuuaccaugacccaccggagacccacaaucgagaaggaugucgaccucggggccggaacgcgccaugugaaugcugaaccugagacccccaacauggacguuauuggcgagcggaucaagagaauuaaagaagaacacagcuccacauggcacuaugaugacgaaaacccuuacaagaccugggccuaucaugggagcuacgaggugaaagcuacaggauccgccucuagcaugaucaauggcgucgugaagcugcugaccaaacccugggauguugugccgauggucacacaaauggcuaugaccgacacgaccccuuucggccagcagcgcguguuuaaggaaaagguugauacacggacccccagaccuauggccgggacacgcaaagugauggagauuaccgcggaguggcucuggcggacgcugggaagaaacaagaaaccccgccuuugcacaagagaagaguucaccaagaaaguccggacaaaugccgcuaugggcgccguguuuaccgaagagaaccaaugggacuccgcucgcgccgccgucgaagaugaggaguucuggaagcugguggacagagaacgggagcuccacaagcuggggaaauguggaucuugcguuuauaauaugaugggcaagagagagaagaaacuuggggaguuuggcaaagcgaagggaagccgggcuaucugguacauguggcugggcgcccgcuaccucgaguucgaagcccugggguuucugaacgaggaucauugguucuccagagaaaauucuuauagcggaguggagggcgaagggcuccacaaacugggauacauccuucgggacauuuccaagaucccuggcggggcuauguaugccgaugacacggcuggcugggacacccgcauuacagaggaugaccugcauaacgaggaaaagaucacccagcagauggaucccgagcacagacagcucgccaaugcgauuuuuaaacugacauaccaaaacaaggucgugaaagugcagcggccgaccccuaagggaacaguuauggacaucaucagccgcaaagaucagagaggcucuggacaggugggaaccuauggccuuaauacguucacaaacauggaagcccaacugguccggcagauggagggggaaggagugcucuccaaggcugaccuggagaauccccaucugcucgagaagaaaauuacccaguggcuggaaaccaagggcguugagcgccuuaaaagaauggccaucagcggggaugacugcguggucaagcccauugaugaccgguuugcuaacgcccugcucgcgcugaaugauaugggcaaagugcgcaaggacaucccucaguggcaaccgucuaagggauggcaugauuggcagcagguccccuucuguucccaccauuuccacgaacuuauuaugaaagacggcagaaagcuggugguuccuugccggccccaggacgagcucaucgggcgcgccagaaucagccaaggagcuggcuggucucugaaagaaacagccugucuggggaaggcuuacgcccagauguggucccucauguauuuucaccggagagaucugcgccuugcuagcaacgccauuugcuccgcggugccuguccauuggauccccaccagccggacaacguggucuauucacgcccaucaccaguggaugaccacagaggacaugcugaccguguggaacagaguuuggaucgaggauaauccuuggauggaagacaaaacacccgugaccacgugggaggaugucccguaccucggaaagcgcgaagaccaaugguguggcagccugauugggcuuaccucccgggcuacaugggcccagaacauccugaccgccauucaacaggugagaucucucaucggcgaugaggaguuccuggacuacaugccuagcaugaagcgcuuucggaaagaagaggaauccgagggagcuaucugguga

SEQ ID NO: 20465 - RNA, 9873 nt, Artificial Sequence
  derived and/or modified CDS sequence (opt5) from DENV-3__GU131906__SS-prME
accagccugugccucaugaugaugcugcccgccacccuugcuuuccaccugacgucccgggacggcgagccucggaugaucguggggaagaacgaacgcggaaagucucuccuguuuaagaccgccagcggcauuaauauguguacacuuaucgcgauggaucugggggagaugugcgacgauaccgugacauacaaguguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauacccggacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcuccgggaucuucguuaccaacgaggugcacacauggacggagcaguacaaguuucaagcugacagccccaaacggcucgccaccgcgauugccggcgcuugggaaaauggagucuguggcaucagaucuacaacccgcauggagaaccugcuguggaagcagauugccaaugaacucaacuauauccugugggagaauaacaucaaacuuacagugguugugggggauauuaucggaguccuggaacagggcaagcggacccucacgccucagcccauggagcugaaauacuccuggaagaccugggggaaggcuaaaauugugacagccgagacccaaaauagcucuuucaucauugacggaccuaacacacccgaaugcccguccgccagcagagcuuggaacgugugggaggucgaagacuauggcuuuggcguuuucaccacaaauaucuggcugaaacuucgcgagguguacacccaguccugugaucaucggcucaugucugcggccaucaaagacgaaagagcugugcacgccgauaugggguacuggauugagagccagaagaacggauccuggaaacuggagaaggccucuuuuaucgaagucaagacgugcacauggccuaaaagccacacccugugguccaauggcgugcucgagagcgacaugauuauccccaagucucuggcugggccuauuucccagcauaaccaccgccccggauaucauacccaaacagccggcccuuggcaccuugggaaacuggaacucgauuucaauuacugcgagggaaccacgguugugaucacagagaacuguggcacccggggccccagccugagaacaaccacagucucugggaagcugauccacgaauggugcugucgcuccugcacccuuccgccucuccgguauaugggagaggacggcuguugguacgggauggaaauuagacccaucaaugagaaagaagagaacaugguuaagagccuggugucugcgggaagcggcaagguggauaauuuuacgauggggguccugugccucgcuauucuguucgaggaagugaugcggggaaaauucggcaagaaacauaugaucgccggcguucuuuuuaccuucgugcugcuccuguccgggcagauuacauggcgcgacauggcccacacccugaucaugauuggaagcaacgcuucugauagaaugggcaugggggucacauaucuugcccugaucgcgaccuuuaagauccagcccuuccucgcucugggauuuuuccuccggaaacugacguccagagagaaucuucugcucggcguggggcuggccauggccacaacccugcaacuuccugaagacauugagcagauggcuaacggaaucgcccugggccucaugacacugaagcucauuacccaguuugaaaccuaccagcuguggacagcucuugugagccugacguguuccaauaccaucuucacacucaccgucgccuggcgcacagcgacccugauucuggccggcguuucucuucugccgcucugccaaagcuccucuaugcggaagacggauuggcugcccaugacaguggcugccaugggggugccuccccucccucuguuuaucuucagccuuaaagacacccccagacgcagauccuggccucugaacgagggagucauggcugugggccugguuucuauccucgccagcucccugcuucggaaugaugugcccauggccgggccgcuggucgcuggaggccuccugauugcguguuaugugaucaccgggacaagcgccgaccucaccguugagaaggcugccgacgugacaugggaagaggaagccgagcagacgggagucucucauaaccugaugauuaccguggaugacgauggcacaaugcgcaucaaagacgaugaaaccgagaacauucuuacaguccugcugaagaccgcucuccugaucguguccggcaucuuuccuuacagcauucccgccacgcuucugguuuggcacaccuggcagaaacagacacaaagaucuggggugcucugggacgucccuucucccccggagacccagaaggcggaacuggaggaaggaguguaccggaucaaacagcagggcauuuucgggaagacacaaguuggagugggcguccagaaggaggggguguuucauaccauguggcacgugacacgcggagcuguucucacgcacaauggcaaaagacuggagccuaacugggccagcgucaagaaagaucuuaucagcuauggcgggggauggcggcuguccgcccaguggcaaaagggcgaagagguccaggugauugcugucgaacccgggaaaaauccuaagaacuuccagaccaugcccggaaucuuccagacaaccaccggcgagauuggggccaucgcgcuggacuuuaagcccggaacaagcggcuccccuaucauuaaucgcgaaggcaaagugguugggcucuacggaaacggcguggucacgaagaaugggggauaugugagcggcaucgcucaaaccaacgccgagccggaugggcccacaccugagcuggaagaggaaauguucaaaaagagaaaucuuaccauuauggaccugcaucccggcucuggaaaaacacggaaguaccucccugccaucguucgcgaggcuauuaagagacggcugagaacccucauccuggcccccacgcgcguggucgcugccgaaauggaggaggcgcuuaaaggccugccuauccgguaucagacaaccgccaccaagagcgaacacacagggagagagauuguggaucugaugugccaugcuaccuuuacaaugcgccuccuguccccgguucgggugcccaacuacaaucuugucaucauggacgaagcccacuucaccgauccugcuucuauugccgccagaggauauaucagcacgcgcgugggcaugggggaggcugcggccauuuuuaugacagcuacacccccuggaacagccgaagccuucccccaguccaacgcuccgauccaggacgaggagcgggacaucccugaaagaucuuggaauagcggcaacgaguggauuaccgauuuuguggggaaaacggucugguucguucccuccaucaaggccggcaaugacauugcgaacugucugcgcaaaaacggaaagaaggugauccaacucucucggaaaaccuuugauacagaauaccagaagaccagacugaaugacugggauuucguggucacaaccgacauuagcgagaugggcgcuaacuuuaaagccgaucgggugaucgacccccgcagaugccugaagccuguuauucucacagaugggcccgagcgggugauccuugccggaccuaugccggucaccgcugccuccgcggcccagcgcagaggccggguggggagaaauccccagaaagaaaacgaccaauacaucuucacgggacagccucugaauaacgaugaggaccaugcucacuggacagaagccaagaugcugcucgacaauauuaacacccccgagggcaucauuccugcucuguucgaacccgagcgcgaaaaguccgccgcuaucgauggggaauaucggcuuaaaggcgagucuagaaagaccuuuguugaacugaugcgccggggagaccucccgguguggcuggcccacaaagucgcguccgagggcauuaaguacacagauagaaaauggugcuucgacggggaacgcaauaaccagauccuggaggagaauauggauguggaaaucuggaccaaggagggagaacggaaaaagcucagaccucgcuggcuugacgccagaacauauagcgauccccuggcucugaaggaguuuaaagacuucgccgcuggccggaagucuauugcccucgaucuggucacggaaaucgggcgcgugccuucccaucuugcccacagaacccggaacgcucuggacaaucucguuaugcugcauacaagcgagcacggaggccgcgcguacagacacgccguggaggaacugcccgagaccauggaaacacuccuucugcugggccucaugauucugcuuaccgggggagcuaugcuguuucucaucuccggcaaagggauuggaaagacgucuaucggccugaucugugugauugccagcuccgggaugcuguggauggccgaugucccucuccaguggaucgcuagcgccauuguucuugaguucuuuaugauggugcugcugauccccgagccggaaaaacaacggaccccucaggacaaccagcucgcguauguggucauuggaauccugacacuugccgcuauuguggccgcuaaugagaugggccugcucgaaaccacaaagagagaucugggcaugucuaaggagcccgggguugugucccccaccagcuaccuggacgucgaccuccauccugccucugcguggacgcuuuaugccguggcuacaaccgucaucacaccgaugcugcgccacaccaucgaaaacagcaccgccaaugugucccuggcugccauugcuaaccaagccguugugcucaugggacuggauaaaggcuggcccaucucuaagauggaccuuggggucccucugcucgcgcugggaugcuacagccaggugaacccccugacacucacggccgcuguucuucugcuggugacccauuacgccauuaucggcccugggcuccaggcuaaagccacacgggaggcccagaagagaaccgcggcuggaauuaugaaaaaucccacagucgauggcaucaugaccaucgaccuggauccugugauuuaugacuccaaguucgagaagcaacuuggccaggugaugcugcucguucugugugccguccagcugcuccuuaugcgcacgucuugggcucugugcgaagcccugacacucgccaccgggccgaucaccacacugugggagggaagccccggcaaauuuuggaacaccacaauugcuguguccauggccaauaucuuccgggggagcuaccuugcgggagccggccuggcuuuuucuauuaugaaguccguggggacgggaagacggggcaccggcagccagggggaaacacucggagagaaauggaagaaaaagcugaaccaacugucccgcaaggaguucgaucucuauaaaaagucuggcaucaccgaggucgacagaacagaggccaaagaagggcuuaagcggggagagaccacgcaccaugcuguuagccgcggcuccgccaaacugcagugguuuguggaaagaaauauggugaucccugaggggcgggucauugaucugggauguggccgcggcggguggucuuacuauugcgcgggacucaagaaagugaccgaaguuagaggcuacacaaaaggcgggcccgggcacgaggagccugugcccaugagcaccuauggguggaacaucgucaagcugauguccggaaaagacguguucuaccuuccgccugaaaagugugauacacugcucugcgacauuggcgagagcucucccucccccaccguugaagagagccggacaauccgcgugcugaaaauggucgagccuuggcugagaaauaaccaguucuguauuaaggugcucaaucccuacaugccuaccgugaucgaacaccuugagcggcugcagagaaaauauggcgggaugcugguccgcaacccgcucucuagaaauuccacgcaugaaauguacuggauuagcaacggaacaggcaauaucguuucuagcgugaacaugguguccagacugcuucugaaucgcuuuaccaugacccaccggagacccacaaucgagaaggaugucgaccucggggccggaacgcgccaugugaacgcugaaccugagacccccaacauggacguuauuggcgagcggaucaagagaauuaaagaagaacacucuagcacauggcacuaugaugacgaaaauccuuacaagaccugggccuaucauggguccuacgaggugaaagcuacaggaagcgccuccucuaugaucaacggcgucgugaagcugcugaccaaacccugggauguugugccgauggucacacaaauggcuaugaccgacacgaccccuuucggccagcagcgcguguuuaaggaaaagguugauacacggacccccagaccuaugcccgggacacgcaaagugauggagauuaccgccgaguggcucuggcggacgcugggaagaaauaagaaaccucgccuuugcacaagagaagaguucaccaagaaaguccggacaaacgcggccaugggcgcuguguuuaccgaagagaaucaaugggacagcgcccgcgcugccgucgaagaugaggaguucuggaagcugguggacagagaacgggagcuccacaagcuggggaaauguggauccugcguuuauaacaugaugggcaagagagagaagaaacuuggggaguuuggcaaagccaagggaucucgggcgaucugguacauguggcugggcgcucgcuaccucgaguucgaagcccugggguuucugaaugaggaucauugguucagcagagaaaacuccuauucuggaguggagggcgaagggcuccacaaacugggauacauccuucgggacauuagcaagauccccggcggggccauguaugcugaugacacggccggcugggacacccgcauuacagaggaugaccugcauaaugaggaaaagaucacccagcagauggauccggagcacagacagcucgcuaacgccauuuuuaaacugacauaccaaaauaaggucgugaaagugcagcggccuacccccaagggaacaguuauggacaucaucucccgcaaagaucagagaggcagcggacaggugggaaccuauggccuuaacacguucacaaauauggaagcgcaacugguccggcagauggagggggaaggagugcucucuaaggccgaccuggagaacccccaucugcucggcaagaaaauuacccaguggcuggagaccaaggggguugaacgccuuaaaagaauggcuaucuccggcgaugacugcguggucaagccuauugaugaccgguuugccaaugcucugcucgcccugaacgauaugggaaaagugcgcaaggacaucccgcaguggcaacccagcaagggcuggcaugauuggcagcaggucccuuucuguucucaccauuuccacgagcuuauuaugaaagacgggagaaagcuggugguucccugccggccucaggacgaacucaucggacgcgcgagaaucucccaaggcgccggguggagccugaaagagacagcuugucugggaaaggccuacgcucagauguggucucucauguauuuucaccggagagaucugcgccuugccuccaacgcuauuugcagcgccgugcccguccauuggaucccuaccucccggacaacguggagcauucacgcgcaucaccaguggaugaccacagaagacaugcugaccguguggaauagaguuuggaucgaggauaaccccuggauggaggacaaaacaccggugaccacgugggaagaugucccuuaccucggcaagcgcgaggaccaauggugugggucucugauuggccuuaccagccgggccacaugggcucagaauauccugaccgccauucaacaggugagaucccucaucggagaugaagaguuccuggacuacaugcccucuaugaagcgcuuucggaaagaggaagagagcgaaggcgccaucugguga

SEQ ID NO: 20466 - RNA, 9873 nt, Artificial Sequence
  derived and/or modified CDS sequence (opt5) from DENV-3__GU131907__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaagcuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugacaaaaaaggaggagcccgugaauauugaagcugagccuccguucggcgaaucuaacaucguuauugggaucggcgacaaagcccucaagauuaauugguauaagaaaggaagcuccaucggcaagauguuugaggccaccgcucggggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcaacgggaucuucguuaccaaugaggugcacacauggacggagcaguacaaguuucaagcugacucccccaaacggcucgccaccgcgauugccggcgcuugggaaaacggagucuguggcaucagaagcacaacccgcauggagaaucugcuguggaagcagauugccaacgaacucaauuauauccugugggagaacaauaucaaacuuacagugguugugggggauauuaucggaguccuggaacagggcaagcggacccucacgccucagcccauggagcugaaauacucuuggaagaccugggggaaggcuaaaauugugacagccgagacccaaaacuccagcuucaucauugacggaccuaacacacccgaaugcccgucugccuccagagcuuggaaugugugggaggucgaagacuauggcuuuggcguuuucaccacaaacaucuggcugaagcuucgcgagguguacacccagagcugugaucaucggcucauguccgcggccaucaaagacgaaagagcugugcacgccgauaugggguacuggauugagucucagaagaauggaagcuggaaacuggagaaggccuccuuuaucgaagucaagacgugcacauggccuaaaucucacacccuguggagcaacggcgugcucgaguccgacaugauuauccccaagagccuggcugggccuauuucucagcauaaucaccgccccggauaucauacccaaacagccggcccuuggcaccuugggaaacuggaacucgauuucaacuacugcgagggaaccacgguugugaucgcggagaauuguggcacacggggccccucccugagaaccacaaccgucagcgggaagcugauccacgaauggugcugucgcucuugcacacuuccgccucuccgguauaugggagaggacggcuguugguacgggauggaaauuagacccaucaacgagaaagaagagaauauggugaagucccugguuagcgcuggaucuggcaagguggauaacuuuaccauggggguccugugccucgccauucuguucgaggaagugaugcggggaaaauucggcaagaaacauaugaucgccggcguucuuuuuacguucgugcugcuccugagcgggcagauuaccuggcgcgacauggcucacacacugaucaugauuggauccaaugccagcgauagaaugggcaugggggucaccuaucuugcgcugacagcuaccuuuaagauccagcccuuccucgcccugggauuuuuccuccggaaacugacgucuagagagaaccuucugcucggcguggggcuggccauggcuacaacccugcaacuuccugaagacaucgagcagauggccaauggaauugcucugggccucaugacacugaagcucaucacccaguuugaaaccuaccagcuguggacagcccuugugucccugacguguagcaacaccauuuucacacucaccgucgcguggcgcacagccacccugauccuggcuggcguuucccuucugccgcucugccaaucuagcuccaugcggaagacggauuggcugcccaugacaguggccgcuaugggggugccuccccucccucuguuuauuuucucucuuaaagacacccccaagagacgcagcuggccucugaaugagggagucauggccgugggccugguuuccauccucgccucuagccugcuuagaaacgaugugcccauggcugggccgcuggucgcgggaggccuccugaucgccuguuaugugauuaccgggacauccgcugaccucaccguugagaaagccgccgacgugacaugggaagaggaagcugagcagacgggagucagccauaaccugaugaucaccguggaugacgauggcacaaugcggauuaaggacgaugaaaccgagaauauccuuacaguccugcugaaaaccgcccuccugauugugucuggcaucuuuccuuacuccauccccgcgacgcuucugguuuggcacaccuggcagaagcagacacaacgcagcggggugcucugggacgucccuucucccccggagacccagaaagcugaacuggaggaaggaguguacagaauuaagcagcagggcaucuucgggaagacacaaguuggagugggcguccagaaagaggggguguuucauaccauguggcacgugacacggggagccguucucacgcacaacggcaagcgccuggagccuaauugggccuccgucaaaaaggaucuuauuagcuauggcgggggauggagacugucugcucaguggcaaaaaggcgaagaggugcaggugaucgccgucgaacccgggaagaacccuaagaauuuccagaccaugcccggaauuuuccagacaaccaccggcgagaucggggcgauugcucuggacuuuaaacccggaacauccggcagcccuaucaucaaccgggaaggcaaggugguugggcucuacggaaauggcguggucacgaaaaacgggggauauguguccggcauugcccaaaccaaugccgagccggaugggcccacaccugagcuggaagaggaaauguucaagaaacgcaaccuuaccaucauggaccugcaucccggcagcggaaagacaagaaaguaccucccugcuauuguucgggaggccaucaaacgcagacugcggacccucauucuggcucccacgagaguggucgccgcggaaauggaggaggcccuuaagggccugccuauccgcuaucagacaaccgcuaccaaaucugaacacacagggcgggagaucguggaucugaugugccaugccaccuuuacaaugagacuccugagcccgguucgcgugcccaauuacaaccuugucauuauggacgaagcucacuucaccgauccugccuccaucgccgcucggggauauauuucuacgagagugggcaugggggaggcggccgcuaucuuuaugacagccacccccccuggaacagccgaagcuuucccccagagcaaugccccgauucaggacgaggagcgcgacaucccugaacgguccuggaacucuggcaaugaguggaucaccgauuuuguggggaagacggucugguucguucccagcauuaaagcgggcaacgacaucgcuaacugucugagaaagaauggaaagaaagugauucaacucucccgcaagaccuuugauacagaauaccagaaaacccggcugaacgacugggauuucguggucacaaccgacaucucugagaugggcgccaauuuuaaggccgauagagugauugacccccggcgcugccugaaaccuguuauccucacagaugggcccgagagagugauucuugcuggaccuaugccggucaccgccgcgagcgccgcucagcggcgcggcagaguggggcggaacccccagaaggaaaaugaccaauacaucuucacgggacagccucugaacaaugaugaggaccaugcccacuggacagaagcuaagaugcugcucgacaacaucaauacccccgagggcauuaucccugcccuguucgaacccgagagagagaaauccgcugccauugauggggaauaucgccuuaagggcgagagccggaaaaccuuuguugaacugaugagacgcggagaccucccgguguggcuggcgcacaaggucgccucugagggcaucaaauacacagaucggaaguggugcuucgacggggaaagaaacaaucagauucuggaggagaacauggauguggaaaucuggaccaaagagggagaacgcaagaagcuccggccuagauggcuugacgcucgcacauauuccgauccccuggcccugaaagaguuuaaggacuucgcugccggcagaaaaagcaucgcccucgaucuggucacggaaauugggcgggugccuucucaucuugcucaccgcaccagaaaugcgcuggacaaccucguuaugcugcauacauccgagcacggaggccgggccuaccgccacgcuguggaggaacugcccgagaccauggaaacacuccuucugcugggccucaugauccugcuuaccgggggagccaugcuguuucucauuagcggcaaggggaucggaaaaacguccauuggccugaucugugugaucgucucuagcgggaugcuguggauggccgauguuccucuccaguggauugcuuccgccaucgugcuugaguucuuuaugauggugcugcugauucccgagccggaaaagcaaagaaccccucaggacaaucagcucgcguaugucgugaucggaauucugacacuugccgcuaucguugccgcuaacgagaugggccugcucgaaaccacaaagcgggaucugggcaugagcaaagagcccgggguggucucucccaccuccuaccuggacguggaccuccauccugccagcgcguggacgcuuuaugccgucgcuacaaccgugauuacaccgaugcugagacacaccaucgaaaauucuaccgccaacguuagccuggcugccaucgcuaaccaagccgugguccucaugggacuggauaagggcuggcccauuuccaaaauggaccuuggggugccucugcucgcgcugggaugcuacucucagguuaauccccugacacucacggccgcugugcuucugcuggucacccauuacgccaucauuggcccugggcuccaggcuaaggccacacgcgaggcccagaaacggaccgcggcuggaaucaugaagaaccccacaguggauggcauuaugaccaucgaccuggauccugugaucuaugacagcaaguucgagaaacaacuuggccagguuaugcugcucguccugugugccgugcagcugcuccuuaugagaacguccugggcucugugcgaagcccugacacucgccaccgggccgauuaccacacugugggagggaucucccggcaaguuuuggaauaccacaaucgcugugagcauggccaacauuuuccgcggguccuaccuugcgggagccggccuggcuuuuagcaucaugaaaucugucgggacgggacggagaggcaccggcucccagggggaaacacucggagagaaguggaaaaagaagcugaaucaacugagccggaaagaauucgaucucuauaagaaauccggcauuaccgagguugaccgcacagaggccaaggaagggcuuaaaagaggagagaccacgcaccaugcugugucucggggcagcgccaagcugcagugguuuguggaacgcaacauggucaucccugaggggagagugaucgaucugggauguggccggggcgggugguccuacuauugcgcgggacucaaaaagguuaccgaagugcgcggcuacacaaaggggggacccggccacgaggagccuguccccaugucuaccuauggguggaauauugugaaacugaugagcggaaaggacguuuucuaccuuccgccugaaaaaugugauacacugcucugcgacaucggcgaguccagccccucucccaccguggaagaguccagaacaauucggguccugaagaugguggagccuuggcugcgcaacaaucaguucuguaucaaagugcucaaccccuacaugccuaccgucauugaacaccuugagagacugcagcggaaguauggcgggaugcugguuagaaauccgcucagccgcaacucuacgcaugaaauguacuggaucuccaauggaacaggcaacauugugagcucugugaauauggucagccggcugcuucugaacagauuuaccaugacccaccgccggcccacaaucgagaaggauguggaccucggggccggaacgagacauguuaacgcugaaccugagacccccaauauggacgugaucggcgagcgcauuaaacggaucaaggaagagcacuccucuacauggcacuaugaugacgaaaacccuuacaaaaccugggccuaucaugggagcuacgaggucaaggcuacaggauccgccagcuccaugauuaauggcgugguuaaacugcugaccaagcccugggauguggucccgauggugacacaaauggcuaugaccgacacgaccccuuucggccagcagagaguuuuuaaggaaaaaguggauacacgcaccccccggccuaugcccgggacaagaaaggucauggagaucaccgccgaguggcucuggcgcacgcugggacggaacaaaaagccuagacuuugcacacgcgaagaguucaccaaaaaggugagaacaaaugcggccaugggcgcugucuuuaccgaagagaaccaaugggacucugcccgggcugccguggaagaugaggaguucuggaagcugguugacaaagaacgcgagcuccacaagcuggggaaauguggaagcugcguguauaauaugaugggcaagagagaaaaaaagcuuggggaguuuggcaaagccaagggaucccgggcgauuugguacauguggcugggcgcuagauaccucgaguucgaagcccugggguuucugaacgaggaucauugguucucucgggaaaauagcuauuccggagucgagggcgaagggcuccacaagcugggauacauccuucgcgacaucucuaaaauucccggcggggccauguaugcugaugacacggccggcugggacaccagaaucacagaggaugaccugcauaacgaggaaaagauuacccagcagauggauccggagcaccggcagcucgcuaaugccaucuuuaaacugacauaccaaaacaagguggugaaaguucagcgcccuacccccaagggaacagugauggacauuaucagcagaaaggaucagcggggcuccgggcaggucggaaccuauggccuuaauacguucacaaacauggaagcgcaacuggugcgccagauggagggggaaggaguucucagcaaagccgaccuggagaauccccaccugcucgagaagaaaaucacccaguggcuggaaaccaagggcguggagagacuuaaacggauggcuauuucuggggaugacugcgucgugaagccuaucgaugaccgcuuugccaacgcucugcucgcccugaacgauaugggcaaggucagaaaagacauuccgcaguggcaacccuccaagggauggcaugauuggcagcaggugccuuucuguagccaccauuuccacgaacuuaucaugaaagacggccggaagcugguugugcccugccgcccucaggacgagcucauugggagagcgcggaucucucaaggagccggcuggucccugaaagaaacagcuugucuggggaaggccuacgcucagauguggagccucauguauuuucaccgcagagaucugcggcuugccucuaaugcuaucugcuccgccguccccgugcauuggauuccuaccagcagaacaacgugguccauccacgcgcaucaccaguggaugaccacagaggacaugcugaccguuuggaaccgcguguggauugaggauaaucccuggauggaagacaagacaccggucaccacgugggaggaugugccuuaccucggaaaacgggaagaccaaugguguggcagccugaucgggcuuaccucuagagccacaugggcucagaacauucugaccgccauccagcaggugcgcagccucauuggcgaugaggaguuccuggacuacaugcccuccaugaagcgguuuagaaaagaagaggaaacagagggagccaucugguga

SEQ ID NO: 20467 - RNA, 9873 nt, Artificial Sequence
  derived and/or modified CDS sequence (opt5) from DENV-3__GQ868634__SS-prME
accagccugugccucaugaugaugcugcccgccacccuugcuuuccaccugacgucccgggacggcgaaccucggaugaucguggggaagaacgaacgcggaaagucucuccuguuuaagaccgccuccggcauuaauauguguacccuuaucgcgauggaucugggggaaaugugcgacgauaccgucacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugcuauuaauuggaagggaaaggaacuuaaaugcggcuccgggaucuucgugaccaacgagguucacacauggacggagcaguacaaguuucaagccgacagccccaaacggcucgcgaccgccauugcuggcgccugggaaaauggaguguguggcaucagaucuacaacccgcauggagaaccugcuguggaagcagauugcuaaugaacucaacuauauccugugggagaauaacaucaaacuuacagucgugguuggggauauuaucggagugcuggaacagggcaagcggacccucacgccucagcccauggagcugaaauacuccuggaagaccugggggaaggccaaaauugucacagccgagacccaaaauagcucuuucaucauugacggaccuaacacacccgaaugcccguccgcuagcagagcguggaacgugugggagguggaagacuauggcuuuggcgucuucaccacaaauaucuggcugaaacuucgcgagguuuacacccaguccugugaucaucggcucaugucugccgcuaucaaagacgaaagagccgugcacgccgauaugggguacuggauugagagccagaagaacggauccuggaaacuggagaaggcuucuuuuaucgaagugaagacgugcacauggccuaaaagccacacccugugguccaauggcguccucgagagcgacaugauuauccccaagucucuggccgggccuauuucccagcauaaccaccgccccggauaucauacccaaacagcgggcccuuggcaccuugggaaacuggaacucgauuucaauuacugcgagggaaccacggugguuaucacagagaacuguggcacccggggccccagccugagaacaaccacagugucugggaagcugauccacgaauggugcugucgcuccugcacccuuccgccucuccgguauaugggagaggacggcuguugguacgggauggaaauuagacccaucaaugagaaagaagagaacauggucaagagccuggugucugcuggaagcggcaagguugauaauuuuacgaugggggugcugugccucgccauucuguucgaggaagucaugcggggaaaauucggcaagaaacauaugaucgccggcgugcuuuuuaccuucguucugcuccuguccgggcagauuacauggcgcgacauggcucacacccugaucaugauuggaagcaacgccucugauagaaugggcaugggggugacauaucuugcgcugaucgcuaccuuuaagauccagcccuuccucgcccugggauuuuuccuccggaaacugacguccagagagaaucuucugcucggcgucgggcuggccauggcuacaacccugcaacuuccugaagacauugagcagauggccaacggaaucgcucugggccucaugacacugaagcucauuacccaguuugaaaccuaccagcuguggacagcccuugugagccugacguguuccaauaccaucuucacacucaccguggcguggcgcacagccacccugauucuggcuggcgucucucuucugccgcucugccaaagcuccucuaugcggaagacggauuggcugcccaugacaguugccgcuaugggggugccuccccucccucuguuuaucuucagccuuaaagacacccccaagagacgcuccuggccucugaacgagggagugauggccgucggccuggugucuauccucgccagcucccugcuuagaaaugauguucccauggcugggccgcugguggcgggaggccuccugauugccuguuaugucaucaccgggacaagcgcugaccucaccguggagaaagccgccgacguuacaugggaagaggaagcugagcagacgggagugucucauaaccugaugauuaccgucgaugacgauggcacaaugcggaucaaggacgaugaaaccgagaacauucuuacagugcugcugaaaaccgcccuccugaucgucuccggcaucuuuccuuacagcauucccgcgacgcuucugguguggcacaccuggcagaagcagacacaacgcucugggguucucugggacgugccuucucccccggagacccagaaagcugaacuggaggaaggagucuacagaaucaagcagcagggcauuuucgggaagacacaagugggaguuggcgugcagaaagagggggucuuucauaccauguggcacgugacacggggagccgugcucacgcacaauggcaagcgccuggagccuaacugggccagcguuaaaaaggaucuuaucagcuauggcgggggauggagacugaaugcucaguggcaaaaaggcgaagagguccaggugauugccguggaacccgggaagaacccuaagaauuuccagaccaugcccggaaucuuccagacaaccaccggcgagauuggggcgaucgcucuggacuuuaaacccggaacauccggcagcccuaucauuaaccgggaaggcaaggucguggggcucuacggaaauggcguugugacgaaaaacgggggauaugucuccggcaucgcccaaaccaaugccgagccggaugggcccacaccugagcuggaagaggaaauguucaagaaacgcaaccuuaccauuauggaccugcaucccggcagcggaaagacaagaaaguaccucccugcuaucgugcgggaggccauuaaacgcagacugcggacccucauccuggcucccacgagaguuguggccgcggaaauggaggaggcccuuaagggccugccuauccgcuaucagacaaccgcuaccaaaucugaacacacagggcgggagauugucgaucugaugugccaugccaccuuuacaaugagacuccugagcccggugcgcguucccaauuacaaccuugugaucauggacgaagcucacuucaccgauccugccuccauugccgcucggggauauaucucuacgagagucggcaugggggaggcggccgcuauuuuuaugacagccacacccccuggaacagccgaggcuuucccccagagcaaugccccgauccaggacgaggagcgcgacaucccugaacgguccuggaacucuggcaaugaguggauuaccgauuuuguggggaagacggugugguucguccccagcaucaaagcgggcaacgacauugcuaacugucugagaaagaauggaaagaaaguuauccaacucucccgcaagaccuuugauacagaauaccagaaaacccggcugaacgacugggauuucguggugacaaccgacauuucugagaugggcgccaauuuuaaggccgauagagucaucgacccccggcgcugccugaaaccugugauucucacagaugggcccgagagaguuauccuugcuggaccuaugccggugaccgccgcgagcgccgcucagcggcgcggcagagucgggcggaacccccagaaggaaaaugaccaauacaucuucacgggacagccucugaacaaugaugaggaccaugcccacuggacagaagcuaagaugcugcucgacaacauuaauacccccgagggcaucauuccugcccuguucgaacccgagagagagaaauccgcugccaucgauggggaauaucgccuuaagggcgagagccggaaaaccuuuguggaacugaugagacgcggagaccucccgguuuggcuggcgcacaagguggccucugagggcauuaaauacacagaucggaaguggugcuucgacggggaaagaaacaaucagauccuggaggagaacauggaugucgaaaucuggaccaaagagggagaacgcaagaagcuccggccuagauggcuugacgcucgcacauauuccgauccccuggcccugaaagaguuuaaggacuucgcugccggcagaaaaagcauugcccucgaucuggugacggaaaucgggcgggucccuucucaucuugcucaccgcaccagaaaugcgcuggacaaccucgugaugcugcauacauccgagcacggaggccgggccuaccgccacgcuguugaggaacugcccgagaccauggaaacacuccuucugcugggccucaugauucugcuuaccgggggagccaugcuguuucucaucagcggcaaggggauuggaaaaacguccaucggccugaucugugugauugugucuagcgggaugcuguggauggccgaugucccucuccaguggaucgcuuccgccauuguucuugaguucuuuaugauggugcugcugauccccgagccggaaaagcaaagaaccccucaggacaaucagcucgcguauguggucauuggaauccugacacuugccgcuauuguggccgcuaacgagaugggccugcucgaaaccacaaagcgggaucugggcaugagcaaagagcccgggguugugucucccaccuccuaccuggacgucgaccuccauccugccagcgcguggacgcuuuaugccguggcuacaaccgucaucacaccgaugcugagacacaccaucgaaaauucuaccgccaacgugagccuggcugccauugcuaaccaagccguugugcucaugggacuggauaagggcuggcccaucuccaaaauggaccuuggggucccucugcucgcgcugggaugcuacucucaggugaauccccugacacucacggccgcuguucuucugcuggugacccauuacgccauuaucggcccugggcuccaggcuaaggccacacgcgaggcccagaaacggaccgcggcuggaauuaugaagaaccccacagucgauggcaucaugaccaucgaccuggauccugugauuuaugacagcaaguucgagaaacaacuuggccaggugaugcugcucguucugugugccguccagcugcuccuuaugagaacguccugggcucugugcgaagcccugacacucgccaccgggccgaucaccacacugugggagggaucucccggcaaguuuuggaauaccacaauugcugugagcauggccaacaucuuccgcggguccuaccuugcgggagccggccuggcuuuuagcauuaugaaaucuguggggacgggacggagaggcaccggcucccagggggaaacacucggagagaaguggaaaaagaagcugaaucaacugagccggaaagaguucgaucucuauaagaaauccggcaucaccgaggucgaccgcacagaggccaaggaagggcuuaaaagaggagagaccacgcaccaugcuguuucucggggcagcgccaagcugcagugguuuguggaacgcaacauggugaucccugaggggagagucauugaucugggauguggccggggcgggugguccuacuauugcgcgggacucaaaaaggugaccgaaguucgcggcuacacaaaaggcgggcccgggcacgaggagccugugcccaugucuaccuauggguggaauaucgucaaacugaugagcggaaaggacguguucuaccuuccgccugaaaaaugugauacacugcucugcgacauuggcgaguccagccccucucccaccguugaagaguccagaacaauccgggugcugaagauggucgagccuuggcugcgcaacaaucaguucuguauuaaagugcucaaccccuacaugccuaccgugaucgaacaccuugagagacugcagcggaaguauggcgggaugcuggucagaaauccgcucagccgcaacucuacgcaugaaauguacuggauuuccaauggaacaggcaacaucguuagcucugugaauauggugagccggcugcuucugaacagauuuaccaugacccaccgccggcccacaaucgagaaggaugucgaccucggggccggaacgagacaugugaacgcugaaccugagacccccaauauggacguuauuggcgagcgcaucaaacggauuaaggaagaacacuccucuacauggcacuaugaugacgaaaacccuuacaaaaccugggccuaucaugggagcuacgaggugaaggcuacaggauccgccagcuccaugaucaauggcgucgugaaacugcugaccaagcccugggauguugugccgauggucacacaaauggcuaugaccgacacgaccccuuucggccagcagagaguguuuaaggaaaaaguugauacacgcacaccccggccuaugcccgggacaagaaaggugauggagauuaccgccgaguggcucuggcgcacgcugggacggaacaaaaagccuagacuuugcacacgcgaagaguucaccaaaaaggucagaacaaaugcggccaugggcgcuguguuuaccgaagagaaccaaugggacucugcccgggcugccgucgaagaugaggaguucuggaagcugguggaccgcgaaagagagcuccacaaacuggggaaguguggaagcugcguuuauaauaugaugggcaaacgggaaaagaaacuuggggaguuuggcaaggccaaaggauccagagcgaucugguacauguggcugggcgcucgguaccucgaguucgaagcccugggguuucugaacgaggaucauugguucucucgcgaaaauagcuauuccggaguggagggcgaagggcuccacaagcugggauacauccuuagagacauuucuaagauccccggcggggccauguaugcugaugacacggccggcugggacacccggauuacagaggaugaccugcauaacgaggagaagaucacccagcagauggauccggagcaccgccagcucgcuaaugccauuuuuaagcugacauaccaaaacaaagucgugaaggugcagagaccuacccccaaaggaacaguuauggacaucaucagccggaaggaucagcgcggcuccggacaggugggaaccuauggccuuaauacguucacaaacauggaagcgcaacuggucagacagauggagggggaaggagugcucagcaaggccgaccuggagaauccccaucugcucgagaaaaagauuacccaguggcuggaaaccaaaggcguugagcggcuuaagcgcauggcuaucucuggggaugacugcguggucaaaccuauugaugacagauuugccaacgcucugcucgcccugaacgauaugggcaaggugcggaaggacaucccgcaguggcaacccuccaaaggauggcaugauuggcagcaggucccuuucuguagccaccauuuccacgaacuuauuaugaaggacggccgcaaacuggugguucccugcagaccucaggacgagcucaucgggcgggcgcgcaucucucaaggagccggcuggucccugaaggaaacagcuugucuggggaaagccuacgcucagauguggagccucauguauuuucacagacgggaucugagacuugccucuaaugcuauuugcuccgccgugcccguccauuggaucccuaccagccgcacaacgugguccauucacgcgcaucaccaguggaugaccacagaggacaugcugaccguguggaaccggguuuggaucgaggauaaucccuggauggaagacaagacaccggugaccacgugggaggaugucccuuaccucggaaagagagaagaccaaugguguggcagccugauugggcuuaccucucgcgccacaugggcucagaacauccugaccgccauucaacaggugcggagccucaucggcgaugaggaguuccuggacuacaugcccuccaugaaaagauuucgcaaggaagaggaaucugagggagccaucugguga

SEQ ID NO: 20468 - RNA, 9873 nt, Artificial Sequence
  derived and/or modified CDS sequence (opt5) from DENV-3__GU131908__SS-prME
accagccugugccucaugaugaugcugcccgccacccuugcuuuccaccugacgucccgggacggcgagccucggaugaucguggggaagaacgaacgcgggaagucucuccuguuuaagaccgccuccggcauuaauauguguacccuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugcuauuaauuggaagggaaaggaacuuaaaugcggcuccgggaucuucgugaccaacgagguucacacauggacggagcaguacaaguuucaagccgacagccccaaacggcucgcgaccgccauugcuggcgccuggaagaauggaguguguggcaucagaucuacaacccgcauggaaaaccugcuguggaaacagauugcuaaugagcucaacuauauccugugggaaaauaacaucaaacuuacagucgugguuggggauauuaucggagugcuggagcagggcaaacggacccucacgccucagcccauggaacugaaguacuccuggaagaccugggggaaagccaagauugucacagccgagacccaaaauagcucuuucaucauugacggaccuaacacacccgagugcccguccgcuagcagagcguggaacgugugggaaguggaggacuauggcuuuggcgucuucaccacaaauaucuggcugaaacuucgcgaaguuuacacccaguccugugaucaucggcucaugucugccgcuaucaaggacgagagagccgugcacgccgauaugggguacuggauugaaagccagaaaaacggauccuggaagcuggagaaggcuucuuuuaucgaggugaaaacgugcacauggccuaagagccacacccugugguccaauggcguccucgaaagcgacaugauuauccccaaaucucuggccgggccuauuucccagcauaaccaccgccccggauaucauacccaaacagcgggcccuuggcaccuugggaagcuggagcucgauuucaauuacugcgaaggaaccacggugguuaucacagagaacuguggcacccggggccccagccugagaacaaccacagugucugggaaacugauccacgaguggugcugucgcuccugcacccuuccgccucuccgguauaugggagaagacggcuguugguacgggauggagauuagacccaucaaugaaaaggaggaaaacauggucaagagccuggugucugcuggaagcggcaaaguugauaauuuuacgaugggggugcugugccucgccauucuguucgaggaggucaugcggggaaaguucggcaaaaagcauaugaucgccggcgugcuuuuuaccuucguucugcuccuguccgggcagauuacauggcgcgacauggcucacacccugaucaugauuggaagcaacgccucugauagaaugggcaugggggugacauaucuugcgcugaucgcuaccuuuaaaauccagcccuuccucgcccugggauuuuuccuccggaagcugacguccagagaaaaucuucugcucggcgucgggcuggccauggcuacaacccugcaacuuccugaggacauugaacagauggccaacggaaucgcucugggccucaugacacugaagcucauuacccaguuugagaccuaccagcuguggacagcccuugugagccugacguguuccaauaccaucuucacacucaccguggcguggcgcacagccacccugauucuggcuggcgucucucuucugccgcucugccaaagcuccucuaugcggaaaacggauuggcugcccaugacaguugccgcuaugggggugccuccccucccucuguuuaucuucagccuuaaggacacccccaaaagacgcuccuggccucugaacgaaggagugauggccgucggccuggugucuauccucgccagcucccugcuuagaaaugauguucccauggcugggccgcugguggcgggaggccuccugauugccuguuaugucaucaccgggacaagcgcugaccucaccguggagaaggccgccgacguuacaugggaggaagaggcugaacagacgggagugucucauaaccugaugauuaccgucgaugacgauggcacaaugcggaucaaagacgaugagaccgaaaacauucuuacagugcugcugaagaccgcccuccugaucgucuccggcaucuuuccuuacagcauucccgcgacgcuucugguguggcacaccuggcagaaacagacacaacgcucugggguucucugggacgugccuucucccccggagacccagaaggcugagcuggaagagggagucuacagaaucaagcagcagggcauuuucgggaaaacacaagugggaguuggcgugcagaaggaaggggucuuucauaccauguggcacgugacacggggagccgugcucacgcacaauggcaaacgccuggagccuaacugggccagcguuaagaaagaucuuaucagcuauggcgggggauggagacugaaugcucaguggcaaaagggcgaggaaguccaggugauugccguggagcccgggaagaacccuaaaaauuuccagaccaugcccggaaucuuccagacaaccaccggcgaaauuggggcgaucgcucuggacuuuaagcccggaacauccggcagcccuaucauuaaccgggagggcaaagucguggggcucuacggaaauggcguugugacgaagaacgggggauaugucuccggcaucgcccaaaccaaugccgaaccggaugggcccacaccugagcuggaggaagagauguucaaaaagcgcaaccuuaccauuauggaccugcaucccggcagcggaaagacaagaaaauaccucccugcuaucgugcgggaagccauuaagcgcagacugcggacccucauccuggcucccacgagaguuguggccgcggagauggaagaggcccuuaaaggccugccuauccgcuaucagacaaccgcuaccaagucugagcacacagggcgggaaauugucgaucugaugugccaugccaccuuuacaaugagacuccugagcccggugcgcguucccaauuacaaccuugugaucauggacgaggcucacuucaccgauccugccuccauugccgcucggggauauaucucuacgagagucggcaugggggaagcggccgcuauuuuuaugacagccacacccccuggaacagccgaggcuuucccccagagcaaugccccgauccaggacgaggaacgcgacaucccugagcgguccuggaacucuggcaaugaauggauuaccgauuuuguggggaaaacggugugguucguccccagcaucaaggcgggcaacgacauugcuaacugucugagaaagaauggcaaaaagguuauccaacucucccgcaaaaccuuugauacagaguaccagaagacccggcugaacgacugggauuucguggugacaaccgacauuucugaaaugggagccaauuuuaaagccgauagagucaucgacccccggcgcugccugaagccugugauucucacagaugggcccgagagaguuauccuugcuggaccuaugccggugaccgccgcgagcgccgcucagcggcgcggcagagucgggcggaacccccagaaggagaaugaccaauacaucuucacgggacagccucugaacaaugaugaagaccaugcccacuggacagaggcuaaaaugcugcucgacaacauuaauacccccgaaggcaucauuccugcccuguucgagcccgaaagagagaaguccgcugccaucgauggggaguaucgccuuaaaggcgaaagccggaagaccuuuguggagcugaugagacgcggagaccucccgguuuggcuggcgcacaaaguggccucugaaggcauuaaguacacagaucggaaauggugcuucgacggggagagaaacaaucagauccuggaagagaacauggaugucgagaucuggaccaaggaaggagagcgcaagaaacuccggccuagauggcuugacgcucgcacauauuccgauccccuggcccugaaggaauuuaaagacuucgcugccggcagaaagagcauugcccucgaucuggugacggagaucgggcgggucccuucucaucuugcucaccgcaccagaaaugcgcuggacaaccucgugaugcugcauacauccgaacacggaggccgggccuaccgccacgcuguugaggagcugcccgaaaccauggagacacuccuucugcugggccucaugauucugcuuaccgggggagccaugcuguuucucaucagcggcaaagggauuggaaagacguccaucggccugaucugugugauugugucuagcgggaugcuguggauggccgaugucccucuccaguggaucgcuuccgccauuguucuugaguucuuuaugauggugcugcugauccccgagccggagaagcaaagaaccccucaggacaaucagcucgcguauguggucauuggaauccugacacuugccgcuauuguggccgcuaacgaaaugggccugcucgagaccacaaaacgggaucugggcaugagcaaggaacccgggguugugucucccaccuccuaccuggacgucgaccuccauccugccagcgcguggacgcuuuaugccguggcuacaaccgucaucacaccgaugcugagacacaccaucgaaaauucuaccgccaacgugagccuggcugccauugcuaaccaagccguugugcucaugggacuggauaaaggcuggcccaucuccaagauggaccuuggggucccucugcucgcgcugggaugcuacucucaggugaauccccugacacucacggccgcuguucuucugcuggugacccauuacgccauuaucggcccugggcuccaggcuaaagccacacgcgaagcccagaagcggaccgcggcuggaauuaugaagaaccccacagucgauggcaucaugaccaucgaccuggauccugugauuuaugacagcaaauucgagaagcaacuuggccaggugaugcugcucguucugugugccguccagcugcuccuuaugagaacguccugggcucugugcgaggcccugacacucgccaccgggccgaucaccacacugugggaaggaucucccggcaaauuuuggaauaccacaauugcugugagcauggccaacaucuuccgcggguccuaccuugcgggagccggccuggcuuuuagcauuaugaagucuguggggacgggacggagaggcaccggcucccagggggagacacucggagaaaaauggaagaagaaacugaaucaacugagccggaaggaguucgaucucuauaaaaaguccggcaucaccgaagucgaccgcacagaggccaaagaggggcuuaagagaggagaaaccacgcaccaugcuguuucucggggcagcgccaaacugcagugguuuguggagcgcaacauggugaucccugaagggagagucauugaucugggauguggccggggcgggugguccuacuauugcgcgggacucaagaaggugaccgagguucgcggcuacacaaaagggggacccggccacgaagaaccugugcccaugucuaccuauggguggaauaucgucaagcugaugagcggaaaagacguguucuaccuuccgccugagaagugugauacacugcucugcgacauuggcgaauccagccccucucccaccguugaggaauccagaacaauccgggugcugaaaauggucgagccuuggcugcgcaacaaucaguucuguauuaaggugcucaaccccuacaugccuaccgugaucgagcaccuugaaagacugcagcggaaguauggcgggaugcuggucagaaauccgcucagccgcaacucuacgcaugagauguacuggauuuccaauggaacaggcaacaucguuagcucugugaauauggugagccggcugcuucugaacagauuuaccaugacccaccgccggcccacaaucgaaaaagaugucgaccucggggccggaacgagacaugugaacgcugagccugaaacccccaauauggacguuauuggcgagcgcaucaagcggauuaaagaggaacacuccucuacauggcacuaugaugacgagaacccuuacaagaccugggccuaucaugggagcuacgaagugaaagcuacaggauccgccagcuccaugaucaauggcgucgugaagcugcugaccaagcccugggauguugugccgauggucacacaaauggcuaugaccgacacgaccccuuucggccagcagagaguguuuaaagagaagguugauacacgcacaccccggccuaugcccgggacaagaaaagugauggaaauuaccgccgaguggcucuggcgcacgcugggacggaacaagaaaccuagacuuugcacacgcgaggaguucaccaagaaggucagaacaaaugcggccaugggcgcuguguuuaccgaggaaaaccaaugggacucugcccgggcugccgucgaggaugaagaguucuggaaacugguggaccgcgagagagaacuccacaagcuggggaaauguggaagcugcguuuauaauaugaugggcaagcgggagaagaaacuuggggaauuuggcaaagccaaaggauccagagcgaucugguacauguggcugggcgcucgguaccucgaguucgaggcccugggguuucugaacgaagaucauugguucucucgcgagaauagcuauuccggaguggaaggcgaggggcuccacaagcugggauacauccuuagagacauuucuaaaauccccggcggggccauguaugcugaugacacggccggcugggacacccggauuacagaagaugaccugcauaacgaggagaagaucacccagcagauggauccggaacaccgccagcucgcuaaugccauuuuuaaacugacauaccaaaacaaggucgugaaagugcagagaccuacccccaagggaacaguuauggacaucaucagccggaaggaucagcgcggcuccggacaggugggaaccuauggccuuaauacguucacaaacauggaggcgcaacuggucagacagauggaaggggagggagugcucagcaaagccgaccuggaaaauccccaucugcucgagaagaaaauuacccaguggcuggagaccaagggcguugaacggcuuaaacgcauggcuaucucuggggaugacugcguggucaagccuauugaugacagauuugccaacgcucugcucgcccugaacgauaugggcaaggugcggaaagacaucccgcaguggcaacccuccaagggauggcaugauuggcagcaggucccuuucuguagccaccauuuccacgagcuuauuaugaaagacggccgcaagcuggugguucccugcagaccucaggacgaacucaucgggcgggcgcgcaucucucaaggagccggcuggucccugaaagagacagcuugucuggggaaggccuacgcucagauguggagccucauguauuuucacagacgggaucugagacuugccucuaaugcuauuugcuccgccgugcccguccauuggaucccuaccagccgcacaacgugguccauucacgcgcaucaccaguggaugaccacagaagacaugcugaccguguggaaccggguuuggaucgaggauaaucccuggauggaggacaagacaccggugaccacgugggaagaugucccuuaccucggaaaaagagaggaccaaugguguggcagccugauugggcuuaccucucgcgccacaugggcucagaacauccugaccgccauucaacaggugcggagccucaucggcgaugaagaguuccuggacuacaugcccuccaugaagagauuucgcaaagaggaagagucugaaggagccaucugguga

SEQ ID NO: 20469 - RNA, 9873 nt, Artificial Sequence
  derived and/or modified CDS sequence (opt5) from DENV-3__GU131909__SS-prME
accagccugugccucaugaugaugcugcccgccacccuugcuuuccaccugacgucccgggacggcgaaccucggaugaucguggggaagaacgaacgcggaaagucucuccuguuuaagaccgccuccggcauuaauauguguacccuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaaguccaaacccacgcuggacaucgagcuccagaagaccgaagcuacacaacuggccacccuucgcaaacuguguauugagggaaagaucacaaauauuaccacggauagcagaugcccuacacagggcgaagcgacccucccggaggaacaggaccagaacuauguguguaaacacaccuacguggaucggggcugggggaauggaugcggccuguuugggaagggaucucuugucacaugcgccaaguuccaaugucuggagcccaucgagggcaaagugguucaguaugaaaaccucaaguacaccgugauuaucacaguccacacgggggaccagcaucaggugggaaaugacacccaaggcguuacaguggagaucaccccucaggcuuccacagucgaagccgugcugcccgaguauggcacccuggggcucgaaugcagcccucgcacgggacuggauuuuaacgagaugauucuucugaccaugaaaaauaaggcuuggaugguccacagacagugguucuuugaccucccccugccguggacaucuggcgccaccacagagaccccuacguggaaccggaaagaacuucuggugacauucaagaaugcccaugcuaaaaagcaagagguugugguccucgggucccaggaaggagcgaugcacaccgcccugacaggcgcuaccgagauccagaacagcgggggcaccucuauuuuugccggacaccugaagugucgccucaaaauggauaagcuggaacuuaaaggcauguccuacgccaugugccugaauacauucgugcucaagaaagagguuagcgagacgcagcaugggaccauccugauuaagguggaauacaagggagaggacgcucccuguaaaaucccuuucuccacagaagauggccaagggaaggcccacaacggaagacugaucaccgcgaaccccgucgugaccaagaaggaggagcccgugaauauugaagcugagccuccguuuggcgaaucuaacaucguuauugggaucggcgacaaagcccuuaagauuaauugguauaagaaaggaagcuccaucggcaagauguucgaggccaccgcuagaggggcuagacgcauggcuauccucggagauacggccugggacuuuggcagcgucgggggagugcugaacucucugggcaaaauggugcaucagauuuucggguccgcguacacagcccucuuuagcggcgucucuuggaucaugaagauuggaaucggcgugcugcuuaccuggauugggcugaauagcaaaaacaccuccaugucuuucagcugcaucguuauuggaaucaucacacucuaucugggcgcugugguccaggccgauauggggugugcuauuaauuggaagggaaaggaacugaaaugcggcuccgggaucuuugugaccaacgagguucacacauggacggagcaguacaaguuccaagccgacagccccaaacggcuugcgaccgccauugcuggcgccugggaaaauggaguguguggcaucagaucuacaacccgcauggagaaccuccuguggaagcagauugcuaaugaacugaacuauauccucugggagaauaacaucaaacugacagucgugguuggggauauuaucggagugcuugaacagggcaagcggacccugacgccucagcccauggagcucaaauacuccuggaagaccugggggaaggccaaaauugucacagccgagacccaaaauagcucuuuuaucauugacggaccuaacacacccgaaugcccguccgcuagcagagcguggaacgugugggagguggaagacuauggcuucggcgucuuuaccacaaauaucuggcugaagcugcgcgagguuuacacccaguccugugaucaucggcuuaugucugccgcuaucaaagacgaaagagccgugcacgccgauaugggguacuggauugagagccagaagaacggauccuggaaacucgagaaggcuucuuucaucgaagugaagacgugcacauggccuaaaagccacacccugugguccaauggcguccuggagagcgacaugauuauccccaagucucucgccgggccuauuucccagcauaaccaccgccccggauaucauacccaaacagcgggcccuuggcaccuggggaaacuugaacuggauuuuaauuacugcgagggaaccacggugguuaucacagagaacuguggcacccggggccccagccucagaacaaccacagugucugggaagcugauccacgaauggugcugucgcuccugcacccugccgccucuucgguauaugggagaggacggcuguugguacgggauggaaauuagacccaucaaugagaaagaagagaacauggucaagagccucgugucugcuggaagcggcaagguugauaauuucacgaugggggugcugugccuggccauucucuucgaggaagucaugcggggaaaauuuggcaagaaacauaugaucgccggcgugcuguucaccuuuguucuucugcucuccgggcagauuacauggcgcgacauggcucacacccugaucaugauuggaagcaacgccucugauagaaugggcaugggggugacauaucuggcgcuuaucgcuaccuucaagauccagcccuuucuggcccucggauucuuucugcggaaacucacguccagagagaaucugcuucugggcgucgggcucgccauggcuacaacccugcaacugccugaagacauugagcagauggccaacggaaucgcucuuggccugaugacacucaagcugauuacccaguucgaaaccuaccagcucuggacagcccuggugagccuuacguguuccaauaccaucuuuacacugaccguggcguggcgcacagccacccucauucuggcuggcgucucucugcuuccgcugugccaaagcuccucuaugcggaagacggauuggcuccccaugacaguugccgcuaugggggugccuccccugccucucuucaucuuuagccugaaagacacccccaagagacgcuccuggccucuuaacgagggagugauggccgucggccuggugucuauccuggccagcucccuccugagaaaugauguucccauggcugggccgcuuguggcgggaggccugcucauugccuguuaugucaucaccgggacaagcgcugaccugaccguggagaaagccgccgacguuacaugggaagaggaagcugagcagacgggagugucucauaaccucaugauuaccgucgaugacgauggcacaaugcggaucaaggacgaugaaaccgagaacauucugacagugcuucugaaaaccgcccugcucaucgucuccggcaucuucccuuacagcauucccgcgacgcugcuuguguggcacaccuggcagaagcagacacaacgcucugggguucugugggacgugccuucucccccggagacccagaaagcugaacucgaggaaggagucuacagaaucaagcagcagggcauuuuugggaagacacaagugggaguuggcgugcagaaagagggggucuuccauaccauguggcacgugacacggggagccgugcugacgcacaauggcaagcgccucgagccuaacugggccagcguuaaaaaggaucugaucagcuauggcgggggauggagacuuaaugcucaguggcaaaaaggcgaagagguccaggugauugccguggaacccgggaagaacccuaagaauuuccagaccaugcccggaaucuuucagacaaccaccggcgagauuggggcgaucgcucuggacuucaaacccggaacauccggcagcccuaucauuaaccgggaaggcaaggucguggggcuguacggaaauggcguugugacgaaaaacgggggauaugucuccggcaucgcccaaaccaaugccgagccggaugggcccacaccugagcucgaagaggaaauguuuaagaaacgcaaccugaccauuauggaccuucaucccggcagcggaaagacaagaaaguaccugccugcuaucgugcgggaggccauuaaacgcagacuccggacccugauccucgcucccacgagaguuguggccgcggaaauggaggaggcccugaagggccuuccuauccgcuaucagacaaccgcuaccaaaucugaacacacagggcgggagauugucgaucugaugugccaugccaccuucacaaugagacugcucagcccggugcgcguucccaauuacaaccuggugaucauggacgaagcucacuuuaccgauccugccuccauugccgcucggggauauaucucuacgagagucggcaugggggaggcggccgcuauuuucaugacagccacacccccuggaacagccgaggcuuuuccccagagcaaugccccgauccaggacgaggagcgcgacaucccugaacgguccuggaacucuggcaaugaguggauuaccgauuucguggggaagacggugugguuuguccccagcaucaaagcgggcaacgacauugcuaacugucuuagaaagaauggaaagaaaguuauccaacugucccgcaagaccuucgauacagaauaccagaaaacccggcucaacgacugggauuuuguggugacaaccgacauuucugagaugggcgccaauuucaaggccgauagagucaucgacccccggcgcugccugaaaccugugauucugacagaugggcccgagagaguuauccucgcuggaccuaugccggugaccgccgcgagcgccgcucagcggcgcggcagagucgggcggaacccccagaaggaaaaugaccaauacaucuucacgggacagccucuuaacaaugaugaggaccaugcccacuggacagaagcuaagaugcugcuggacaacauuaauacccccgagggcaucauuccugcccucuuugaacccgagagagagaaauccgcugccaucgauggggaauaucgccugaagggcgagagccggaaaaccuucguggaacuuaugagacgcggagaccugccgguuuggcucgcgcacaagguggccucugagggcauuaaauacacagaucggaaguggugcuuugacggggaaagaaacaaucagauccuggaggagaacauggaugucgaaaucuggaccaaagagggagaacgcaagaagcugcggccuagauggcucgacgcucgcacauauuccgauccccuugcccugaaagaguucaaggacuuugcugccggcagaaaaagcauugcccuggaucucgugacggaaaucgggcgggucccuucucaucuggcucaccgcaccagaaaugcgcuugacaaccuggugaugcuccauacauccgagcacggaggccgggccuaccgccacgcuguugaggaacugcccgagaccauggaaacacugcuccuucugggccugaugauucuccugaccgggggagccaugcuuuuccugaucagcggcaaggggauuggaaaaacguccaucggccucaucugugugauugugucuagcgggaugcuguggauggccgaugucccucugcaguggaucgcuuccgccauuguucucgaguuuuucaugauggugcuucugauccccgagccggaaaagcaaagaaccccucaggacaaucagcuggcguauguggucauuggaauccucacacuggccgcuauuguggccgcuaacgagaugggccuucuggaaaccacaaagcgggaucucggcaugagcaaagagcccgggguugugucucccaccuccuaccuggacgucgaccugcauccugccagcgcguggacgcucuaugccguggcuacaaccgucaucacaccgaugcuuagacacaccaucgaaaauucuaccgccaacgugagccuggcugccauugcuaaccaagccguugugcugaugggacucgauaagggcuggcccaucuccaaaauggaccugggggucccucuucuggcgcucggaugcuacucucaggugaauccccugacacugacggccgcuguucuccuucuggugacccauuacgccauuaucggcccugggcugcaggcuaaggccacacgcgaggcccagaaacggaccgcggcuggaauuaugaagaaccccacagucgauggcaucaugaccaucgaccucgauccugugauuuaugacagcaaguuugagaaacaacugggccaggugaugcuucugguucucugugccguccagcugcugcucaugagaacguccugggcucuuugcgaagcccugacacuggccaccgggccgaucaccacacucugggagggaucucccggcaaguucuggaauaccacaauugcugugagcauggccaacaucuuucgcggguccuaccuggcgggagccggccuugcuuucagcauuaugaaaucuguggggacgggacggagaggcaccggcucccagggggaaacacugggagagaaguggaaaaagaagcucaaucaacugagccggaaagaauuugaucuguauaagaaauccggcaucaccgaggucgaccgcacagaggccaaggaagggcucaaaagaggagagaccacgcaccaugcuguuucucggggcagcgccaaacuucagugguucguggaacgcaacauggugaucccugaggggagagucauugaucugggauguggccggggcgggugguccuacuauugcgcgggacugaaaaaggugaccgaaguucgcggcuacacaaaaggcgggcccgggcacgaggagccugugcccaugucuaccuauggguggaauaucgucaaacucaugagcggaaaggacguguucuaccugccgccugaaaaaugugauacacuucugugcgacauuggcgaguccagccccucucccaccguugaagaguccagaacaauccgggugcucaagauggucgagccuuggcugcgcaacaaucaguuuuguauuaaagugcugaaccccuacaugccuaccgugaucgaacaccucgagagacuucagcggaaguauggcgggaugcuggucagaaauccgcugagccgcaacucuacgcaugaaauguacuggauuuccaauggaacaggcaacaucguuagcucugugaauauggugagccggcuccugcuuaacagauucaccaugacccaccgccggcccacaaucgagaaggaugucgaccugggggccggaacgagacaugugaacgcugaaccugagacccccaauauggacguuauuggcgagcgcaucaaacggauuaaggaagaacacuccucuacauggcacuaugaugacgaaaacccuuacaaaaccugggccuaucaugggagcuacgaggugaaggcuacaggauccgccagcuccaugaucaauggcgucgugaaacuccugaccaagcccugggauguugugccgauggucacacaaauggcuaugaccgacacgaccccuuuuggccagcagagaguguucaaggaaaaaguugauacacgcacaccccggccuaugcccgggacaagaaaggugauggagauuaccgccgaguggcuguggcgcacgcucggacggaacaaaaagccuagacugugcacacgcgaagaguuuaccaaaaaggucagaacaaaugcggccaugggcgcuguguucaccgaagagaaccaaugggacucugcccgggcugccgucgaagaugaggaguuuuggaaacuuguggaccgcgaaagagagcugcacaaacucgggaaguguggaagcugcguuuauaauaugaugggcaaacgggaaaagaaacugggggaguucggcaaggccaaaggauccagagcgaucugguacauguggcuuggcgcucgguaccuggaguuugaagcccucggguuccugaacgaggaucauugguuuucucgcgaaaauagcuauuccggaguggagggcgaagggcugcacaagcucggauacauccugagagacauuucuaagauccccggcggggccauguaugcugaugacacggccggcugggacacccggauuacagaggaugaccuucauaacgaggagaagaucacccagcagauggauccggagcaccgccagcuggcuaaugccauuuucaagcucacauaccaaaacaaagucgugaaggugcagagaccuacccccaaaggaacaguuauggacaucaucagccggaaggaucagcgcggcuccggacaggugggaaccuauggccugaauacguuuacaaacauggaagcgcaacuugucagacagauggagggggaaggagugcugagcaaggccgaccucgagaauccccaucugcuggagaaaaagauuacccaguggcucgaaaccaaaggcguugagcggcugaagcgcauggcuaucucuggggaugacugcguggucaaaccuauugaugacagauucgccaacgcccuucuggcccucaacgauaugggcaaggugcggaaggacaucccgcaguggcaacccuccaaaggauggcaugauuggcagcaggucccuuucuguagccaccauuuucacgaacugauuaugaaggacggccgcaaacuugugguucccugcagaccucaggacgagcugaucgggcgggcgcgcaucucucaaggagccggcuggucccucaaggaaacagcuugucuggggaaagccuacgcucagauguggagccugauguauuuccacagacgggaucucagacuggccucuaaugcuauuugcuccgccgugcccguccauuggaucccuaccagccgcacaacgugguccauucacgcgcaucaccaguggaugaccacagaggacaugcuuaccguguggaaccggguuuggaucgaggauaaucccuggauggaagacaagacaccggugaccacgugggaggaugucccuuaccugggaaagagagaagaccaaugguguggcagccucauugggcugaccucucgcgccacaugggcucagaacauccuuaccgccauucaacaggugcggagccugaucggcgaugaggaguuucucgacuacaugcccuccaugaaaagauuccgcaaggaagaggaaucugagggagccaucugguga

SEQ ID NO: 20470 - RNA, 9873 nt, Artificial Sequence
  derived and/or modified CDS sequence (opt5) from DENV-3__GU131912__SS-prME
acaagccugugccucaugaugaugcugcccgccacacuugcuuuccaccugacgucccgggacggcgaaccucggaugaucguggggaagaacgaacgcggaaaaucucuccuguuuaagaccgccagcggcauuaauauguguacacuuaucgcgauggaucugggggaaaugugcgacgauaccgucacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccaauauuuucgccggacaccucaagugucgccugaaaauggauaaacuugaacugaaaggcaugucuuacgccaugugccucaacacauuugugcugaagaaagagguuuccgagacgcagcaugggaccauccugauuaagguggaauacaagggagaggacgcucccuguaaaaucccuuucagcacagaagauggccaagggaaggcccacaacggaagacuuaucaccgcgaaucccgucgugaccaagaaagaggagcccauuaacaucgaagcugagccuccguucggcgaauccaauauugugaucgggauuggcgacaaagcccucaagaucaacugguauaagaaaggaucuagcaucggcaagauguuugaggccaccgcuagaggggccagacgcauggcuauucugggagauacggccugggacuucggcuccguugggggaguccugaauagccucggcaaaauggugcaucagaucuuugggucugcguacacagcccuguucuccggcgugagcuggauuaugaagaucggaauuggcguccuucugaccuggaucgggcucaacucuaaaaauaccagcauguccuuuucuugcauugugaucggaaucauuacacuguaucugggcgcuguugugcaggccgauauggggugugucaucaacuggaagggaaaggaacuuaaaugcggcaaugggauuuucgugaccaacgagguucacacauggacggagcaguacaaguuucaagcugacagccccaaacggcucgccaccgcgaucgccggcuccugggaaaauggaguguguggcauuagaagcacaacccgcauggagaaccugcuguggaagcagaucgcuaaugaacucaacuauauccugugggagaauaacauuaaacuuacagucgugguuggggauaucauuggagugcuggaacagggcaagcggacccucacgccucagcccauggagcugaaauacucuuggaagaccugggggaaggccaaaaucgucacagcugagacccaaaacuccagcuucauuaucgacggaccuaauacacccgaaugcccgucugccuccagagccuggaacgugugggagguggaagacuauggcuuuggcgucuucaccacaaauaucuggcugaaacuucgcgagguuuacacccagagcugugaucaucggcucauguccgcugcgauuaaagacgaaagagccgugcacgcugauaugggguacuggaucgagucucagaagaacggaagcuggaaacuggagaaggccuccuuuauugaagugaagacgugcacauggccuaaaucucacacccuguggagcaauggcguccucgaguccgacaugaucauucccaagagccuggccgggccuaucucucagcauaaccaccgccccggauaucauacccaaacagcuggcccuuggcaccuugggaaacuggaacucgauuucaauuacugcgagggaaccacggugguuaucgccgagaacuguggcacacggggccccucccugagaaccacaaccgugagcgggaagcugauucacgaauggugcugucgcucuugcacacuuccgccucuccgguauaugggagaggacggcuguugguacgggauggaaaucagacccauuaaugagaaagaagagaacauggucaagucccuggugagcgcgggaucuggcaagguugauaauuuuaccaugggggugcugugccucgcuauccuguucgaggaagucaugcggggaaaauucggcaagaaacauaugauugccggcgugcuuuuuacguucguucugcuccugagcgggcagaucaccuggcgcgacauggcccacacacugauuaugaucggauccaacgcuagcgauagaaugggcaugggggugaccuaucuugcccugaucgcgacauuuaagauucagcccuuccucgcucugggauuuuuccuccggaaacugaccucuagagagaaucuucugcucggcgucgggcuggccauggccacgacacugcaacuuccugaagacaucgagcagauggcuaacggaauugcccugggccucaugacccugaagcucaucacacaguuugaaaccuaccagcuguggaccgcucuugugucccugacauguagcaauacgauuuucacccucacaguggccuggcgcaccgcgacacugauccuggccggcgucucccuucugccgcucugccaaucuagcuccaugcggaagaccgauuggcugcccaugacgguugcugccaugggggugccuccccucccucuguuuaucuucucucuuaaagacacacccaagagaaaaagcuggccucugaacgagggagugauggcugucggccugguguccauucucgccucuagccugcuucgcaacgauguucccauggccgggccgcugguggcuggaggccuccugaucgcguguuaugucauuaccgggaccuccgccgaccucacaguggagaaggcugccgacguuaccugggaagaggaagccgagcagacaggagugagccauaaucugaugaucacggucgaugacgauggcaccaugagaauuaaagacgaugaaacagagaacauccuuaccgugcugcugaagacagcucuccugaucgucucuggcauuuuuccuuacuccauccccgccacccuucugguguggcacacguggcagaaacagacccaacggagcgggguucucugggacgugccuucucccccggagacacagaaggcggaacuggaggaaggagucuaccgcauuaagcagcagggcaucuucgggaaaacccaagugggaguuggcgugcagaaggagggggucuuucauacaauguggcacgugaccagaggagcugugcucacacacaauggcaaacggcuggagccuaacugggccuccguuaagaaagaucuuauuagcuauggcgggggauggcgccugucugcccaguggcaaaagggcgaagagguccaggugaucgcuguggaacccgggaagaauccuaaaaacuuccagacgaugcccggaauuuuccagaccacaaccggcgagaucggggccaucgcgcuggacuuuaagcccggaaccuccggcagcccuauuaucaauagagaaggcaaagucguggggcucuacggaaacggcguugugacaaagaaugggggauaugucuccggcauugcucaaacgaacgccgagccggaugggcccaccccugagcuggaagaggaaauguucaaaaagcggaaucuuacaaucauggaccugcaucccggcagcggaaagacccgcaaauaccucccugccauugugagagaggcuaucaagcggcgccugagaacacucauccuggcccccacccggguuguggcugccgaaauggaggaggcgcuuaaaggccugccuauuagauaucagacgacagccucuaagagcgaacacaccgggcgcgagaucgucgaucugaugugccaugcuaccuuuacaaugcggcuccuguccccggugagaguucccaacuacaaucuuauuaucauggacgaagcccacuucaccgauccugcuucuauugccgcccgcggauauaucagcacacgggugggcaugggggaggcugcggccaucuuuaugaccgcuacgcccccuggaacagccgaagccuucccccaguccaacgcuccgauucaggacgaggagagagacaucccugaacgcucuuggaauagcggcaacgaguggauuaccgauuuugucgggaaaacagugugguucgugcccuccaucaaggccggcaacgacauugcgaauugucugcggaagaacggcaaaaaggucauccaacucucuagaaaaaccuuugauacggaauaccagaagacccgccugaaugacugggauuucguugugacaaccgacauuagcgagaugggagcuaacuuuaaagccgaucgggugaucgaccccagacggugccugaagccugucauccucacagaugggcccgagcgcgugauucuugccggaccuaugccgguuaccgcugccuccgcggcccagagacggggccgcguggggagaaauccccagaaggaaaacgaccaauacaucuucacaggacagccucugaauaacgaugaggaccaugcucacuggaccgaagccaaaaugcugcucgacaauauuaacacgcccgagggcaucauuccugcucuguucgaacccgagcgggaaaagagcgccgcuaucgauggggaauauagacuuaaaggcgagucucgcaagacauuugucgaacugaugcggagaggagaccucccgguguggcuggcccacaaaguugcguccgagggcaucaaguacaccgaucgcaaauggugcuucgacggggaacggaauaaccagauucuggaggagaauauggauguggaaaucuggaccaaggagggagaaagaaagaaacuccgcccucgguggcuugacgccagaacauauagcgauccccuggcucugaaggaguuuaaagacuucgccgcuggccgcaagucuauugcccucgaucuggucaccgaaaucgggagagugccuucccaucuugcccaccggacacgcaacgcucuggacaaucucgucaugcugcauacgagcgagcacggaggcagagcguaccggcacgccguggaggaacugcccgagaccauggaaacacuccuucugcugggccucaugauucugcuuaccgggggagcuaugcuguuucucaucuccggcaaagggaucggaaagacaucuauuggccugaucuguguuauugugagcuccgggaugcuguggauggccgaugugccucuccaguggaucgccagcgcuauuguccuugaguucuuuaugaugguucugcugauccccgagccggaaaagcaacgcaccccucaggacaaccagcucgccuauguggugauuggaauccugacgcuugcggccaucgucgcugccaaugagaugggccugcucgaaaccacaaaaagagaucugggcaugucuaaggagcccggggugguuucccccaccagcuaccuggacguggaccuccauccugcuucugccuggacacuuuaugcggucgccaccacggugauuacaccgaugcugcggcacaccaucgaaaacagcacagcuaacgucucccuggccgcuauugccaaucaagcugugguucucaugggacuggauaaaggcuggcccaucucuaagauggaccuuggggugccucugcucgcccugggaugcuacagccaggucaacccccugacccucaccgcggccgugcuucugcugguuacacauuacgcuauuaucggcccugggcuccaggccaaagcuacgagagaggcccagaagcgcaccgccgcgggaaucaugaagaaucccacaguggauggcauuaugaccaucgaccuggauccugucauuuaugacuccaaauucgagaagcaacuuggccaggugaugcugcucgugcugugugcuguucagcugcuccuuaugcggacaucuugggcccugugcgaagcucugacccucgccacggggccgaucacaacccugugggagggaagccccggcaaauuuuggaacaccacaauugccgucuccauggcuaauaucuucagagggagcuaccuugccggagcgggccuggccuuuucuaucaugaaguccguggggaccggacgccggggcacaggcagccagggggaaacgcucggagagaaauggaagaagaaacugaaccaacuguccagaaaggaguucgaucucuauaaaaagucuggcauuaccgagguggaccggacagaggcuaaagaagggcuuaagcgcggagagaccacacaccaugccgucagcagaggcuccgcuaaacugcagugguuuguugaacggaauauggugaucccugaggggcgcgugauugaucugggauguggcagaggcggguggucuuacuauugcgccggacucaagaaggucaccgaagugcggggcuacacgaaagggggacccggccacgaggagccuguucccaugagcaccuauggguggaacaucgugaagcugauguccggaaaagacgucuucuaccuuccgccugaaaagugugauacacugcucugcgacauuggcgagagcucucccucccccaccguggaagagagccgcacaaucagaguucugcggaugguggagccuuggcugcgcaauaaccaguucuguauuaaaguccucaaucccuacaugccuaacgugaucgaacaccuugagagacugcagcggaaguauggcgggaugcuggugagaaauccgcucucucgcaacuccacccaugaaauguacuggaucagcaauggaacaggcaacauugucucuagcguuaacauggugucccggcugcuucugaauagauuuaccaugacgcaccgccggcccacaaucgagaaggauguggaccucggggcgggaaccagacaugucaacgccgaaccugagacccccaauauggacgugauuggcgagcgcaucaaacggauuaaggaagaacacucuagcacauggcacuaugaugacgaaaacccuuacaaaacgugggcuuaucauggguccuacgagguuaaggccaccggaagcgcuuccucuaugaucaauggcguggucaaacugcugacaaagcccugggaugugguuccgauggugacccaaauggccaugacagacaccacaccuuucggccagcagagagucuuuaaggaaaaaguggauacccgcacgccccggccuaugcccgggaccagaaagguuauggagaucacagcugaguggcucuggcgcacccugggacggaacaaaaagccuagacuuugcacacgcgaagaguucaccaaaaaggugagaacgaaugccgcgaugggcgccgucuuuacagaagagaaccaaugggacagcgcucgggccgcuguggaagaugaggaguucuggaagcuggucgacaaagaacgcgagcuccacaagcuggggaaauguggauccugcguguauaauaugaugggcaagagagagaagaaacuuggggaguuuggcaaagccaagggaucucgggccauuugguacauguggcugggcgcgagauaccucgaguucgaagcucugggguuucugaacgaggaucauugguucagccgggaaaauuccuauucuggaguugagggcgaagggcuccacaagcugggauacauccuucgcgacauuagcaaaauccccggcggggccauguaugccgaugacaccgcuggcugggacacaagaauuaccgaggaugaccugcauaacgaggaaaagaucacgcagcagauggauccggagcaccggcagcucgccaaugcuaucuuuaaacugaccuaccaaaacaagguggucaaagugcagcgcccuacacccaagggaaccgugauggacauuaucuccagaaaggaucagcggggcagcgggcagguuggaacauauggccuuaauaccuucacaaacauggaagcccaacuggugcgccagauggagggggaaggaguccucucugaggcggaccuggagaacccccaucugcucgagaagaagauuacccaguggcuggagacgaaaggcguggaaagacuuaagcggauggccaucuccggggaugacugcguugugaaaccuauugaugaccgcuuugcuaaugcccugcucgcucugaacgauaugggcaaggucagaaaggacaucccgcaguggcaacccagcaaaggauggcaugauuggcaacaggugccuuucuguucucaccauuuccacgagcuuaucaugaaggacggccggaaacuggucgugcccugccgcccucaggacgaacucauugggagagcccggaucucccaaggagcgggcuggagccugaaggagacagccugucuggggaaggcuuacgcccagauguggucucucauguauuuucaccgcagagaucugcggcuugcuuccaaugccauuugcagcgcuguucccgugcauuggaucccuaccuccagaaccacauggagcauucacgcccaucaccaguggaugaccacagaggacaugcugacggucuggaaccgcguguggaucgaagauaaucccuggauggaggacaagaccccgguuacaaccugggaagaugugccuuaccucggaaagcgggaggaccaaugguguggcucucugauugggcuuacaagcagagcgaccugggcccagaacauccugacggcuauccagcagguccgcucccucauuggcgaugaggaguuccuggacuacaugcccucuaugaaacgguuuagaaaggaggaagagagcgaaggagccaucugguga

SEQ ID NO: 20471 - RNA, 9873 nt, Artificial Sequence
  derived and/or modified CDS sequence (opt5) from DENV-3__GU131913__SS-prME
accagccugugccucaugaugaugcugcccgccacacuugcuuuccaccugacgucccgggacggcgaaccucggaugaucguggggaagaacgaacgcggaaaaucucuccuguuuaagaccgccagcggcauuaauauguguacacuuaucgcgauggaucugggggaaaugugcgacgauaccgugacauacaaauguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacagcuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccauuaauaucgaagcugagccuccguucggcgaaucuaacauugugaucgggauuggcgacaaagcccucaagaucaauugguauaagaaaggaagcuccaucggcaagauguuugaggccaccgcuagaggggccagacgcauggcuauucugggagauacggccugggacuucggcagcguugggggaguccugaacucucucggcaaaauggugcaucagaucuuuggguccgcguacacagcccuguucagcggcgugucuuggauuaugaagaucggaauuggcguccuucugaccuggaucgggcucaauagcaaaaacaccuccaugucuuuuagcugcauugugaucggaaucguuacacuguaucugggcgcugugguccaggccgauauggggugugugauuaauuggaagggaaaggaacuuaaaugcggcaacgggaucuucguuaccaaugaggugcacacauggacggagcaguacaaguuucaagcugacucccccaaacggcucgccaccgcgauugccggcgcuugggaaaacggagucuguggcaucagaagcacaacccgcauggagaaucugcuguggaagcagauugccaacgaacucaauuauauccugugggagaacaauaucaaacuuacagugguugugggggauauuaucggaguccuggaacagggcaagcggacccucacgccucagcccauggagcugaaauacucuuggaagaccugggggaaggcuaaaauugugacagccgagacccaaaacuccagcuucaucauugacggaccuaacacacccgaaugcccgucugccuccagagcuuggaaugugugggaggucgaagacuauggcuuuggcguuuucaccacaaacaucuggcugaaacuucgcgaggugcauacccagagcugugaucaccggcucauguccgcggccaucaaagacgaaagagcugugcacgccgauaugggguacuggauugagucucagaagaauggaagcuggaaacuggagaaggccuccuuuaucgaagucaagacgugcacauggccuaaaucucauacccuguggagcaacggcgugcucgaguccgacaugauuauccccaagagccuggcugggccuauuucucagcacaaucaucgccccggauaccacacccaaacagccggcccuuggcaccuugggaaacuggaacucgauuucaacuauugcgagggaaccacgguugugaucgcggagaauuguggcacacggggccccucccugagaaccacaaccgucagcgggaagcugauccaugaauggugcugucgcucuugcacacuuccgccucuccgguacaugggagaggacggcuguugguaugggauggaaauuagacccaucaacgagaaagaagagaauauggugaagucccugguuagcgcuggaucuggcaagguggauaacuuuaccauggggguccugugccucgccauucuguucgaggaagugaugcggggaaaauucggcaagaaacacaugaucgccggcguucuuuuuacguucgugcugcuccugagcgggcagauuaccuggcgcgacauggcucauacacugaucaugauuggauccaaugccagcgauagaaugggcaugggggucaccuaccuugcgcugaucgcuacauuuaagauccagcccuuccucgcccugggauuuuuccuccggaaacugaccucuagagagaaccuucugcucggcguggggcuggccauggcuacgacacugcaacuuccugaagacauugagcagauggccaauggaaucgcucugggccucaugacccugaagcucauuacacaguuugaaaccuaucagcuguggaccgcccuugugucccugacauguagcaacacgaucuucacccucacagucgcguggcgcaccgccacacugauucuggcuggcguuucccuucugccgcucugccaaucuagcuccaugcggaagaccgauuggcugcccaugacgguggccgcuaugggggugccuccccucccucuguuuaucuucucucuuaaagacacacccaagagaaaaagcuggccucugaaugagggagucauggccgugggccugguuuccauccucgccucuagccugcuucgcaacgaugugcccauggcugggccgcuggucgcgggaggccuccugauugccuguuacgugaucaccgggaccuccgcugaccucacaguugagaaggccgccgacgugaccugggaagaggaagcugagcagacaggagucagccacaaccugaugauuacgguggaugacgauggcaccaugagaaucaaagacgaugaaacagagaauauucuuaccguccugcugaagacagcccuccugaucgugucuggcaucuuuccuuauuccauucccgcgacccuucugguuuggcauacguggcagaaacagacccaacggagcggggugcucugggacgucccuucucccccggagacacagaaggcugaacuggaggaaggaguguaccgcaucaagcagcagggcauuuucgggaaaacccaaguuggagugggcguccagaaggaggggguguuucacacaauguggcacgugaccagaggagccguucucacacauaacggcaaacggcuggagccuaauugggccuccgucaagaaagaucuuaucagcuacggcgggggauggcgccugucugcucaguggcaaaagggcgaagagguccaggugauugccgucgaacccgggaagaacccuaaaaauuuccagacgaugcccggaaucuuccagaccacaaccggcgagauuggggcgaucgcucuggacuuuaagcccggaaccuccggcagcccuaucauuaacagagaaggcaaagugguugggcucuauggaaauggcguggucacaaagaacgggggauacguguccggcaucgcccaaacgaaugccgagccggaugggcccaccccugagcuggaagaggaaauguucaaaaagcggaaccuuacaauuauggaccugcaccccggcagcggaaagacccgcaaauaucucccugcuaucguuagagaggccauuaagcggcgccugagaacacucauccuggcucccacccggguggucgccgcggaaauggaggaggcccuuaaaggccugccuaucagauaccagacgacagcuaccaagucugaacauaccgggcgcgagauuguggaucugaugugccacgccacauuuaccaugcggcuccugagcccgguuagagugcccaauuauaaccuugucaucauggacgaagcucauuucacagauccugccuccauugccgcucgcggauacaucucuacccgggugggcaugggggaggcggccgcuauuuuuaugacggccacacccccuggaaccgccgaggcuuucccccagagcaaugccccgauccaggacgaggagagagacaucccugaacgcuccuggaacucuggcaaugaguggauuacagauuuuguggggaaaaccgucugguucguucccagcaucaaggcgggcaacgacauugcuaacugucugcggaagaauggcaaaaaggugauccaacucuccagaaaaacguuugauaccgaauaucagaagacacgccugaacgacugggauuucguggucaccacagacauuucugagaugggagccaauuuuaaagccgaucgggugaucgaccccagacggugccugaagccuguuauucucaccgaugggcccgagcgcgugauccuugcuggaccuaugccggucacagccgcgagcgccgcucagagacggggccgcguggggagaaacccccagaaggaaaaugaccaauacaucuucaccggacagccucugaacaaugaugaggaccacgcccacuggacggaagcuaaaaugcugcucgacaacauuaauacacccgagggcaucauuccugcccuguucgaacccgagcgggagaaguccgcugccaucgauggggaauacagacuuaaaggcgagagccgcaagaccuuuguugaacugaugcggagaggagaccucccgguguggcuggcgcauaaagucgccucugagggcauuaaguauaccgaucgcaaauggugcuucgacggggaacggaacaaucagauccuggaggagaacauggauguggaaaucuggacaaaggagggagaaagaaagaaacuccgcccucgguggcuugacgcuagaaccuacuccgauccccuggcccugaaggaguuuaaagacuucgcugccggccgcaagagcauugcccucgaucuggucacagaaaucgggagagugccuucucaccuugcucaucggacgcgcaaugcgcuggacaaccucguuaugcugcacaccuccgagcacggaggcagagccuaucggcaugcuguggaggaacugcccgagacaauggaaacccuccuucugcugggccucaugauucugcuuacagggggagccaugcuguuucucaucagcggcaaagggauuggaaagaccuccaucggccugaucugugugauugucucuagcgggaugcuguggauggccgauguuccucuccaguggaucgcuuccgccauugugcuugaguucuuuaugauggugcugcugauccccgagccggaaaagcaacgcacgccucaggacaaucagcucgcguacgucgugauuggaauccugacccuugccgcuauuguugccgcuaacgagaugggccugcucgaaacaaccaaaagagaucugggcaugagcaaggagcccgggguggucucucccacauccuaucuggacguggaccuccacccugccagcgcguggacccuuuacgccgucgcuacgacagugaucaccccgaugcugcggcauacaaucgaaaauucuaccgccaacguuagccuggcugccauugcuaaccaagccgugguccucaugggacuggauaaaggcuggcccaucuccaagauggaccuuggggugccucugcucgcgcugggaugcuauucucagguuaauccccugacccucacagccgcugugcuucugcuggucacgcacuacgccauuaucggcccugggcuccaggcuaaagccaccagagaggcccagaagcgcacagcggcuggaauuaugaagaaccccaccguggauggcaucaugacaaucgaccuggauccugugauuuacgacagcaaauucgagaagcaacuuggccagguuaugcugcucguccugugugccgugcagcugcuccuuaugcggaccuccugggcucugugcgaagcccugacgcucgccacagggccgaucaccacccugugggagggaucucccggcaaauuuuggaauacaaccauugcugugagcauggccaacaucuucagaggguccuaucuugcgggagccggccuggcuuuuagcauuaugaagucugucgggacaggacgccggggcacgggcucccagggggaaacccucggagagaaauggaagaagaaacugaaucaacugagcagaaaggaguucgaucucuacaaaaaguccggcaucacagagguugaccggaccgaggccaaagaagggcuuaagcgcggagagacaacccaucacgcugugucuagaggcagcgccaaacugcagugguuuguggaacggaacauggucaucccugaggggcgcgugauugaucugggauguggcagaggcgggugguccuauuacugcgcgggacucaagaagguuacggaagugcggggcuauaccaaagggggacccggccacgaggagccuguccccaugucuacauacggguggaauaucgugaagcugaugagcggaaaagacguuuucuaucuuccgccugaaaagugugauacccugcucugcgacauuggcgaguccagccccucucccacaguggaagagucccgcaccaucagaguccugaaaaugguggagccuuggcugcggaacaaucaguucuguauuaaggugcucaaccccuacaugccuaaugucaucgaacaucuugagcgccugcagagaaaguacggcgggaugcugguucggaacccgcucagcagaaauucuacacacgaaauguauuggauuuccaacggaaccggcaauaucgugagcucugugaacauggucagccgccugcuucugaaccgguuuacgaugacacauagacgccccaccaucgagaaagauguggaccucggggccggaacccggcacguuaaugcugaaccugagacacccaacauggacgugauuggcgagagaaucaagcgcauuaaagaagaacacuccucuacguggcauuacgaugacgaaaauccuuauaagaccugggccuaccacgggagcuaugaggucaaagcuacaggauccgccagcuccaugaucaacggcgugguuaagcugcugaccaagcccugggauguggucccgauggugacacaaauggcuaugaccgacacaaccccuuucggccagcagcggguuuuuaaagaaaagguggauacgagaacaccccgcccuaugcccgggacacggaaagucauggagauuaccgccgaguggcucuggagaacacugggacgcaauaagaaaccucggcuuugcaccagagaagaguucacgaagaaggugcgcacaaacgcggccaugggcgcugucuuuaccgaagagaaucaaugggacucugccagagcugccguggaagaugaggaguucuggaaacugguugacaaggaacgggagcuccauaaacuggggaaguguggaagcugcguguacaacaugaugggcaaacgcgaaaagaaacuuggggaguuuggcaaggccaagggauccagagcgaucugguauauguggcugggcgcucgguuccucgaguuugaagcccugggguuccugaaugaggaucacugguuuucuagagaaaacagcuacuccggagucgagggcgaagggcuccauaaacugggauacauccuucgggacauuucuaagauccccggcggggccauguaugcugaugacacagccggcugggacacccgcauuacggaggaugaccugcacaaugaggagaagaucacccagcagauggauccggagcacagacagcucgcuaacgccauuuucaagcugacauaccaaaauaaaguggugaagguucagcggccuacccccaagggaacagugauggacaucaucagccgcaaagaucagagaggcuccgggcaggucggaaccuauggccuuaacacauuuaccaauauggaagcgcaacuggugcggcagauggagggggaaggaguucucagcgaggccgaccuggagaacccccaucugcucgaaaagaaaauuacgcaguggcuggagacaaagggcguggaacgccuuaaaagaauggcuaucucuggggaugacugcgucgugaagccuauugaugaccgguucgccaacgcucugcucgcccugaaugauaugggcaagguccgcaaagacaucccgcaguggcaacccuccaagggauggcacgauuggcaacaggugccuuucuguagccaucacuuucacgagcuuauuaugaaagacggcagaaagcugguugugcccugccggccucaggacgaacucaucgggcgcgcgagaaucucucaaggagccggcuggucccugaaagagaccgcuugucuggggaaggccuacgcucagauguggagccucauguauuuccaucggcgcgaucugagacuugccucuaacgcuauuugcuccgccguccccgugcacuggaucccuaccagccggacaaccugguccauucaugcgcaccaucaguggaugacaacggaggacaugcugaccguuuggaauagaguguggaucgaagauaaccccuggaugggagacaagacaccggucaccacaugggaggaugugccuuaccucggcaaacgcgaagaccaauggugugggagccugauuggccuuaccucucgggccacgugggcucagaauauccugaccgccauucaacaggugagaagccucaucggagaugaggaguuucuggacuauaugcccuccaugaagcgcuuccggaaagaagaggaaucugagggcgccaucugguga

SEQ ID NO: 20472 - RNA, 9873 nt, Artificial Sequence
  derived and/or modified CDS sequence (opt5) from DENV-3__GU131914__SS-prME
accagccugugccucaugaugaugcugcccgccacacuugcuuuccaccugacgucccgggacggagaaccucggaugaucguggggaagaacgaacgcgggaaaucucuccuguuuaagaccgccagcggcauuaauauguguacacuuaucgcgauggaucugggggaaaugugcgacgauaccgucacauacaaauguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccauuaauaucgaagcugagccuccguucggcgaaucuaacauugugaucgggauuggcgacaaagcccucaagaucaauugguauaagaaaggaagcuccaucggcaagauguuugaggccaccgcuagaggggccagacgcauggcuauucugggagauacggccugggacuucggcagcguugggggaguccugaacucucucggcaaaauggugcaucagaucuuuggguccgcguacacagcccuguucagcggcgugucuuggauuaugaagaucggaauuggcguccuucugaccuggaucgggcucaauagcaaaaacaccuccaugucuuuuagcugcauugugaucggaaucauuacacuguaucugggcgcuguugugcaggccgauauggggugugucaucaauuggaagggaaaggaacuuaaaugcggcaacgggauuuucgugaccaaugagguucacacauggacggagcaguacaaguuucaagcugacucccccaaacggcucgccaccgcgaucgccggcgcuugggaaaacggaguguguggcauuagaagcacaacccgcauggagaaucugcuguggaagcagaucgccaacgaacucaauuauauccugugggagaacaauauuaaacuuacagucgugguuggggauaucauuggagugcuggaacagggcaagcggacccucacgccucagcccauggagcugaaauacucuuggaagaccugggggaaggcuaaaaucgucacagccgagacccaaaacuccagcuucauuaucgacggaccuaacacacccgaaugcccgucugccuccagagcuuggaaugugugggagguggaagacuauggcuuuggcgucuucaccacaaacaucuggcugaaacuucgcgagguucauacccagagcugugaucaccggcucauguccgcggccauuaaagacgaaagagcugugcacgccgauaugggguacuggaucgagucucagaagaauggaagcuggaaacuggagaaggccuccuuuauugaagugaagacgugcacauggccuaaaucucauacccuguggagcaacggcguccucgaguccgacaugaucauucccaagagccuggcugggccuaucucucagcacaaucaucgccccggauaccacacccaaacagccggcccuuggcaccuugggaaacuggaacucgauuucaacuauugcgagggaaccacggugguuaucgcggagaauuguggcacacggggccccucccugagaaccacaaccgugagcgggaagcugauucaugaauggugcugucgcucuugcacacuuccgccucuccgguacaugggagaggacggcuguugguaugggauggaaaucagacccauuaacgagaaagaagagaauauggucaagucccuggugagcgcuggaucuggcaagguugauaacuuuaccaugggggugcugugccucgccauccuguucgaggaagucaugcggggaaaauucggcaagaaacacaugauugccggcgugcuuuuuacguucguucugcuccugagcgggcagaucaccuggcgcgacauggcucauacacugauuaugaucggauccaaugccagcgauagaaugggcaugggggugaccuaccuugcgcugaucgcuacauuuaagauucagcccuuccucgcccugggauuuuuccuccggaaacugaccucuagagagaaccuucugcucggcgucgggcuggccauggcuacgacacugcaacuuccugaagacaucgagcagauggccaauggaauugcucugggccucaugacccugaagcucaucacacaguuugaaaccuaucagcuguggaccgcccuugugucccugacauguagcaacacgauuuucacccucacaguggcguggcgcaccgccacacugauccuggcuggcgucucccuucugccgcucugccaaucuagcuccaugcggaagaccgauuggcugcccaugacgguugccgcuaugggggugccuccccucccucuguuuaucuucucucuuaaagacacacccaagagaaaaagcuggccucugaaugagggagugauggccgucggccugguguccauucucgccucuagccugcuucgcaacgauguucccauggcugggccgcugguggcgggaggccuccugaucgccuguuacgucauuaccgggaccuccgcugaccucacaguggagaaggccgccgacguuaccugggaagaggaagcugagcagacaggagugagccacaaccugaugaucacggucgaugacgauggcaccaugagaauuaaagacgaugaaacagagaauauccuuaccgugcugcugaagacagcccuccugaucgucucuggcauuuuuccuuauuccauccccgcgacccuucugguguggcauacguggcagaaacagacccaacggagcgggguucucugggacgugccuucucccccggagacacagaaggcugaacuggaggaaggagucuaccgcauuaagcagcagggcaucuucgggaaaacccaagugggaguuggcgugcagaaggagggggucuuucacacaauguggcacgugaccagaggagccgugcucacacauaacggcaaacggcuggagccuaauugggccuccguuaagaaagaucuuauuagcuacggcgggggauggcgccugucugcucaguggcaaaagggcgaagagguccaggugaucgccguggaacccgggaagaacccuaaaaauuuccagacgaugcccggaauuuuccagaccacaaccggcgagaucggggcgaucgcucuggacuuuaagcccggaaccuccggcagcccuauuaucaacagagaaggcaaagucguggggcucuauggaaauggcguugugacaaagaacgggggauacgucuccggcauugcccaaacgaaugccgagccggaugggcccaccccugagcuggaagaggaaauguucaaaaagcggaaccuuacaaucauggaccugcaccccggcagcggaaagacccgcaaauaucucccugcuauugugagagaggccaucaagcggcgccugagaacacucauccuggcucccacccggguuguggccgcggaaauggaggaggcccuuaaaggccugccuauuagauaccagacgacagcuaccaagucugaacauaccgggcgcgagaucgucgaucugaugugccacgccacauuuaccaugcggcuccugagcccggugagaguucccaauuauaaccuugugauuauggacgaagcucauuucacagauccugccuccaucgccgcucgcggauacauuucuacccgggucggcaugggggaggcggccgcuaucuuuaugacggccacacccccuggaaccgccgaggcuuucccccagagcaaugccccgauccaggacgaggagagagacauuccugaacgcuccuggaacucuggcaaugaguggaucacagauuuuguggggaaaaccgugugguucguccccagcauuaaggcgggcaacgacaucgcuaacugucugcggaagaauggcaaaaagguuauucaacucuccagaaaaacguuugauaccgaauaucagaagacacgccugaacgacugggauuucguggugaccacagacaucucugagaugggagccaauuuuaaagccgaucgggucauugaccccagacggugccugaagccugugauccucaccgaugggcccgagcgcguuauccuugcuggaccuaugccggugacagccgcgagcgccgcucagagacggggccgcgucgggagaaacccccagaaggaaaaugaccaauacauuuucaccggacagccucugaacaaugaugaggaccacgcccacuggacggaagcuaaaaugcugcucgacaacaucaauacacccgagggcauuaucccugcccuguucgaacccgagcgggagaaguccgcugccauugauggggaauacagacuuaaaggcgagagccgcaagaccuuuguggaacugaugcggagaggagaccucccgguuuggcuggcgcauaaaguggccucugagggcaucaaguauaccgaucgcaaauggugcuucgacggggaacggaacaaucagauccuggaggagaacauggaugucgaaauuuggacaaaggagggagaaagaaagaaacuccgcccucgguggcuugacgcuagaaccuacuccgauccccuggcccugaaggaguuuaaagacuucgcugccggccgcaagagcaucgcccucgaucuggugacagaaauugggagagucccuucucaccuugcucaucggacgcgcaaugcgcuggacaaccucgugaugcugcacaccuccgagcacggaggcagagccuaucggcaugcuguugaggaacugcccgagacaauggaaacccuccuucugcugggccucaugauccugcuuacagggggagccaugcuguuucucauuagcggcaaagggaucggaaagaccuccaucggccugauuugugugaucgugucuagcgggaugcuguggauggccgaugucccucuccaguggauugcuuccgccaucguucuugaguucuuuaugauggugcugcugauucccgagccggaaaagcaacgcacgccucaggacaaucagcucgcguacguggucaucggcauucugacccuugccgcuaucguggccgcuaacgagaugggccugcucgaaacaaccaaaagagaucugggcaugagcaaggagcccgggguugugucucccacauccuaucuggacgucgaccuccacccugccagcgcguggacccuuuacgccguggcuacgacagucaucaccccgaugcugcggcauacaauugaaaauucuaccgccaacgugagccuggcugccaucgcuaaccaagccguugugcucaugggacuggauaaaggcuggcccauuuccaagauggaccuuggggucccucugcucgcgcugggaugcuauucucaggugaauccccugacccucacagccgcuguucuucugcuggugacgcacuacgccaucauuggcccugggcuccaggcuaaagccaccagagaggcccagaagcgcacagcggcuggaaucaugaagaaccccaccgucgauggcaucaugacaauugaccuggauccugugaucuacgacagcaaauucgagaagcaacuuggccaggugaugcugcucguucugugugccguccagcugcuccuuaugcggaccuccugggcucugugcgaagcccugacgcucgccacagggccgauuaccacccugugggagggaucucccggcaaauuuuggaauacaaccaucgcugugagcauggccaacauuuucagaggguccuaucuugcgggagccggccuggcuuuuagcaucaugaagucuguggggacaggacgccggggcacgggcucccagggggaaacccucggagagaaauggaagaagaaacugaaucaacugagcagaaaggaguucgaucucuacaaaaaguccggcaucacagaggucgaccggaccgaggccaaagaagggcuuaagcgcggagagacaacccaucacgcuguuucuagaggcagcgccaaacugcagugguuuguggaacggaacauggugauuccugaggggcgcgucaucgaucugggauguggcagaggcgggugguccuauuacugcgcgggacucaagaaggugacggaaguucggggcuauaccaaagggggacccggccacgaggagccugugcccaugucuacauacggguggaauauugucaagcugaugagcggaaaagacguguucuaucuuccgccugaaaagugugauacccugcucugcgacaucggcgaguccagccccucucccacaguugaagagucccgcaccauuagagugcugaaaauggucgagccuuggcugcggaacaaucaguucuguaucaaggugcucaaccccuacaugccuaaugugauugaacaucuugagcgccugcagagaaaguacggcgggaugcugguccggaacccgcucagcagaaauucuacacacgaaauguauuggaucuccaacggaaccggcaauaucguuagcucugugaacauggugagccgccugcuucugaaccgguuuacgaugacacauagacgccccaccauugagaaagaugucgaccucggggccggaacccggcacgugaaugcugaaccugagacacccaacauggacguuaucggcgagagaauuaagcgcaucaaagaagaacacuccucuacguggcauuacgaugacgaaaauccuuauaagaccugggccuaccacgggagcuaugaggugaaagcuacaggauccgccagcuccaugauuaacggcgucgugaagcugcugaccaagcccugggauguugugccgauggucacacaaauggcuaugaccgacacaaccccuuucggccagcagcggguguuuaaagaaaagguugauacgagaacaccccgcccuaugcccgggacacggaaagugauggagaucaccgccgaguggcucuggagaacacugggacgcaauaagaaaccucggcuuugcaccagagaagaguucacgaagaagguccgcacaaacgcggccaugggcgcuguguuuaccgaagagaaucaaugggacucugccagagcugccgucgaagaugaggaguucuggaaacugguggacaaggaacgggagcuccauaaacuggggaaguguggaagcugcguuuacaacaugaugggcaaacgcgaaaagaaacuuggggaguuuggcaaggccaagggauccagagcgaucugguauauguggcugggcgcucgguuccucgaguuugaagcccugggguuccugaaugaggaucacugguuuucuagagaaaacagcuacuccggaguggagggcgaagggcuccauaaacugggauacauucuucgggacaucucuaagauucccggcggggccauguaugcugaugacacagccggcugggacacccgcaucacggaggaugaccugcacaaugaggagaagauuacccagcagauggauccggagcacagacagcucgcuaacgccaucuucaagcugacauaccaaaauaaagucgugaaggugcagcggccuacccccaagggaacaguuauggacaucauuagccgcaaagaucagagaggcuccggacaggugggaaccuauggccuuaacacauuuaccaauauggaagcgcaacugguccggcagauggagggggaaggagugcucagcgaggccgaccuggagaacccccaucugcucgaaaagaaaaucacgcaguggcuggagacaaagggcguugaacgccuuaaaagaauggcuauuucuggggaugacugcguggucaagccuaucgaugaccgguucgccaacgcucugcucgcccugaaugauaugggcaaggugcgcaaagacauuccgcaguggcaacccuccaagggauggcacgauuggcagcaggucccuuucuguagccaucacuuucacgagcuuaucaugaaagacggcagaaagcuggugguucccugccggccucaggacgaacucaucgggcgcgcgagaauuucucaaggagccggcuggucccugaaagagaccgcuugucuggggaaggccuacgcucagauguggagccucauguauuuccaucggcgcgaucugagacuugccucuaacgcuaucugcuccgccgugcccguccacuggauuccuaccagccggacaaccugguccauccaugcgcaccaucaguggaugacaacggaggacaugcugaccguguggaauagaguuuggauugaagauaaccccuggaugggagacaagacaccggugaccacaugggaggaugucccuuaccucggcaaacgcgaagaccaauggugugggagccugaucggccuuaccucucgggccacgugggcucagaauauucugaccgccauccaacaggugagaagccucaucggagaugaggaguuucuggacuauaugcccuccaugaagcgcuuccggaaagaagaggaaucugagggcgccauuugguga

SEQ ID NO: 20473 - RNA, 9873 nt, Artificial Sequence
  derived and/or modified CDS sequence (opt5) from DENV-3__GU131915__SS-prME
accagccugugccucaugaugaugcugcccgccacccuugcuuuccaccugacgucccgggacggcgaaccucggaugaucguggggaagaacgaacgcggaaagucucuccuguuuaagaccgccagcggcauuaauauguguacccuuaucgcgauggaucugggggaaaugugcgacgauaccgucacauacaaauguccgcucauugcugaagccgagcccgaagacaucgauugcugguguaaccugaccuccacauggguuaccuauggaacgugcaaucaggccggcgagcauagacgggacaagcgcucuguggcucuggccccucacguggggaugggacucgauaccagaacacagaccuggaugagcgcugagggcgccuggcggcaggucgaaaaaguggagacaugggcgcugcgccaucccggcuucaccauucuugcccuguuucucgcucacuacaucgggacgucccugacacagaagguugugaucuucauucuucugaugcucgucaccccuucuaugacaaugagaugugugggaguuggcaaccgggacuuuguggaagggcugagcggagccaccugggucgauguggugcuggagcauggcgggugcgucaccacaauggcuaaguccaaacccacgcucgacaucgagcugcagaagaccgaagccacacaacuugcgacccugcgcaaacucuguauugagggaaagaucacaaauauuaccacggauagcagaugcccuacacagggcgaagccacccugccggaggaacaggaccagaacuauguuuguaaacacaccuacguggaucggggcugggggaauggaugcggccuuuucgggaagggaucucuggugacaugcgcuaaguuucaaugucucgagcccaucgagggcaaagucgugcagcacgaaaaccugaaguauaccguuauuaucacagugcauacgggggaccagcaccaggucggaaaugacacccaaggcgugacaguugagaucaccccucaggccuccacaguggaagcuguccugcccgaguacggcacccucgggcuggaaugcagcccucgcacgggacuugauuucaacgagaugauucugcucaccaugaaaaauaaggccuggauggugcauagacagugguuuuucgaccugccccuuccguggacaucuggcgccaccacagagaccccuacguggaaccggaaagaacugcucgucacauuuaagaaugcucacgcgaaaaagcaagaggugguugugcuggggucccaggaaggagccaugcacaccgcucugacaggcgccaccgagauccagaacagcgggggcaccucuauuuucgccggacaucucaagugucgccugaaaauggauaaacuugaacugaaaggcauguccuaugcuaugugccucaauacauuuguccugaagaaagaggugagcgagacgcagcacgggaccauccugauuaagguugaauacaagggagaggacgcccccuguaaaaucccuuucuccacagaagauggccaagggaaggcgcauucuggaagacuuaucaccgcuaaccccguggucaccaagaaggaggagcccgugaacauugaagccgagccuccguucggcgaaagcaauaucgugauugggaucggcgacaaagcccucaagauuaacugguacaagaaaggauccagcaucggcaagauguuugaggcuaccgccagaggggcuagacgcauggccauccugggagauacggcgugggacuucggcucuguugggggaguccugaauagccucggcaaaauggugcaccagauuuuugggagcgccuauacagcucuguucucuggcgugagcuggaucaugaagauuggaaucggcguccuucugaccuggauugggcucaacuccaaaaauaccucuaugagcuuuuccugcaucgugauuggaaucaucacacuguaccugggcgccguugugcaggcugauauggggugugucauuaacuggaagggaaaggaacuuaaaugcggcagcgggaucuucgugaccaaugagguucauacauggacggagcaguauaaguuucaagccgacucucccaaacggcucgcgaccgccauugcuggcgccugggaaaacggaguguguggcaucagauccacaacccgcauggagaaucugcuguggaagcagauugcuaacgaacucaauuacauccugugggagaacaauaucaaacuuacagucgugguuggggauauuaucggagugcuggaacagggcaagcggacccucacgccucagcccauggagcugaaauauagcuggaagaccugggggaaggccaaaauugucacagccgagacccaaaacucuuccuucaucauugacggaccuaauacacccgaaugcccgagcgcuuccagagcguggaacgugugggagguggaagacuacggcuuuggcgucuucaccacaaacaucuggcugaaacuucgcgagguuuauacccagucuugugaucaccggcucaugagcgccgcuaucaaagacgaaagagccgugcacgccgauaugggguacuggauugagucccagaagaauggaucuuggaaacuggagaaggcuagcuuuaucgaagugaagacgugcacauggccuaaaucccauacccuguggagcaacggcguccucgagucugacaugauuauccccaagucccuggccgggccuauuagccagcacaaucaucgccccggauaccacacccaaacagcgggcccuuggcaccuugggaaacuggaacucgauuucaacuauugcgagggaaccacggugguuaucacagagaauuguggcacccggggccccucucugagaacaaccacaguguccgggaagcugauccaugaauggugcugucgcagcugcacccuuccgccucuccgguacaugggagaggacggcuguugguaugggauggaaauuagacccaucaacgagaaagaagagaauauggucaagucucuggugagcgcuggauccggcaagguugauaacuuuacgaugggggugcugugccucgccauucuguucgaggaagucaugcggggaaaauucggcaagaaacacaugaucgccggcgugcuuuuuaccuucguucugcuccugagcgggcagauuacauggcgcgacauggcucauacccugaucaugauuggaucuaaugccuccgauagaaugggcaugggggugacauaccuugcgcugaucgcuaccuuuaagauccagcccuuccucgcccugggauuuuuccuccggaaacugacgagcagagagaaccuucugcucggcgucgggcuggccauggcuacaacccugcaacuuccugaagacauugagcagauggccaauggaaucgcucugggccucaugacacugaagcucauuacccaguuugaaaccuaucagcuguggacagcccuugugucccugacguguucuaacaccaucuucacacucaccguggcguggcgcacagccacccugauucuggcuggcgucagccuucugccgcucugccaauccucuagcaugcggaagacggauuggcugcccaugacaguugccgcuaugggggugccuccccucccucuguuuaucuucucccuuaaagacacccccaagagacgcucuuggccucugaaugagggagugauggccgucggccuggugagcauccucgccuccagccugcuuagaaacgauguucccauggcugggccgcugguggcgggaggccuccugauugccuguuacgucaucaccgggacaucugcugaccucaccguggagaaagccgccgacguuacaugggaagaggaagcugagcagacgggagugucccacaaucugaugauuaccgucgaugacgauggcacaaugcggaucaaggacgaugaaaccgagaacauucuuacagugcugcugaaaaccgcccuccugaucgucagcggcaucuuuccuuauucuauucccgcgacgcuucugguguggcauaccuggcagaagcagacacaacgcuccgggguucucugggacgugccuucucccccggagacccagaaagcugaacuggaggaaggagucuacagaaucaagcagcagggcauuuucgggaagacacaagugggaguuggcgugcagaaagagggggucuuucacaccauguggcacgugacacggggagccgugcucacgcauaacggcaagcgccuggagccuaauugggccuccguuaaaaaggaucuuaucuccuacggcgggggauggagacugaacgcucaguggcaaaaaggcgaagagguccaggugauugccguggaacccgggaagaauccuaagaacuuccagaccaugcccggaaucuuccagacaaccaccggcgagauuggggcgaucgcucuggacuuuaaacccggaacaagcggcuccccuaucauuaaucgggaaggcaaggucguggggcucuauggaaacggcguugugacgaaaaaugggggauacgucagcggcaucgcccaaaccaacgccgagccggaugggcccacaccugagcuggaagaggaaauguucaagaaacgcaaucuuaccauuauggaccugcaccccggcucuggaaagacaagaaaguaucucccugcuaucgugcgggaggccauuaaacgcagacugcggacccucauccuggcucccacgagaguuguggccgcggaaauggaggaggcccuuaagggccugccuauccgcuaccagacaaccgcuaccaaaagcgaacauacagggcgggagauugucgaucugaugugccacgccaccuuuacaaugagacuccuguccccggugcgcguucccaacuauaaucuugugaucauggacgaagcucauuucaccgauccugccucuauugccgcucggggauacaucagcacgagagucggcaugggggaggcggccgcuauuuuuaugacagccacacccccuggaacagccgaggcuuucccccaguccaacgccccgauccaggacgaggagcgcgacaucccugaacggucuuggaauagcggcaacgaguggauuaccgauuuuguggggaagacggugugguucguccccuccaucaaagcgggcaaugacauugcuaacugucugagaaagaacggaaagaaaguuauccaacucucucgcaagaccuuugauacagaauaucagaaaacccggcugaaugacugggauuucguggugacaaccgacauuagcgagaugggcgccaacuuuaaggccgauagagucaucgacccccggcgcugccugaaaccugugauucucacagaugggcccgagagaguuauccuugcuggaccuaugccggugaccgccgcguccgccgcucagcggcgcggcagagucgggcggaauccccagaaggaaaacgaccaauacaucuucacgggacagccucugaauaacgaugaggaccacgcccacuggacagaagcuaagaugcugcucgacaauauuaacacccccgagggcaucauuccugcccuguucgaacccgagagagagaaaagcgcugccaucgauggggaauaccgccuuaagggcgagucucggaaaaccuuuguggaacugaugagacgcggagaccucccgguuuggcuggcgcauaagguggccuccgagggcauuaaauauacagaucggaaguggugcuucgacggggaaagaaauaaccagauccuggaggagaauauggaugucgaaaucuggaccaaagagggagaacgcaagaagcuccggccuagauggcuugacgcucgcacauacagcgauccccuggcccugaaagaguuuaaggacuucgcugccggcagaaaaucuauugcccucgaucuggugacggaaaucgggcgggucccuucccaccuugcucaucgcaccagaaacgcgcuggacaaucucgugaugcugcacacaagcgagcacggaggccgggccuaucgccaugcuguugaggaacugcccgagaccauggaaacacuccuucugcugggccucaugauucugcuuaccgggggagccaugcuguuucucaucuccggcaaggggauuggaaaaacgucuaucggccugaucugugugauugugagcuccgggaugcuguggauggccgaugucccucuccaguggaucgcuagcgccauuguucuugaguucuuuaugauggugcugcugauccccgagccggaaaagcaaagaaccccucaggacaaccagcucgcguacguggucauuggaauccugacacuugccgcuauuguggccgcuaaugagaugggccugcucgaaaccacaaagcgggaucugggcaugucuaaagagcccgggguugugucccccaccagcuaucuggacgucgaccuccacccugccucugcguggacgcuuuacgccguggcuacaaccgucaucacaccgaugcugagacauaccaucgaaaacagcaccgccaaugugucccuggcugccauugcuaaccaagccguugugcucaugggacuggauaagggcuggcccaucucuaaaauggaccuuggggucccucugcucgcgcugggaugcuauagccaggugaacccccugacacucacggccgcuguucuucugcuggugacccacuacgccauuaucggcccugggcuccaggcuaaggccacacgcgaggcccagaaacggaccgcggcuggaauuaugaagaaucccacagucgauggcaucaugaccaucgaccuggauccugugauuuacgacuccaaguucgagaaacaacuuggccaggugaugcugcucguucugugugccguccagcugcuccuuaugagaacgucuugggcucugugcgaagcccugacacucgccaccgggccgaucaccacacugugggagggaagccccggcaaguuuuggaacaccacaauugcuguguccauggccaauaucuuccgcgggagcuaucuugcgggagccggccuggcuuuuucuauuaugaaauccguggggacgggacggagaggcaccggcagccagggggaaacacucggagagaaguggaaaaagaagcugaaccaacugucccggaaagaguucgaucucuacaagaaaucuggcaucaccgaggucgaccgcacagaggccaaggaagggcuuaaaagaggagagaccacgcaucacgcuguuagccggggcuccgccaagcugcagugguuuguggaacgcaauauggugaucccugaggggagagucauugaucugggauguggccggggcggguggucuuauuacugcgcgggacucaaaaaggugaccgaaguucgcggcuauacaaaaggcgggcccgggcacgaggagccugugcccaugagcaccuacggguggaacaucgucaaacugauguccggaaaggacguguucuaucuuccgccugaaaaaugugauacacugcucugcgacauuggcgagagcucucccucccccaccguugaagagagcagaacaauccgggugcugaagauggucgagccuuggcugcgcaauaaccaguucuguauuaaagugcucaaucccuacaugccuaccgugaucgaacaucuugagagacugcagcggaaguacggcgggaugcuggucagaaacccgcucucucgcaauuccacgcacgaaauguauuggauuagcaacggaacaggcaauaucguuucuagcgugaacauggugucccggcugcuucugaauagauuuaccaugacccaucgccggcccacaaucgagaaggaugucgaccucggggccggaacgagacacgugaacgcugaaccugagacccccaacauggacguuauuggcgagcgcaucaaacggauuaaggaagaacacucuagcacauggcauuacgaugacgaaaauccuuauaaaaccugggccuaccacggguccuaugaggugaaggcuacaggaagcgccuccucuaugaucaacggcgucgugaaacugcugaccaagcccugggauguugugccgauggucacacaaauggcuaugaccgacacgaccccuuucggccagcagagaguguuuaaggaaaaaguugauacacgcacaccccggccuaugcccgggacaagaaaggugauggagauuaccgccgaguggcucuggcgcacgcugggacggaauaaaaagccuagacuuugcacacgcgaagaguucaccaaaaaggucagaacaaacgcggccaugggcgcuguguuuaccgaagagaaucaaugggacagcgcccgggcugccgucgaagaugaggaguucuggaagcugguggaccgcgaaagagagcuccauaaacuggggaaguguggauccugcguuuacaacaugaugggcaaacgggaaaagaaacuuggggaguuuggcaaggccaaaggaucuagagcgaucugguauauguggcugggcgcucgguaccucgaguucgaagcccugggguuucugaaugaggaucacugguucagccgcgaaaacuccuacucuggaguggagggcgaagggcuccauaagcugggauauauccuuagagacauuagcaagauccccggcggggccauguacgcugaugacacggccggcugggacacccggauuacagaggaugaccugcacaaugaggagaagaucacccagcagauggauccggagcaccgccagcucgcuaacgccauuuuuaagcugacauaucaaaauaaagucgugaaggugcagagaccuacccccaaaggaacaguuauggacaucaucucccggaaggaucagcgcggcagcggacaggugggaaccuacggccuuaacacguucacaaauauggaagcgcaacuggucagacagauggagggggaaggagugcucucuaaggccgaccuggagaacccccaucugcucgagaaaaagauuacccaguggcuggaaaccaaaggcguugagcggcuuaagcgcauggcuaucuccggggaugacugcguggucaaaccuauugaugacagauuugccaaugcucugcucgcccugaacgauaugggcaaggugcggaaggacaucccgcaguggcaacccagcaaaggauggcacgauuggcagcaggucccuuucuguucucaucacuuccacgaacuuauuaugaaggacggccgcaaacuggugguucccugcagaccucaggacgagcucaucgggcgggcgcgcaucucccaaggagccggcuggagccugaaggaaacagcuugucuggggaaagccuaugcucagauguggucucucauguacuuucauagacgggaucugagacuugccuccaacgcuauuugcagcgccgugcccguccacuggaucccuaccucccgcacaacguggagcauucaugcgcaccaucaguggaugaccacagaggacaugcugaccguguggaaucggguuuggaucgaggauaaccccuggauggaagacaagacaccggugaccacgugggaggaugucccuuaucucggaaagagagaagaccaaugguguggcucucugauugggcuuaccagccgcgccacaugggcucagaauauccugaccgccauucaacaggugcggucccucaucggcgaugaggaguuccuggacuacaugcccucuaugaaaagauuucgcaaggaagaggaaagcgagggagccaucugguga

SEQ ID NO: 20474 - RNA, 9873 nt, Artificial Sequence
  derived and/or modified CDS sequence (opt5) from DENV-3__GU131916__SS-prME
accucccugugccucaugaugaugcugcccgccacccuugcuuuccaccugacgucccgggacggcgaaccucggaugaucguggggaagaacgaacgcggaaaaucucuccuguuuaagaccgccagcggcauuaauauguguacccuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaagaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcuccgggaucuucguuaccaacgaggugcacacauggacggagcaguacaaguuucaagcugacagccccaaacggcucgccaccgcgauugccggcgcuugggaaaauggagucuguggcaucagaucuacaacccgcauggagaaccugcuguggaagcagauugccaaugaacucaacuauauccugugggagaauaacaucaaacuuacagugguugugggggauauuaucggaguccuggaacagggcaagcggacccucacgccucagcccauggagcugaaauacuccuggaagaccugggggaaggcuaaaauugugacagccgagacccaaaauagcucuuucaucauugacggaccuaacacacccgaaugcccguccgccagcagagcuuggaacgugugggaggucgaagacuauggcuuuggcguuuucaccacaaauaucuggcugaaacuucgcgagguguacacccaguccugugaucaucggcucaugucugcggccaucaaagacgaaagagcugugcacgccgauaugggguacuggauugagagccagaagaacggauccuggaaacuggagaaggccucuuuuaucgaagucaagacgugcacauggccuaaaagccacacccugugguccaauggcgugcucgagagcgacaugauuauccccaagucucuggcugggccuauuucccagcauaaccaccgccccggauaucauacccaaacagccggcccuuggcaccuugggaaacuggaacucgauuucaauuacugcgagggaaccacgguugugaucacagagaacuguggcacccggggccccagccugagaacaaccacagucucugggaagcugauccacgaauggugcugucgcuccugcacccuuccgccucuccgguauaugggagaggacggcuguugguacgggauggaaauuagacccaucaaugagaaagaagagaacaugguuaagagccuggugucugcgggaagcggcaagguggauaauuuuacgauggggguccugugccucgcuauucuguucgaggaagugaugcggggaaaauucggcaagaaacauaugaucgccggcguucuuuuuaccuucgugcugcuccuguccgggcagauuacauggcgcgacauggcccacacccugaucaugauuggaagcaacgcuucugauagaaugggcaugggggucacauaucuugcccugaucgcgaccuuuaagauccagcccuuccucgcucugggauuuuuccuccggaaacugacguccagagagaaucuucugcucggcguggggcuggccauggccacaacccugcaacuuccugaagacauugagcagauggcuaacggaaucgcccugggccucaugacacugaagcucauuacccaguuugaaaccuaccagcuguggacagcucuugugagccugacguguuccaauaccaucuucacacucaccgucgccuggcgcacagcgacccugauucuggccggcguuucucuucugccgcucugccaaagcuccucuaugcggaagacggauuggcugcccaugacaguggcugccaugggggugccuccccucccucuguuuaucuucagccuuaaagacacccccaagagacgcuccuggccucugaacgagggagucauggcugugggccugguuucuauccucgccagcucccugcuuagaaaugaugugcccauggccgggccgcuggucgcuggaggccuccugauugcguguuaugugaucaccgggacaagcgccgaccucaccguugagaaagcugccgacgugacaugggaagaggaagccgagcagacgggagucucucauaaccugaugauuaccguggaugacgauggcacaaugcggaucaaggacgaugaaaccgagaacauucuuacaguccugcugaaaaccgcucuccugaucguguccggcaucuuuccuuacagcauucccgccacgcuucugguuuggcacaccuggcagaagcagacacaacgcucuggggugcucugggacgucccuucucccccggagacccagaaagcggaacuggaggaaggaguguacagaaucaagcagcagggcauuuucgggaagacacaaguuggagugggcguccagaaagaggggguguuucauaccauguggcacgugacacggggagcuguucucacgcacaauggcaagcgccuggagccuaacugggccagcgucaaaaaggaucuuaucagcuauggcgggggauggagacuguccgcccaguggcaaaaaggcgaagagguccaggugauugcugucgaacccgggaagaauccuaagaacuuccagaccaugcccggaaucuuccagacaaccaccggcgagauuggggccaucgcgcuggacuuuaaacccggaacaagcggcuccccuaucauuaaucgggaaggcaaggugguugggcucuacggaaacggcgugaucacgaaaaaugggggauaugucagcggcauugcucaaaccaacgccgagccggaugggcccacaccugagcuggaagaggaaauguucaagaaacgcaaucuuaccaucauggaccugcaucccggcucuggaaagacaagaaaguaccucccugccauugugcgggaggcuaucaaacgcagacugcggacccucauccuggcccccacgagaguuguggcugccgaaauggaggaggcgcuuaagggccugccuauucgcuaucagacaaccgccaccaaaagcgaacacacagggcgggagaucgucgaucugaugugccaugcuaccuuuacaaugagacuccuguccccggugcgcguucccaacuacaaucuugugauuauggacgaagcccacuucaccgauccugcuucuaucgccgcccggggauauauuagcacgagagucggcaugggggaggcugcggccaucuuuaugacagcuacacccccuggaacagccgaagccuucccccaguccaacgcuccgauccaggacgaggagcgcgacauuccugaacggucuuggaauagcggcaacgaguggaucaccgauuuuguggggaagacggugugguucguccccuccauuaaagccggcaaugacaucgcgaacugucugagaaagaacggaaagaaaguuauucaacucucucgcaagaccuuugauacagaauaccagaaaacccggcugaaugacugggauuucguggugacaaccgacaucagcgagaugggcgcuaacuuuaaggccgauagagucauugacccccggcgcugccugaaaccugugauccucacagaugggcccgagagaguuauccuugccggaccuaugccggugaccgcugccuccgcggcccagcggcgcggcagagucgggcggaauccccagaaggaaaacgaccaauacauuuucacgggacagccucugaauaacgaugaggaccaugcucacuggacagaagccaagaugcugcucgacaauaucaacacccccgagggcauuaucccugcucuguucgaacccgagagagagaaaagcgccgcuauugauggggaauaucgccuuaagggcgagucucggaaaaccuuuguggaacugaugagacgcggagaccucccgguuuggcuggcccacaagguggcguccgagggcaucaaauacacagaucggaaguggugcuucgacggggaaagaaauaaccagauccuggaggagaauauggaugucgaaauuuggaccaaagagggagaacgcaagaagcuccggccuagauggcuugacgcccgcacauauagcgauccccuggcucugaaagaguuuaaggacuucgccgcuggcagaaaaucuaucgcccucgaucuggugacggaaauugggcgggucccuucccaucuugcccaccgcaccagaaacgcucuggacaaucucgugaugcugcauacaagcgagcacggaggccgggcguaccgccacgccguugaggaacugcccgagaccauggaaacacuccuucugcugggccucaugauccugcuuaccuccggggcuaugcuguuucucauuucuggaaagggcaucgggaaaacgagcaucggacugauuugugugaucguguccagcggcaugcuguggauggccgaugucccucuccaguggauugccucugcuaucguucuugaguucuuuaugauggugcugcugauucccgagccggaaaagcaaagaaccccucaggacaaccagcucgccuauguggucaucgggauucugacacuugcggccaucguggcugccaaugagaugggacugcucgaaaccacaaagcgggaucugggcauguccaaagagcccggcguugugagccccaccucuuaccuggacgucgaccuccauccugcuagcgccuggacgcuuuaugcgguggccacaaccgucaucacaccgaugcugagacacaccauugaaaacuccaccgcuaaugugucucuggccgcuaucgccaaccaagcuguugugcucauggggcuggauaagggauggcccauuagcaaaauggaccuuggcgucccucugcucgcccuggggugcuacucccaggugaacccccugacacucacggcggccguucuucugcuggugacccauuacgcuaucauuggaccuggccuccaggccaaggcuacacgcgaggcccagaaacggaccgccgcggggaucaugaagaaucccacagucgauggaaucaugaccauugaccuggauccugugaucuaugacucuaaguucgagaaacaacuuggccaggugaugcugcucguucugugugcuguccagcugcuccuuaugagaacgagcugggcccugugcgaagcucugacacucgccaccggcccgauuaccacacugugggaggggucccccggaaaguuuuggaacaccacaaucgccgugagcauggcuaauauuuuccgcggcucuuaccuugccggggcgggacuggccuuuuccaucaugaaaagcgugggcacggggcggagaggaaccggcucccagggcgaaacacucggggagaaguggaaaaagaagcugaaccaacugucucggaaagaguucgaucucuauaagaaaagcggaaucaccgaggucgaccgcacagaggcuaaggaaggccuuaaaagaggggagaccacgcaccaugccguuucccggggaucugcuaagcugcagugguuuguggaacgcaauauggugauuccugagggcagagucaucgaucugggguguggacggggcggcuggagcuacuauugcgccgggcucaaaaaggugaccgaaguucgcggauacacaaagggcgggcccggacacgaggagccugugcccauguccaccuauggcuggaacauugucaaacugaugagcgggaaggacguguucuaccuuccgccugaaaaaugugauacacugcucugcgacaucggagagucuucccccagccccaccguugaagagucuagaacaauucgggugcugaagauggucgagccuuggcugcgcaauaaccaguucuguaucaaagugcucaaucccuacaugccuaccgugauugaacaccuugagagacugcagcggaaguauggcggcaugcuggucagaaacccgcucucccgcaauagcacgcaugaaauguacuggaucucuaacgggacaggaaauaucguuagcuccgugaacauggugucucggcugcuucugaauagauuuaccaugacccaccgccggcccacaauugagaaggaugucgaccucggcgcggggacgagacaugugaacgccgaaccugagacccccaacauggacguuaucggagagcgcauuaaacggaucaaggaagaacacagcuccacauggcacuaugaugacgaaaauccuuacaaaaccugggcuuaucauggcagcuacgaggugaaggccacaggguccgcuucuagcaugauuaacggagucgugaaacugcugaccaagcccugggauguugugccgauggucacacaaauggccaugaccgacacgaccccuuucggccagcagagaguguuuaaggaaaaaguugauacacgcacaccccggccuaugcccggcacaagaaaggugauggagaucaccgcugaguggcucuggcgcacgcuggggcggaauaaaaagccuagacuuugcacacgcgaagaguucaccaaaaaggucagaacaaacgccgcgaugggagccguguuuaccgaagagaaucaaugggacuccgcucgggccgcugucgaagaugaggaguucuggaagcugguggaccgcgaaagagagcuccacaaacugggcaagugugggucuugcguuuauaacaugaugggaaaacgggaaaagaaacuuggcgaguuugggaaggccaaaggcagcagagccaucugguacauguggcugggagcgcgguaccucgaguucgaagcucugggcuuucugaaugaggaucauugguucucccgcgaaaacucuuauagcgggguggagggagaaggccuccacaagcugggguacauucuuagagacaucuccaagauucccggaggcgccauguaugccgaugacacggcugggugggacacccggaucacagaggaugaccugcauaaugaggagaagauuacccagcagauggauccggagcaccgccagcucgccaacgcuaucuuuaagcugacauaccaaaauaaagucgugaaggugcagagaccuacccccaaaggcacaguuauggacaucauuagccggaaggaucagcgcggaucuggccagguggggaccuauggacuuaacacguucacaaauauggaagcccaacuggucagacagauggagggcgaagacgugcucuccaaggcggaucuggagaacccccaucugcucgagaaaaagaucacccaguggcuggaaaccaaagggguugagcggcuuaagcgcauggccauuagcggagacgauugcguggucaaaccuaucgacgauagauuugcuaaugcccugcucgcucugaacgacaugggcaaggugcggaaggauauuccgcaguggcaacccucuaaaggguggcaugacuggcagcaggucccuuucuguucccaccauuuccacgaacuuaucaugaaggacggccgcaaacuggugguucccugcagaccucaggaugagcucaucggacgggcccgcauuagccaaggcgcgggguggucucugaaggaaacagccugucugggaaaggcuuacgcccagauguggucccucauguauuuucacagacgggaccugagacuugcuagcaacgccaucugcuccgcugugcccguccauuggauuccuaccagccgcacaacguggucuauccacgcccaucaccaguggaugaccacagaggauaugcugaccguguggaaucggguuuggauugaggacaaccccuggauggaagauaagacaccggugaccacgugggaggacgucccuuaccucggcaagagagaagaucaauggugugggagccugaucggacuuaccucccgcgcgacaugggcccagaauauucugaccgcuauccaacaggugcggucucucaucggcgacgaggaguucagcgauuacaugcccuccaugaaaagauuucgcaaggaagaggaaucugagggggccauuugguga

SEQ ID NO: 20475 - RNA, 9873 nt, Artificial Sequence
  derived and/or modified CDS sequence (opt5) from DENV-3__GU131917__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucacccuucugaugcucgugacaccuucuaugaccaugagauguguuggagugggcaaccgggacuuugucgaagggcugagcggagcuaccuggguggaugugguccuggagcauggcgggugcguuacaacgauggccaaguccaaacccacccucgacauugagcugcagaagacagaagcuacccaacuugccacacugcgcaaacucuguaucgagggaaagauuaccaauaucacgacagauagcagaugcccuacccagggcgaagcgacccugccggaggaacaggaccagaacuauguguguaaacacacauacguggaucggggcugggggaauggaugcggccuuuucgggaagggaucucuggucaccugcgccaaguuucaaugucucgagcccauugagggcaaagugguucaguaugaaaaccugaaguacacagugaucauuacgguccacaccggggaccagcaucaggugggaaaugacacacaaggcguuaccguggagaucacaccucaggcuuccaccgucgaagccgugcugcccgaguauggcacgcucgggcuggaaugcagcccucgcaccggacuugauuucaacgagaugauccugcucacaaugaaaaauaaggcuuggaugguccacagacagugguuuuucgaccugccccuuccguggaccucuggcgccacaaccgagacgccuacauggaaccggaaagaacugcucgugaccuuuaagaaugcccaugcuaaaaagcaagagguugugguccuggggucccaggaaggagcgaugcacacagcccugaccggcgcuaccgagauucagaacagcgggggcacaucuaucuucgccggacaccucaagugucgccugaaaauggauaagcuugaacugaaaggcauguccuacgccaugugccucaauacguuugugcugaagaaagagguuagcgagacccagcaugggacaauucugaucaagguggaauacaagggagaggacgcucccuguaaaauuccuuucuccaccgaagauggccaagggaaggcccacaacggaagacuuaucacagcgaaccccgucgugaccaaaaaggaggagcccgugaauaucgaagcugagccuccguucggcgaaucuaacauuguuaucgggauuggcgacaaagcccucaagaucaauugguauaagaaaggaagcuccauuggcaagauguuugaggccacggcucggggggccagacgcauggcuauccugggagauacagccugggacuucggcagcgucgggggagugcugaacucucucggcaaaauggugcaucagaucuuuggguccgcguacaccgcccuguucagcggcgucucuuggauuaugaagaucggaauuggcgugcuucugaccuggaucgggcucaauagcaaaaacacauccaugucuuuuagcugcauuguuaucggaauuaucacccuguaucugggcgcugugguccaggccgauauggggugugugaucaauuggaagggaaaggaacuuaaaugcggcaacgggauuuucguuacaaaugaggugcacacguggaccgagcaguacaaguuucaagcugacucccccaaacggcucgccacagcgaucgccggcgcuugggaaaacggagucuguggcauuagaagcaccacacgcauggagaaucugcuguggaagcagaucgccaacgaacucaauuauauucugugggagaacaauaucaaacuuaccgugguugugggggauaucauuggaguccuggaacagggcaagcggacgcucaccccucagcccauggagcugaaauacucuuggaagacaugggggaaggcuaaaaucgugaccgccgagacacaaaacuccagcuucauuaucgacggaccuaacacccccgaaugcccgucugccuccagagcuuggaaugugugggaggucgaagacuauggcuuuggcguuuucacaaccaacauuuggcugaagcuucgcgagguguacacgcagagcugugaucaucggcucauguccgcggccaucaaagacgaaagagcugugcacgccgauaugggguacuggaucgagucucagaagaauggaagcuggaaacuggagaaggccuccuuuauugaagucaagacaugcaccuggccuaaaucucacacccuguggagcaacggcgugcucgaguccgacaugaucauucccaagagccuggcugggccuaucucucagcauaaucaccgccccggauaucauacacaaaccgccggcccuuggcaccuugggaaacuggaacucgauuucaacuacugcgagggaacgacaguugugauugcggagaauuguggcacccggggccccucccugagaacaaccacagucagcgggaagcugauccacgaauggugcugucgcucuugcacccuuccgccucuccgguauaugggagaggacggcuguugguacgggauggaaaucagacccauuaacgagaaagaagagaauauggugaagucccugguuagcgcuggaucuggcaagguggauaacuuuacgauggggguccugugccucgccauccuguucgaggaagugaugcggggaaaauucggcaagaaacauaugauugccggcguucuuuuuaccuucgugcugcuccugagcgggcagaucacauggcgcgacauggcucacacccugauuaugaucggauccaaugccagcgauagaaugggcaugggggucacauaucuugcgcugauugcuaccuuuaagauccagcccuuccucgcccugggauuuuuccuccggaaacugacgucuagagagaaccuucugcucggcguggggcuggccauggcuacaacccugcaacuuccugaagacaucgagcagauggccaauggaauugcucugggccucaugacacugaagcucaucacccaguuugaaaccuaccagcuguggacagcccuugugucccugacguguagcaacaccauuuucacacucaccgucgcguggcgcacagccacccugauccuggcuggcguuucccuucugccgcucugccaaucuagcuccaugcggaagacggauuggcugcccaugacaguggccgcuaugggggugccuccccucccucuguuuauuuucucucuuaaagacacccccaagagacgcagcuggccucugaaugagggagucauggccgugggccugguuuccauccucgccucuagccugcuuagaaacgaugugcccauggcugggccgcuggucgcgggaggccuccugaucgccuguuaugugauuaccgggacauccgcugaccucaccguugagaaagccgccgacgugacaugggaagaggaagcugagcagacgggagucagccauaaccugaugaucaccguggaugacgauggcacaaugcggauuaaggacgaugaaaccgagaauauccuuacaguccugcugaaaaccgcccuccugauugugucuggcaucuuuccuuacuccauccccgcgacgcuucugguuuggcacaccuggcagaagcagacacaacgcagcggggugcucugggacgucccuucucccccggagacccagaaagcugaacuggaggaaggaguguacagaauuaagcagcagggcaucuucgggaagacacaaguuggagugggcguccagaaagaggggguguuucauaccauguggcacgugacacggggagccguucucacgcacaacggcaagcgccuggagccuaauugggccuccgucaaaaaggaucuuauuagcuauggcgggggauggagacugucugcucaguggcaaaaaggcgaagaggugcaggugaucgccgucgaacccgggaagaacccuaagaauuuccagaccaugcccggaauuuuccagacaaccaccggcgagaucggggcgauugcucuggacuuuaaacccggaacauccggcagcccuaucaucaaccgggaaggcaaggugguugggcucuacggaaauggcguggucacgaaaaacgggggauauguguccggcauugcccaaaccaaugccgagccggaugggcccacaccugagcuggaagaggaaauguucaagaaacgcaaccuuaccaucauggaccugcaucccggcagcggaaagacaagaaaguaccucccugcuauuguucgggaggccaucaaacgcagacugcggacccucauucuggcucccacgagaguggucgccgcggaaauggaggaggcccuuaagggccugccuauccgcuaucagacaaccgcuaccaaaucugaacacacagggcgggagaucguggaucugaugugccaugccaccuuuacaaugagacuccugagcccgguucgcgugcccaauuacaaccuugucauuauggacgaagcucacuucaccgauccugccuccaucgccgcucggggauauauuucuacgagagugggcaugggggaggcggccgcuaucuuuaugacagccacccccccuggaacagccgaagcuuucccccagagcaaugccccgauucaggacgaggagcgcgacaucccugaacgguccuggaacucuggcaaugaguggaucaccgauuuuguggggaagacggucugguucguucccagcauuaaagcgggcaacgacaucgcuaacugucugagaaagaauggaaagaaagugauucaacucucccgcaagaccuuugauacagaauaccagaaaacccggcugaacgacugggauuucguggucacaaccgacaucucugagaugggcgccaauuuuaaggccgauagagugauugacccccggcgcugccugaaaccuguuauccucacagaugggcccgagagagugauucuugcuggaccuaugccggucaccgccgcgagcgccgcucagcggcgcggcagaguggggcggaacccccagaaggaaaaugaccaauacaucuucacgggacagccucugaacaaugaugaggaccaugcccacuggacagaagcuaagaugcugcucgacaacaucaauacccccgagggcauuaucccugcccuguucgaacccgagagagagaaauccgcugccauugauggggaauaucgccuuaagggcgagagccggaaaaccuuuguugaacugaugagacgcggagaccucccgguguggcuggcgcacaaggucgccucugagggcaucaaauacacagaucggaaguggugcuucgacggggaaagaaacaaucagauucuggaggagaacauggauguggaaaucuggaccaaagagggagaacgcaagaagcuccggccuagauggcuugacgcucgcacauauuccgauccccuggcccugaaagaguuuaaggacuucgcugccggcagaaaaagcaucgcccucgaucuggucacggaaauugggcgggugccuucucaucuugcucaccgcaccagaaaugcgcuggacaaccucguuaugcugcauacauccgagcacggaggccgggccuaccgccacgcuguggaggaacugcccgagaccauggaaacacuccuucugcugggccucaugauccugcuuaccgggggagccaugcuguuucucauuagcggcaaggggaucggaaaaacguccauuggccugaucugugugaucgucucuagcgggaugcuguggauggccgauguuccucuccaguggauugcuuccgccaucgugcuugaguucuuuaugauggugcugcugauucccgagccggaaaagcaaagaaccccucaggacaaucagcucgcguaugucgugaucggaauucugacacuugccgcuaucguugccgcuaacgagaugggccugcucgaaaccacaaagcgggaucugggcaugagcaaagagcccgggguggucucucccaccuccuaccuggacguggaccuccauccugccagcgcguggacgcuuuaugccgucgcuacaaccgugauuacaccgaugcugagacacaccaucgaaaauucuaccgccaacguuagccuggcugccaucgcuaaccaagccgugguccucaugggacuggauaagggcuggcccauuuccaaaauggaccuuggggugccucugcucgcgcugggaugcuacucucagguuaauccccugacacucacggccgcugugcuucugcuggucacccauuacgccaucauuggcccugggcuccaggcuaaggccacacgcgaggcccagaaacggaccgcggcuggaaucaugaagaaccccacaguggauggcauuaugaccaucgaccuggauccugugaucuaugacagcaaguucgagaaacaacuuggccagguuaugcugcucguccugugugccgugcagcugcuccuuaugagaacguccugggcucugugcgaagcccugacacucgccaccgggccgauuaccacacugugggagggaucucccggcaaguuuuggaauaccacaaucgcugugagcauggccaacauuuuccgcggguccuaccuugcgggagccggccuggcuuuuagcaucaugaaaucugucgggacgggaaagcggggcaccggcucccagggggaaacacucggagagaaauggaagaagaaacugaaucaacugagcagaaaggaauucgaucucuauaaaaaguccggcauuaccgagguugaccggucugaggccaaagaagggcuuaagcgcggagagacaacccaccaugcugugagcagaggcuccgccaaacugcagugguuuguggaacggaacauggucaucccugaggggcgcgugaucgaucugggauguggcagaggcggguggucuuacuauugcgcgggacucaagaagguuacggaagugcggggcuacaccaaagggggacccggccacgaggagccuguccccaugagcacauauggguggaauauugugaagcugauguccggaaaagacguuuucuaccuuccgccugaaaagugugauacccugcucugcgacaucggcgagagcucucccucccccacaguggaagagagccgcaccauuagaguccugaaaaugguggagccuuggcugcggaacaaucaguucuguaucaaggugcucaaccccuacaugccuacagucauugaacaccuugagcgccugcagagaaaguauggcgggaugcugguucggaauccgcucucuagaaacuccacccaugaaauguacuggaucagcaauggaacgggcaacauugugucuagcgugaauauggucucccgccugcuucugaaccgguuuacaaugacccacagacgccccaccaucgagaaagauguggaccucggggccggaacacggcauguuaacgcugaaccugagacgcccaauauggacgugaucggcgagagaauuaagcgcaucaaagaagagcacucuagcaccuggcacuaugaugacgaaaacccuuacaagacaugggccuaucauggguccuacgaggucaaagcuaccggaagcgccuccucuaugauuaauggcgugguuaagcugcugacaaagcccugggauguggucccgauggugacccaaauggcuaugacagacaccacgccuuucggccagcagcggguuuuuaaagaaaagguggauaccagaacaccccgcccuaugcccgggacccggaaagucauggagaucacagccgaguggcucuggagaacccugggacgcaacaagaaaccucggcuuugcacgagagaagaguucacaaagaaggugcgcaccaaugcggccaugggcgcugucuuuacagaagagaaccaaugggacagcgccagagcugccguggaagaugaggaguucuggaaacugguugacaaggaacgggagcuccacaaacuggggaaguguggauccugcguguauaauaugaugggcaaacgcgaaaagaaacuuggggaguuuggcaaggccaagggaucuagagcgauuugguacauguggcugggcgcucgguaccucgaguucgaagcccugggguuucugaacgaggaucauugguucagcagagaaaauuccuauucuggagucgagggcgaagggcuccacaaacugggauacauccuucgggacaucagcaagauucccggcggggccauguaugcugaugacaccgccggcugggacacgcgcaucaccgaggaugaccugcauaacgaggaaaaaauuacacagcagauggauccggagcacagacagcucgcuaaugccaucuuuaagcugaccuaccaaaacaaaguggugaagguucagcggccuacacccaagggaaccgugauggacauuaucucccgcaaagaucagagaggcagcgggcaggucggaacauauggccuuaauaccuucacgaacauggaagcgcaacuggugcggcagauggagggggaaggaguucucucuaaggccgaccuggagaauccccaccugcucgagaaaaagaucauucaguggcuggaaacaaaaggcguggagcgccuuaagagaauggcuaucuccggggaugacugcgucgugaagccuauugaugaccgguuugccaacgcucugcucgcccugaacgauaugggcaaaguccgcaaggacaucccgcaguggcaacccagcaaaggauggcaugauuggcagcaggugccuuucuguucucaccauuuccacgaacuuauuaugaaggacggcagaaaacugguugugcccugccggccucaggacgagcucaucgggcgcgcgagaaucucccaaggagccggcuggagccugaaggaaaccgcuugucuggggaaggccuacgcucagauguggucucucauguauuuucaccggcgcgaucugagacuugccuccaaugcuauuugcagcgccguccccgugcauuggaucccuaccucccggacaaccuggagcauucacgcgcaucaccaguggaugacaacggaggacaugcugucuguuuggaacagaguguggaucgaggauaaucccuggauggaagacaaaaccccggucacaaccugggaggaugugccuuaccucggaaagcgcgaagaccaaugguguggcagccugauugggcuuacaucccgggccaccugggcucagaacauccugacggccauucagcaggugagaucucucaucggcgaugaggaguuccuggacuacaugcccagcaugaaacgcuuucggaaggaagaggaauccgagggagccaucugguga

SEQ ID NO: 20476 - RNA, 9873 nt, Artificial Sequence
  derived and/or modified CDS sequence (opt5) from DENV-3__GU131918__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaagcuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugacaaaaaaggaggagcccgugaauauugaagcugagccuccguucggcgaaucuaacaucguuauugggaucggcgacaaagcccucaagauuaauugguauaagaaaggaagcuccaucggcaagauguuugaggccaccgcucggggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcaacgggaucuucguuaccaaugaggugcacacauggacggagcaguacaaguuucaagcugacucccccaaacggcucgccaccgcgauugccggcgcuugggaaaacggagucuguggcaucagaagcacaacccgcauggagaaucugcuguggaagcagauugccaacgaacucaauuauauccugugggagaacaauaucaaacuuacagugguugugggggauauuaucggaguccuggaacagggcaagcggacccucacgccucagcccauggagcugaaauacucuuggaagaccugggggaaggcuaaaauugugacagccgagacccaaaacuccagcuucaucauugacggaccuaacacacccgaaugcccgucugccuccagagcuuggaaugugugggaggucgaagacuauggcuuuggcguuuucaccacaaacaucuggcugaagcuucgcgagguguacacccagagcugugaucaucggcucauguccgcggccaucaaagacgaaagagcugugcacgccgauaugggguacuggauugagucucagaagaauggaagcuggaaacuggagaaggccuccuuuaucgaagucaagacgugcacauggccuaaaucucacacccuguggagcaacggcgugcucgaguccgacaugauuauccccaagagccuggcugggccuauuucucagcauaaucaccgccccggauaucauacccaaacagccggcccuuggcaccuugggaaacuggaacucgauuucaacuacugcgagggaaccacgguugugaucacagagaauuguggcacccggggccccucccugagaacaaccacagucagcgggaagcugauccacgaauggugcugucgcucuugcacccuuccgccucuccgguauaugggagaggacggcuguugguacgggauggaaauuagacccaucaacgagaaagaagagaauauggugaagucccugguuagcgcgggaucuggcaagguggauaacuuuacgauggggguccugugccucgcuauucuguucgaggaagugaugcggggaaaauucggcaagaaacauaugaucgccggcguucuuuuuaccuucgugcugcuccugagcgggcagauuacauggcgcgacauggcccacacccugaucaugauuggauccaaugcuagcgauagaaugggcaugggggucacauaucuugcccugaucgcgaccuuuaagauccagcccuuccucgcucugggauuuuuccuccggaaacugacgucuagagagaaccuucugcucggcguggggcuggccauggccacaacccugcaacuuccugaagacauugagcagauggcuaauggaaucgcccugggccucaugacacugaagcucauuacccaguuugaaaccuaccagcuguggacagcucuugugucccugacguguagcaacaccaucuucacacucaccgucgccuggcgcacagcgacccugauucuggccggcguuucccuucugccgcucugccaaucuagcuccaugcggaagacggauuggcugcccaugacaguggcugccaugggggugccuccccucccucuguuuaucuucucucuuaaagacacccccaagagacgcagcuggccucugaaugagggagucauggcugugggccugguuuccauccucgccucuagccugcuuagaaacgaugugcccauggccgggccgcuggucgcuggaggccuccugauugcguguuaugugaucaccgggacauccgccgaccucaccguugagaaagcugccgacgugacaugggaagaggaagccgagcagacgggagucagccauaaccugaugauuaccguggaugacgauggcacaaugcggaucaaggacgaugaaaccgagaauauucuuacaguccugcugaaaaccgcucuccugaucgugucuggcaucuuuccuuacuccauucccgccacgcuucugguuuggcacaccuggcagaagcagacacaacgcagcggggugcucugggacgucccuucucccccggagacccagaaagcggaacuggaggaaggaguguacagaaucaagcagcagggcauuuucgggaagacacaaguuggagugggcguccagaaagaggggguguuucauaccauguggcacgugacacggggagcuguucucacgcacaacggcaagcgccuggagccuaauugggccuccgucaaaaaggaucuuaucagcuauggcgggggauggagacugucugcccaguggcaaaaaggcgaagaggugcaggugauugcugucgaacccgggaagaacccuaagaauuuccagaccaugcccggaaucuuccagacaaccaccggcgagauuggggccaucgcgcuggacuuuaaacccggaacauccggcagcccuaucauuaaccgggaaggcaaggugguugggcucuacggaaauggcguggucacgaaaaacgggggauauguguccggcaucgcucaaaccaaugccgagccggaugggcccacaccugagcuggaagaggaaauguucaagaaacgcaaccuuaccauuauggaccugcaucccggcagcggaaagacaagaaaguaccucccugccaucguucgggaggcuauuaaacgcagacugcggacccucauccuggcccccacgagaguggucgcugccgaaauggaggaggcgcuuaagggccugccuauccgcuaucagacaaccgccaccaaaucugaacacacagggcgggagauuguggaucugaugugccaugcuaccuuuacaaugagacuccugagcccgguucgcgugcccaauuacaaccuugucaucauggacgaagcccacuucaccgauccugcuuccauugccgcccggggauauaucucuacgagagugggcaugggggaggcugcggccauuuuuaugacagcuacccccccuggaacagccgaagccuucccccagagcaaugcuccgauccaggacgaggagcgcgacaucccugaacgguccuggaacucuggcaaugaguggauuaccgauuuuguggggaagacggucugguucguucccagcaucaaagccggcaacgacauugcgaacugucugagaaagaauggaaagaaagugauccaacucucccgcaagaccuuugauacagaauaccagaaaacccggcugaacgacugggauuucguggucacaaccgacauuucugagaugggcgcuaauuuuaaggccgauagagugaucgacccccggcgcugccugaaaccuguuauucucacagaugggcccgagagagugauccuugccggaccuaugccggucaccgcugccagcgcggcccagcggcgcggcagaguggggcggaacccccagaaggaaaaugaccaauacaucuucacgggacagccucugaacaaugaugaggaccaugcucacuggacagaagccaagaugcugcucgacaacauuaauacccccgagggcaucauuccugcucuguucgaacccgagagagagaaauccgccgcuaucgauggggaauaucgccuuaagggcgagagccggaaaaccuuuguugaacugaugagacgcggagaccucccgguguggcuggcccacaaggucgcgucugagggcauuaaauacacagaucggaaguggugcuucgacggggaaagaaacaaucagauccuggaggagaacauggauguggaaaucuggaccaaagagggagaacgcaagaagcuccggccuagauggcuugacgcccgcacauauuccgauccccuggcucugaaagaguuuaaggacuucgccgcuggcagaaaaagcauugcccucgaucuggucacggaaaucgggcgggugccuucucaucuugcccaccgcaccagaaaugcucuggacaaccucguuaugcugcauacauccgagcacggaggccgggcguaccgccacgccguggaggaacugcccgagaccauggaaacacuccuucugcugggccucaugauucugcuuaccgggggagcuaugcuguuucucaucagcggcaaggggauuggaaaaacguccaucggccugaucugugugauugucucuagcgggaugcuguggauggccgauguuccucuccaguggaucgccuccgcuauugugcuugaguucuuuaugauggugcugcugauccccgagccggaaaagcaaagaaccccucaggacaaucagcucgccuaugucgugauuggaauccugacacuugcggccauuguugcugccaacgagaugggccugcucgaaaccacaaagcgggaucugggcaugagcaaagagcccgggguggucucucccaccuccuaccuggacguggaccuccauccugcuagcgccuggacgcuuuaugcggucgccacaaccgugaucacaccgaugcugagacacaccaucgaaaauucuaccgcuaacguuagccuggccgcuauugccaaccaagcugugguccucaugggacuggauaagggcuggcccaucuccaaaauggaccuuggggugccucugcucgcccugggaugcuacucucagguuaauccccugacacucacggcggccgugcuucugcuggucacccauuacgcuauuaucggcccugggcuccaggccaaggcuacacgcgaggcccagaaacggaccgccgcgggaauuaugaagaaccccacaguggauggcaucaugaccaucgaccuggauccugugauuuaugacagcaaguucgagaaacaacuuggccagguuaugcugcucguccugugugcugugcagcugcuccuuaugagaacguccugggcccugugcgaagcucugacacucgccaccgggccgaucaccacacugugggagggaucucccggcaaguuuuggaauaccacaauugccgugagcauggcuaacaucuuccgcggguccuaccuugccggagcgggccuggccuuuagcauuaugaaaucugucgggacgggaaagcggggcaccggcucccagggggaaacacucggagagaaauggaagaagaaacugaaucaacugagcagaaaggaauucgaucucuauaaaaaguccggcaucaccgagguugaccggucugaggcuaaagaagggcuuaagcgcggagagacaacccaccaugccgugagcagaggcuccgcuaaacugcagugguuuguggaacggaacauggucaucccugaggggcgcgugauugaucugggauguggcagaggcggguggucuuacuauugcgccggacucaagaagguuacggaagugcggggcuacaccaaagggggacccggccacgaggagccuguccccaugagcacauauggguggaauaucgugaagcugauguccggaaaagacguuuucuaccuuccgccugaaaagugugauacccugcucugcgacauuggcgagagcucucccucccccacaguggaagagagccgcaccaucagaguccugaaaaugguggagccuuggcugcggaacaaucaguucuguauuaaggugcucaaccccuacaugccuacagucaucgaacaccuugagcgccugcagagaaaguauggcgggaugcugguucggaauccgcucucuagaaacuccacccaugaaauguacuggauuagcaauggaacgggcaacaucgugucuagcgugaauauggucucccgccugcuucugaaccgguuuacaaugacccacagacgccccaccaucgagaaagauguggaccucggggcgggaacacggcauguuaacgccgaaccugagacgcccaauauggacgugauuggcgagagaaucaagcgcauuaaagaagagcacucuagcaccuggcacuaugaugacgaaaacccuuacaagacaugggcuuaucauggguccuacgaggucaaagccaccggaagcgcuuccucuaugaucaauggcgugguuaagcugcugacaaagcccugggauguggucccgauggugacccaaauggccaugacagacaccacgccuuucggccagcagcggguuuuuaaagaaaagguggauaccagaacaccccgcccuaugcccgggacccggaaagucauggagauuacagcugaguggcucuggagaacccugggacgcaacaagaaaccucggcuuugcacgagagaagaguucacaaagaaggugcgcaccaaugccgcgaugggcgccgucuuuacagaagagaaccaaugggacagcgcuagagccgcuguggaagaugaggaguucuggaaacugguugacaaggaacgggagcuccacaaacuggggaaguguggauccugcguguauaauaugaugggcaaacgcgaaaagaaacuuggggaguuuggcaaggccaagggaucuagagccaucugguacauguggcugggcgcgcgguaccucgaguucgaagcucugggguuucugaacgaggaucauugguucagcagagaaaauuccuauucuggagucgagggcgaagggcuccacaaacugggauacauccuucgggacauuagcaagauccccggcggggccauguaugccgaugacaccgcuggcugggacacgcgcauuaccgaggaugaccugcauaacgaggaaaaaaucacacagcagauggauccggagcacagacagcucgccaaugcuauuuuuaagcugaccuaccaaaacaaaguggugaagguucagcggccuacacccaagggaaccgugauggacaucaucucccgcaaagaucagagaggcagcgggcaggucggaacauauggccuuaauaccuucacgaacauggaagcccaacuggugcggcagauggagggggaaggaguucucucuaaggcggaccuggagaauccccaccugcucgagaaaaagauuauccaguggcuggaaacaaaaggcguggagcgccuuaagagaauggccauuuccggggaugacugcgucgugaagccuaucgaugaccgguuugcuaacgcccugcucgcucugaacgauaugggcaaaguccgcaaggacauuccgcaguggcaacccagcaaaggauggcaugauuggcagcaggugccuuucuguucucaccauuuccacgaacuuaucaugaaggacggcagaaaacugguugugcccugccggccucaggacgagcucaucgggcgcgccagaauuucccaaggagcgggcuggagccugaaggaaaccgccugucuggggaaggcuuacgcccagauguggucucucauguauuuucaccggcgcgaucugagacuugcuuccaaugccaucugcagcgcuguccccgugcauuggauuccuaccucccggacaaccuggagcauccacgcccaucaccaguggaugacaacggaggacaugcugucuguuuggaacagaguguggauugaggauaaucccuggauggaagacaaaaccccggucacaaccugggaggaugugccuuaccucggaaagcgcgaagaccaaugguguggcagccugaucgggcuuacaucccgggcgaccugggcccagaacauucugacggcuauccagcaggugagaucucucaucggcgaugaggaguuccuggacuacaugcccagcaugaaacgcuuucggaaggaagaggaauccgagggagccauuugguga

SEQ ID NO: 20477 - RNA, 9873 nt, Artificial Sequence
  derived and/or modified CDS sequence (opt5) from DENV-3__GU131933__SS-prME
acaagccugugccucaugaugaugcugcccgccacacuugcuuuccaccugacgucccgggacggcgagccucggaugaucguggggaagaacgaacgcggaaaaucucuccuguuuaagacagccagcggcauuaauauguguacacuuaucgcgauggaucugggggagaugugcgacgauacagugacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaagaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcuccgggaucuucguuaccaacgaggugcacacauggacggagcaguacaaguuucaagcugacagccccaaacggcucgccaccgcgauugccggcgcuugggaaaauggagucuguggcaucagaucuacaacccgcauggagaaccugcuguggaagcagauugccaaugaacucaacuauauccugugggaaaauagcaucaaacuuacagugguugugggggauauuaucggaguccuggaacagggcaagcggacccucacgccucagcccauggagcugaaauacagcuggaagaccugggggaaggcuaaaauugugacagccgagacccaaaacucuuccuucaucauugacggaccuaauacacccgaaugcccgagcgccuccagagcuuggaacgugugggaggucgaagacuauggcuuuggcguuuucaccacaaacaucuggcugaaacuucgcgagguguacacccagucuugugaucaucggcucaugagcgcggccaucaaagacgaaagagcugugcacgccgauaugggguacuggauugagucccagaagaauggaucuuggaaacuggagaaggccagcuuuaucgaagucaagacgugcacauggccuaaaucccacacccuguggagcaacggcgugcucgagucugacaugauuauccccaagucccuggcugggccuauuagccagcauaaucaccgccccggauaucauacccaaacagccggcccuuggcaccuugggaaacuggaacucgauuucaacuacugcgagggaaccacgguugugaucacagagaauuguggcacccggggccccucucugagaacaaccacagucuccgggaagcugauccacgaauggugcugucgcagcugcacccuuccgccucuccgguauaugggagaggacggcuguugguacgggauggaaauuagacccaucaacgagaaagaagagaauauggugaagucucugguuagcgcgggauccggcaagguggauaacuuuacgauggggguccugugccucgcuauucuguucgaggaagugaugcggggaaaauucggcaagaaacauaugaucgccggcguucuuuuuaccuucgugcugcuccugagcgggcagauuacauggcgcgacauggcccacacccugaucaugauuggaucuaaugcuuccgauagaaugggcaugggggucacauaucuugcccugaucgcgaccuuuaagauccagcccuuccucgcucugggauuuuuccuccggaaacugacgagcagagagaaccuucugcucggcguggggcuggccauggccacaacccugcaacuuccugaagacauugagcagauggcuaauggaaucgcccugggccucaugacacugaagcucauuacccaguuugaaaccuaccagcuguggacagcucuugugucccugacguguucuaacaccaucuucacacucaccgucgccuggcgcacagcgacccugauucuggccggcguuagccuucugccgcucugccaauccucuagcaugcggaagacggauuggcugcccaugacaguggcugccaugggggugccuccccucccucuguuuaucuucucccuuaaagacacccccaagagacgcucuuggccucugaaugagggagucauggcugugggccugguuagcauccucgccuccagccugcuuagaaacgaugugcccauggccgggccgcuggucgcuggaggccuccugauugcguguuaugugaucaccgggacaucugccgaccucaccguugagaaagcugccgacgugacaugggaagaggaagccgagcagacgggagucucccauaaucugaugauuaccguggaugacgauggcacaaugcggaucaaggacgaugaaaccgagaacauucuuacaguccugcugaaaaccgcucuccugaucgugagcggcaucuuuccuuacucuauucccgccacgcuucugguuuggcacaccuggcagaagcagacacaacgcuccggggugcucugggacgucccuucucccccggagacccagaaagcggaacuggaggaaggaguguacagaaucaagcagcagggcauuuucgggaagacacaaguuggagugggcguccagaaagaggggguguuucauaccauguggcacgugacacggggagcuguucucacgcacaacggcaagcgccuggagccuaauugggccuccgucaaaaaggaucuuaucuccuauggcgggggauggagacugagcgcccaguggcaaaaaggcgaagagguccaggugauugcugucgaacccgggaagaacccuaagaauuuccagaccaugcccggaaucuuccagacaaccaugggcgagauuggggccaucgcgcuggacuuuaaacccggaaccuccggcagcccuaucauuaaccgggaaggcaaggugguugggcucuacggaaauggcguggucaccaagaacgggggauaugugucuggcaucgcucaaacgaaugccgagccggaugggcccaccccugagcuggaagaggaaauguucaagaaacgcaaccuuacaauuauggaccugcaucccggcagcggaaagaccagaaaguaccucccugccaucguucgggaggcuauuaaacgcagacugcggacacucauccuggcccccaccagaguggucgcugccgaaauggaggaggcgcuuaagggccugccuauccgcuaucagacgacagccaccaaauccgaacacaccgggcgggagauuguggaucugaugugccaugcuacauuuaccaugagacuccugucuccgguucgcgugcccaauuacaaccuugucaucauggacgaagcccacuucacagauccugcuagcauugccgcccggggauauaucuccaccagagugggcaugggggaggcugcggccauuuuuaugacggcuacacccccuggaaccgccgaagccuucccccagucuaaugcuccgauccaggacgaggagcgcgacaucccugaacggagcuggaacuccggcaaugaguggauuacagauuuuguggggaagaccgucugguucguucccucuaucaaagccggcaacgacauugcgaauugucugagaaagaacggaaagaaagugauccaacucagccgcaagacguuugauaccgaauaccagaaaacacggcugaacgacugggauuucguggucaccacagacauuuccgagaugggcgcuaauuuuaaggccgauagagugaucgacccccggcgcugccugaaaccuguuauucucaccgaugggcccgagagagugauccuugccggaccuaugccggucacagcugccagcgcggcccagcggcgcggcagaguggggcggaacccccagaaggaaaaugaccaauacaucuucaccggacagccucugaacaaugaugaggaccaugcucacuggacggaagccaagaugcugcucgacaacauuaauacacccgagggcaucauuccugcucuguucgaacccgagagagagaaaucugccgcuaucgauggggaauaucgccuuaagggcgagucccggaaaaccuuuguugaacugaugagacgcggagaccucccgguguggcuggcccacaaggucgcgagcgagggcauuaaauacaccgaucggaaguggugcuucgacggggaaagaaacaaucagauccuggaggagaacauggauguggaaaucuggacaaaagagggagaacgcaagaagcuccggccuagauggcuugacgcccgcaccuauucugauccccuggcucugaaagaguuuaaggacuucgccgcuggcagaaaauccauugcccucgaucuggucacagaaaucgggcgggugccuagccaucuugcccaccgcacgagaaaugcucuggacaaccucguuaugcugcauaccuccgagcacggaggccgggcguaccgccacgccguggaggaacugcccgagacaauggaaacccuccuucugcugggccucaugauucugcuuacagggggagcuaugcuguuucucaucucuggcaaggggauuggaaaaaccagcaucggccugaucugugugauugccuccagcgggaugcuguggauggccgaugucccucuccaguggaucgcuucugccauuguucuugaguucuuuaugauggugcugcugauccccgagccggaaaagcaaagaacgccucaggacaaucagcucgcguauguggucauuggaauccugacccuugccgcuauuguggccgcuaacgagaugggccugcucgaaacaaccaagcgggaucugggcauguccaaagagcccgggguugugagccccacaucuuaccuggacgucgaccuccauccugccagcgcguggacccuuuaugccguggcuacgacagucaucaccccgaugcugagacacacaaucgaaaauuccaccgccaacgugucucuggcugccauugcuaaucaagccguugugcucaugggacuggauaagggcuggcccaucagcaaaauggaccuuggggucccucugcucgcgcugggaugcuacucccaggugaacccccugacccucacagccgcuguucuucugcuggugacgcauuacgccauuaucggcccugggcuccaggcuaaggccacccgcgaggcccagaaacggacagcggcuggaauuaugaagaaccccaccgucgauggcaucaugacaaucgaccuggauccugugauuuaugacucuaaguucgagaaacaacuuggccaggugaugcugcucguucugugugccguccagcugcuccuuaugagaaccagcugggcucugugcgaagcccugacgcucgccacagggccgaucaccacccugugggagggaucccccggcaaguuuuggaauacaaccauugcugugagcauggccaacaucuuccgcgggucuuaccuugcgggagccggccuggcuuuuuccauuaugaaaagcguggggacaggacggagaggcacgggcucccagggggaaacccucggagagaaguggaaaaagaagcugaaucaacugucucggaaagaguucgaucucuauaagaaaagcggcaucacagaggucgaccgcaccgaggccaaggaagggcuuaaaagaggagagacaacccaccaugcuguuucccggggcucugccaagcugcagugguuuguggaacgcaacauggugaucccugaggggagagucauugaucugggauguggccggggcggguggagcuacuauugcgcgggacucaaaaaggugacggaaguucgcggcuacaccaaaggcgggcccgggcacgaggagccugugcccauguccacauauggguggaauaucgucaaacugaugagcggaaaggacguguucuaccuuccgccugaaaaaugugauacccugcucugcgacauuggcgagucuucccccagccccacaguugaagagucuagaaccauccgggugcugaagauggucgagccuuggcugcgcaacaaucaguucuguauuaaagugcucaaccccuacaugccuacagugaucgaacaccuugagagacugcagcggaaguauggcgggaugcuggucagaaauccgcucucccgcaacagcacccaugaaauguacuggauuucuaauggaacgggcaacaucguuagcuccgugaauauggugucucggcugcuucugaacagauuuacaaugacccaccgccggcccaccaucgagaaggaugucgaccucggggccggaacaagacaugugaaugcugaaccugagacgcccaacauggacguuauuggcgagcgcaucaaacggauuaaggaagaacacagcuccaccuggcacuaugaugacgaaaacccuuacaaaacaugggccuaucaugggagcuacgaggugaaggcuaccggauccgccucuagcaugaucaauggcgucgugaaacugcugacaaagcccugggauguugugccgauggucacccaaauggcuaugacagacaccacgccuuucggccagcagagaguguuuaaggaaaaaguugauacccgcacaccccggccuauggccgggaccagaaaggugauggagauuacagcggaguggcucuggcgcacccugggacggaacaaaaagcccagacuuugcacgcgcgaagaguucaccaagaaggucagaaccaaugccgcuaugggcgccguguuuacagaagagaaccaaugggacuccgcucgggccgccgucgaagaugaggaguucuggaagcugguggaccgcgaaagagagcuccacaaacuggggaaguguggaucuugcguuuauaauaugaugggcaaacgggaaaagaaacuuggggaguuuggcaaggcgaaaggaagcagagcuaucugguacauguggcugggcgcccgguaccucgaguucgaagcccugggguuucugaacgaggaucauugguucucccgcgaaaauucuuauagcggaguggagggcgaagggcuccacaagcugggauacauccuuagagacauuuccaagaucccuggcggggcuauguaugccgaugacaccgcuggcugggacacgcggauuaccgaggaugaccugcauaacgaggagaaaaucacacagcagauggaucccgagcaccgccagcucgccaaugcgauuuuuaagcugaccuaccaaaacaaagucgugaaggugcagagaccgacaccuaaaggaaccguuauggacaucaucagccggaaggaucagcgcggcucuggacaggugggaacauauggccuuaauaccuucacgaacauggaagcccaacuggucagacagauggagggggaaggagugcucuccaaggcugaccuggagaauccccaucugcucgagaaaaagauuacacaguggcuggaaaccaaaggcguugagcggcuuaagcgcauggccaucagcggggaugacugcguggucaaacccauugaugacagauuugcuaacgcccugcucgcgcugaaugauaugggcaaggugcggaaggacaucccucaguggcaaccgucuaaaggauggcaugauuggcagcagguccccuucuguucccaccauuuccacgaacuuauuaugaaggacggccgcaaacuggugguuccuugcagaccccaggacgagcucaucgggcgggcccgcaucagccaaggagcuggcuggucucugaaggaaaccgccugucuggggaaggcuuacgcccagauguggucccucauguauuuucacagacgggaucugagacuugcuagcaacgccauuugcuccgcggugccuguccauuggauccccacaagccgcaccacauggucuauucacgcccaucaccaguggaugacgaccgaggacaugcugacaguguggaaccggguuuggaucgaggauaauccuuggauggaagacaagacccccgugacaaccugggaggaugucccguaccucggaaagagagaagaccaaugguguggcagccugauugggcuuacgucccgcgcuaccugggcccagaacauccugacagccauucaacaggugcggucucucaucggcgaugaggaguuccuggacuacaugccuagcaugaaaagauuucgcaaggaagaggaauccgagggagcuaucugguga

SEQ ID NO: 20478 - RNA, 9873 nt, Artificial Sequence
  derived and/or modified CDS sequence (opt5) from DENV-3__GU131934__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggaucgauguggugcuggagcauggcgggugcgucaccacaauggccaaguccaaacccacgcucgacauugagcugcagaagaccgaagcuacacaacuugccacccugcgcaaacucuguaucgagggaaagauuacaaauaucaccacggauagcagaugcccuacacagggcgaagcgacccugccggaggaacaggaccagaacuauguuuguaaacacaccuacguggaucggggcugggggaauggaugcggccuuuucgggaagggaucucuggugacaugcgccaaguuucaaugucucgagcccauugagggcaaagucgugcaguaugaaaaccugaaguacaccguuaucaucacagugcacacgggggaccagcaucaggucggaaaugacacccaaggcgugacaguugagauuaccccucaggcuuccacaguggaagccguccugcccgaguauggcacccucgggcuggaaugcagcccucgcacgggacuugauuucaacgagaugauccugcucaccaugaaaaauaaggcuuggauggugcacagacagugguuuuucgaccugccccuuccguggacaucuggcgccaccacagagaccccuacguggaaccggaaagaacugcucgucacauuuaagaaugcccaugcuaaaaagcaagaggugguugugcuggggucccaggaaggagcgaugcacaccgcccugacaggcgcuaccgagauucagaacagcgggggcaccucuaucuucgccggacaccucaagugucgccugaaaauggauaagcuugaacugaaaggcauguccuacgccaugugccucaauacauuuguccugaagaaagaggugagcgagacgcagcaugggaccauucugaucaagguugaauacaagggagaggacgcucccuguaaaaucccuuucuccacagaagauggccaagggaaggcccacaacggaagacuuauuaccgcgaaccccguggucacaaaaaaggaggagcccgugaauaucgaagcugagccuccguucggcgaaucuaacauugugaucgggauuggcgacaaagcccucaagaucaauugguauaagaaaggaagcuccaucggcaagauguuugaggccaccgcucggggggccagacgcauggcuauucugggagauacggccugggacuucggcagcguugggggaguccugaacucucucggcaaaauggugcaucagaucuuuggguccgcguacacagcccuguucagcggcgugucuuggauuaugaagaucggaauuggcguccuucugaccuggaucgggcucaauagcaaaaacaccuccaugucuuuuagcugcauugugaucggaguuaucacacuguaucugggcgcugugguccaggccgauauggggugugugauuaauuggaagggaaaggaacuuaaaugcggcaacgggaucuucguuaccaaugaggugcacacauggacggagcaguacaaguuucaagcugacucccccaaacggcucgccaccgcgauugccggcgcuugggaaaacggagucuguggcaucagaagcacaacccgcauggagaaucugcuguggaagcagauugccaacgaacucaauuauauccugugggagaacaauaucaaacuuacagugguugugggggauauuaucggaguccuggaacagggcaagcggacccucacgccucagcccauggagcugaaauacucuuggaagaccugggggaaggcuaaaauugugacagccgagaaccaaaacuccagcuucaucauugacggaccuaauacccccgaaugcccgucugccuccagagcuuggaacgugugggaggucgaagacuauggcuuuggcguuuucacaaccaauaucuggcugaagcuucgcgagguguacacacagagcugugaucaucggcucauguccgcggccaucaaagacgaaagagcugugcacgccgauaugggguacuggauugagucucagaagaacggaagcuggaaacuggagaaggccuccuuuaucgaagucaagaccugcacguggccuaaaucucacacacuguggagcaauggcgugcucgaguccgacaugauuauccccaagagccuggcugggccuauuucucagcauaaccaccgccccggauaucauacccaaaccgccggcccuuggcaccuugggaaacuggaacucgauuucaauuacugcgagggaacaaccguugugaucgcggagaacuguggcacgcggggccccucccugagaacaaccacagucagcgggaagcugauccacgaauggugcugucgcucuugcacccuuccgccucuccgguauaugggagaggacggcuguugguacgggauggaaauuagacccaucaaugagaaagaagagaacauggugaagucccugguuagcgcuggaucuggcaagguggauaauuuuacaauggggguccugugccucgccauucuguucgaggaagugaugcggggaaaauucggcaagaaacauaugaucgccggcguucuuuuuaccuucgugcugcuccugagcgggcagauuacguggcgcgacauggcucacacccugaucaugauuggauccaacgccagcgauagaaugggcaugggggucacauaucuugcgcugaucgcuaccuuuaagauccagcccuuccucgcccugggauuuuuccuccggaaacugacaucuagagagaaucuucugcucggcguggggcuggccauggcuaccacgcugcaacuuccugaagacauugagcagauggccaacggaaucgcucugggccucaugacacugaagcucauuacccaguuugaaacauaccagcuguggaccgcccuugugucccugaccuguagcaauacaaucuucacgcucaccgucgcguggcgcacagccacccugauucuggcuggcguuucccuucugccgcucugccaaucuagcuccaugcggaagacagauuggcugcccaugaccguggccgcuaugggggugccuccccucccucuguuuaucuucucucuuaaagacacgcccaagagacgcagcuggccucugaacgagggagucauggccgugggccugguuuccauccucgccucuagccugcuuagaaacgaugugcccauggcugggccgcuggucgcgggaggccuccugauugccuguuaugugaucacagggaccuccgcugaccucaccguugagaaagccgccgacgugacaugggaagaggaagcugagcagaccggagucagccauaaucugaugauuacaguggaugacgauggcacgaugcggaucaaggacgaugaaaccgagaacauucuuacaguccugcugaaaaccgcccuccugaucgugucuggcaucuuuccuuacuccauucccgcgacacuucugguuuggcacaccuggcagaagcagacgcaacgcagcggggugcucugggacgucccuucucccccggagacccagaaagcugaacuggaggaaggaguguacagaaucaagcagcagggcauuuucgggaagacacaaguuggagugggcguccagaaagaggggguguuucauaccauguggcacgugacacggggagccguucucacccacaauggcaagcgccuggagccuaacugggccuccgucaaaaaggaucuuaucagcuauggcgggggauggagacugucugcucaguggcaaaaaggcgaagaggugcaggugauugccgucgaacccgggaagaauccuaagaacuuccagacaauccccggaauuuuccagacgaccacaggcgagaucggggcgaucgcucuggacuuuaaacccggaaccuccggcagcccuauuaucaaucgggaaggcaaggugguugggcucuacggaaacggcguggucaccaaaaaugggggauauguguccggcauugcccaaacaaacgccgagccggaugggcccacgccugagcuggaagaggaaauguucaagaaacgcaaucuuaccaucauggaccugcaucccggcagcggaaagacaagaaaguaccucccugcuauuguucgggaggccaucaaacgcagacugcggacccucauccuggcucccacaagaguggucgccgcggaaauggaggaggcccuuaagggccugccuauucgcuaucagaccacggcuacaaaaucugaacacaccgggcgggagaucguggaucugaugugccaugccaccuuuacaaugagacuccugagcccgguucgcgugcccaacuacaaucuugucauuauggacgaagcucacuucaccgauccugccuccaucgccgcucggggauauauuucuacaagagugggcaugggggaggcggccgcuaucuuuaugaccgccacgcccccuggaacagccgaagcuuucccccagagcaacgccccgauccaggacgaggagcgcgacauuccugaacgguccuggaauucuggcaacgaguggaucaccgauuuuguggggaagacagucugguucguucccagcauuaaagcgggcaacgacaucgcuaauugucugagaaagaacggaaagaaagugauucaacucucccgcaagaccuuugauacggaauaccagaaaacccggcugaaugacugggauuucguggucacaaccgacaucucugagaugggcgccaacuuuaaggccgauagagugauugacccccggcgcugccugaaaccuguuauccucacagaugggcccgagagagugauccuugcuggaccuaugccggucaccgccgcgagcgccgcucagcggcgcggcagaguggggcggaauccccagaaggaaaacgaccaauacauuuucacaggacagccucugaauaacgaugaggaccaugcccacuggaccgaagcuaagaugcugcucgacaauaucaacacgcccgagggcauuaucccugcccuguucgaacccgagagagagaaauccgcugccauugauggggaauaucgccuuaagggcgagagccggaaaacauuuguugaacugaugagacgcggagaccucccgguguggcuggcgcacaaggucgccucugagggcaucaaauacaccgaucggaaguggugcuucgacggggaaagaaauaaccagauccuggaggagaauauggauguggaaauuuggaccaaagagggagaacgcaagaagcuccggccuagauggcuugacgcucgcacauauuccgauccccuggcccugaaagaguuuaaggacuucgcugccggcagaaaaagcaucgcccucgaucuggucaccgaaauugggcgggugccuucucaucuugcucaccgcacaagaaacgcgcuggacaaucucguuaugcugcauacguccgagcacggaggccgggccuaccgccacgcuguggaggaacugcccgagaccauggaaacacuccuucugcugggccucaugauccugcuuaccgggggagccaugcuguuucucauuagcggcaaggggaucggaaaaacauccaucggccugauuugugugaucgucucuagcgggaugcuguggauggccgauguuccucuccaguggauugcuuccgccaucgugcuugaguucuuuaugauggugcugcugauucccgagccggaaaagcaaagaaccccucaggacaaccagcucgcguaugucgugaucggaauucugacgcuugccgcuaucguugccgcuaaugagaugggccugcucgaaaccacaaagcgggaucugggcaugagcaaagagcccgggguggucucucccaccuccuaccuggacguggaccuccauccugccagcgcguggacacuuuaugccgucgcuaccacggugaucacaccgaugcugagacacaccauugaaaacucuacagccaacguuagccuggcugccaucgcuaaucaagccgugguccucaugggacuggauaagggcuggcccauuuccaaaauggaccuuggggugccucugcucgcgcugggaugcuacucucagguuaacccccugacccucaccgccgcugugcuucugcuggucacacauuacgccaucauuggcccugggcuccaggcuaaggccacgcgcgaggcccagaaacggaccgcggcuggaaucaugaagaaucccacaguggauggcaucaugaccauugaccuggauccugugaucuaugacagcaaguucgagaaacaacuuggccagguuaugcugcucguccugugugccgugcagcugcuccuuaugagaacauccugggcucugugcgaagcccugacccucgccacggggccgauuacaacccugugggagggaucucccggcaaguuuuggaacaccacaaucgcugugagcauggccaauauuuuccgcggguccuaccuugcgggagccggccuggcuuuuagcaucaugaaaucugucgggaccggacggagaggcacaggcucccagggggaaacgcucggagagaaguggaaaaagaagcugaaccaacugagccggaaagaauucgaucucuauaagaaauccggcaucaccgagguugaccgcacagaggccaaggaagggcuuaaaagaggagagaccacacaccaugcugugucucggggcagcgccaagcugcagugguuuguggaacgcaauauggucauuccugaggggagagugaucgaucugggauguggccggggcgggugguccuacuauugcgcgggacucaaaaagguuaccgaagugcgcggcuacacgaaggggggacccggccacgaggagccuguccccaugucuaccuauggguggaacauugugaaacugaugagcggaaaggacguuuucuaccuuccgccugaaaaaugugauacacugcucugcgacaucggcgaguccagccccucucccaccguggaagaguccagaacaauucggguccugaagaugguggagccuuggcugcgcaauaaccaguucuguaucaaagugcucaaucccuacaugccuaccgucauugaacaccuugagagacugcagcggaaguauggcgggaugcugguuagaaacccgcucagccgcaauucuacacaugaaauguacuggaucuccaacggaaccggcaauaucgugagcucugugaacauggucagccggcugcuucugaacagauuuacgaugacacaccgccggcccaccauugagaaggauguggaccucggggccggaaccagacauguuaaugcugaaccugagacacccaacauggacgugaucggcgagcgcauuaaacggaucaaggaagagcacuccucuacguggcacuaugaugacgaaaauccuuacaaaaccugggccuaucaugggagcuacgaggucaaggcuacaggauccgccagcuccaugauuaacggcgugguuaaacugcugaccaagcccugggauguggucccgauggugacacaaauggcuaugaccgacacaaccccuuucggccagcagagaguuuuuaaggaaaaaguggauacgcgcaccccccggccuaugcccgggacaagaaaggucauggagaucaccgccgaguggcucuggcgcacacugggacggaauaaaaagccuagacuuugcacccgcgaagaguucacgaaaaaggugagaacaaacgcggccaugggcgcugucuuuaccgaagagaaucaaugggacucugcccgggcugccguggaagaugaggaguucuggaagcugguugacaaagaacgcgagcuccacaagcuggggaaauguggaagcugcguguauaacaugaugggcaagagagaaaaaaagcuuggggaguuuggcaaagccaagggaucccgggcgaucugguacauguggcugggcgcuagauaccucgaguucgaagcccugggguuucugaaugaggaucauugguucucucgggaaaacagcuauuccggagucgagggcgaagggcuccacaagcugggauacauucuucgcgacaucucuaaaauucccggcggggccauguaugcugaugacacagccggcugggacaccagaaucacggaggaugaccugcauaaugaggaaaagauuacccagcagauggauccggagcaccggcagcucgcuaacgccaucuuuaaacugacauaccaaaauaagguggugaaaguucagcgcccuacccccaagggaacagugauggacaucauuagcagaaaggaucagcggggcuccgggcaggucggaaccuauggccuuaacacauucaccaauauggaagcgcaacuggugcgccagauggagggggaaggaguucucagcaaagccgaccuggagaacccccaccugcucgagaagaaaaucacgcaguggcuggaaacaaagggcguggagagacuuaaacggauggcuauuucuggggaugacugcgucgugaagccuaucgaugaccgcuuugccaacgcucugcucgcccugaaugauaugggcaaggucagaaaagacauuccgcaguggcaacccuccaagggauggcaugauuggcagcaggugccuuucuguagccaccauuuccacgaacuuaucaugaaagacggccggaagcugguugugcccugccgcccucaggacgagcucaucgggagagcgcggauuucucaaggagccggcuggucccugaaagaaaccgcuugucuggggaaggccuacgcucagauguggagccucauguauuuucaccgcagagaucugcggcuugccucuaacgcuaucugcuccgccguccccgugcauuggauuccuaccagcagaacaaccugguccauccacgcgcaucaccaguggaugacaacggaggacaugcugaccguuuggaaucgcguguggauugaggauaaccccuggauggaagacaagacaccggucaccacaugggaggaugugccuuaccucggaaaacgggaagaccaaugguguggcagccugaucgggcuuaccucuagagccacgugggcucagaauauucugaccgccauccagcaggugcgcagccucaucggcgaugaggaguuccuggacuacaugcccuccaugaagcgguuuagaaaagaagaggaaacagagggagccauuugguga

SEQ ID NO: 20479 - RNA, 9873 nt, Artificial Sequence
  derived and/or modified CDS sequence (opt5) from DENV-3__GU131935__SS-prME
acaagccugugccucaugaugaugcugcccgccacccuugcuuuccaccugacgucccgggacggcgaaccucggaugaucguggggaagaacgaacgcggaaaaucucuccuguuuaagaccgccuccggcauuaauauguguacacuuaucgcgauggaucugggggaaaugugcgacgauaccgucacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacagcuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugcuauuaauuggaagggaaaggaacuuaaaugcggcuccgggaucuucgugaccaacgagguucacacauggacggagcaguacaaguuucaagccgacagccccaaacggcucgcgaccgccauugcuggcgccugggaaaauggaguguguggcaucagaucuacaacccgcauggagaaccugcuguggaagcagauugcuaaugaacucaacuauauccugugggagaauaacaucaaacuuacagucgugguuggggauauuaucggagugcuggaacagggcaagcggacccucacgccucagcccauggagcugaaauacuccuggaagaccugggggaaggccaaaauugucacagccgagacccaaaauagcucuuucaucauugacggaccuaacacacccgaaugcccguccgcuagcagagcguggaacgugugggagguggaagacuauggcuuuggcgucuucaccacaaauaucuggcugaaacuucgcgagguuuacacccaguccugugaucaucggcucaugucugccgcuaucaaagacgaaagagccgugcacgccgauaugggguacuggauugagagccagaagaacggauccuggaaacuggagaaggcuucuuuuaucgaagugaagacgugcacauggccuaaaagccacacccugugguccaauggcguccucgagagcgacaugauuauccccaagucucuggccgggccuauuucccagcauaaccaccgccccggauaucauacccaaacagcgggcccuuggcaccuugggaaacuggaacucgauuucaauuacugcgagggaaccacggugguuaucacagagaacuguggcacccggggccccagccugagaacaaccacagugucugggaagcugauccacgaauggugcugucgcuccugcacccuuccgccucuccgguauaugggagaggacggcuguugguacgggauggaaauuagacccaucaaugagaaagaagagaacauggucaagagccuggugucugcuggaagcggcaagguugauaauuuuacgaugggggugcugugccucgccauucuguucgaggaagucaugcggggaaaauucggcaagaaacauaugaucgccggcgugcuuuuuaccuucguucugcuccuguccgggcagauuacauggcgcgacauggcucacacccugaucaugauuggaagcaacgccucugauagaaugggcaugggggugacauaucuugcgcugaucgcuaccuuuaagauccagcccuuccucgcccugggauuuuuccuccggaaacugacguccagagagaaucuucugcucggcgucgggcuggccauggcuacaacccugcaacuuccugaagacauugagcagauggccaacggaaucgcucugggccucaugacacugaagcucauuacccaguuugaaaccuaccagcuguggacagcccuugugagccugacguguuccaauaccaucuucacacucaccguggcguggcgcacagccacccugauucuggcuggcgucucucuucugccgcucugccaaagcuccucuaugcggaagacggauuggcugcccaugacaguugccgcuaugggggugccuccccucccucuguuuaucuucagccuuaaagacacccccaagagacgcuccuggccucugaacgagggagugauggccgucggccuggugucuauccucgccagcucccugcuuagaaaugauguucccauggcugggccgcugguggcgggaggccuccugauugccuguuaugucaucaccgggacaagcgcugaccucaccguggagaaagccgccgacguuacaugggaagaggaagcugagcagacgggagugucucauaaccugaugauuaccgucgaugacgauggcacaaugcggaucaaggacgaugaaaccgagaacauucuuacagugcugcugaaaaccgcccuccugaucgucuccggcaucuuuccuuacagcauucccgcgacgcuucugguguggcacaccuggcagaagcagacacaacgcucugggguucucugggacgugccuucucccccggagacccagaaagcugaacuggaggaaggagucuacagaaucaagcagcagggcauuuucgggaagacacaagugggaguuggcgugcagaaagagggggucuuucauaccauguggcacgugacacggggagccgugcucacgcacaauggcaagcgccuggagccuaacugggccagcguuaaaaaggaucuuaucagcuauggcgggggauggagacugaaugcucaguggcaaaaaggcgaagagguccaggugauugccguggaacccgggaagaacccuaagaauuuccagaccaugcccggaaucuuccagacaaccaccggcgagauuggggcgaucgcucuggacuuuaaacccggaacauccggcagcccuaucauuaaccgggaaggcaaggucguggggcucuacggaaauggcguugugacgaaaaacgggggauaugucuccggcaucgcccaaaccaaugccgagccggaugggcccacaccugagcuggaagaggaaauguucaagaaacgcaaccuuaccauuauggaccugcaucccggcagcggaaagacaagaaaguaccucccugcuaucgugcgggaggccauuaaacgcagacugcggacccucauccuggcucccacgagaguuguggccgcggaaauggaggaggcccuuaagggccugccuauccgcuaucagacaaccgcuaccaaaucugaacacacagggcgggagauugucgaucugaugugccaugccaccuuuacaaugagacuccugagcccggugcgcguucccaauuacaaccuugugaucauggacgaagcucacuucaccgauccugccuccauugccgcucggggauauaucucuacgagagucggcaugggggaggcggccgcuauuuuuaugacagccacacccccuggaacagccgaggcuuucccccagagcaaugccccgauccaggacgaggagcgcgacaucccugaacgguccuggaacucuggcaaugaguggauuaccgauuuuguggggaagacggugugguucguccccagcaucaaagcgggcaacgacauugcuaacugucugagaaagaauggaaagaaaguuauccaacucucccgcaagaccuuugauacagaauaccagaaaacccggcugaacgacugggauuucguggugacaaccgacauuucugagaugggcgccaauuuuaaggccgauagagucaucgacccccggcgcugccugaaaccugugauucucacagaugggcccgagagaguuauccuugcuggaccuaugccggugaccgccgcgagcgccgcucagcggcgcggcagagucgggcggaacccccagaaggaaaaugaccaauacaucuucacgggacagccucugaacaaugaugaggaccaugcccacuggacagaagcuaagaugcugcucgacaacauuaauacccccgagggcaucauuccugcccuguucgaacccgagagagagaaauccgcugccaucgauggggaauaucgccuuaagggcgagagccggaaaaccuuuguggaacugaugagacgcggagaccucccgguuuggcuggcgcacaagguggccucugagggcauuaaauacacagaucggaaguggugcuucgacggggaaagaaacaaucagauccuggaggagaacauggaugucgaaaucuggaccaaagagggagaacgcaagaagcuccggccuagauggcuugacgcucgcacauauuccgauccccuggcccugaaagaguuuaaggacuucgcugccggcagaaaaagcauugcccucgaucuggugacggaaaucgggcgggucccuucucaucuugcucaccgcaccagaaaugcgcuggacaaccucgugaugcugcauacauccgagcacggaggccgggccuaccgccacgcuguugaggaacugcccgagaccauggaaacacuccuucugcugggccucaugauucugcuuaccgggggagugaugcuguuucucaucagcggcaaggggauuggaaaaacguccaucggccugaucugugugauugucucuagcgggaugcuguggauggccgauguuccucuccaguggaucgccuccgcuauugugcuugaguucuuuaugauggugcugcugauccccgagccggaaaagcaaagaaccccucaggacaaucagcucgccuaugucgugauuggaauccugacacuugcggccauuguugcugccaacgagaugggccugcucgaaaccacaaagcgggaucugggcaugagcaaagagcccgggguggucucucccaccuccuaccuggacguggaccuccauccugcuagcgccuggacgcuuuaugcggucgccacaaccgugaucacaccgaugcugagacacaccaucgaaaauucuaccgcuaacguuagccuggccgcuauugccaaccaagcugugguccucaugggacuggauaagggcuggcccaucuccaaaauggaccuuggggugccucugcucgcccugggaugcuacucucagguuaauccccugacacucacggcggccgugcuucugcuggucacccauuacgcuauuaucggcccugggcuccaggccaaggcuacacgcgaggcccagaaacggaccgccgcgggaauuaugaagaaccccacaguggauggcaucaugaccaucgaccuggauccugugauuuaugacagcaaguucgagaaacaacuuggccagguuaugcugcucguccuguguacggugcagcugcuccuuaugagaacauccugggcucugugcgaagcccugacccucgcuaccgggccgaucacaacccugugggagggaucucccggcaaguuuuggaauacaacgauugccgugagcauggccaacaucuuccgcggguccuaccuugcuggagccggccuggcguuuagcauuaugaaaucugucgggaccggacggagaggcacaggcucccagggggaaacccucggagagaaguggaaaaagaagcugaaucaacugagccggaaagaguucgaucucuauaagaaauccggcaucacagagguugaccgcaccgaggccaaggaagggcuuaaaagaggagagacgacccaccaugcugugucucggggcagcgccaagcugcagugguuuguggaacgcaacauggucaucccugaggggagagugauugaucugggauguggccggggcgggugguccuacuauugcgcuggacucaaaaagguuacagaagugcgcggcuacaccaaagggggacccggccacgaggagccuguccccaugucuacauauggguggaauaucgugaaacugaugagcggaaaggacguuuucuaccuuccgccugaaaaaugugauacccugcucugcgacauuggcgaguccagccccucucccacaguggaagaguccagaaccauccggguccugaagaugguggagccuuggcugcgcaacaaucaguucuguauuaaagugcucaaccccuacaugccuacggucaucgaacaccuugagagacugcagcggaaguauggcgggaugcugguuagaaauccgcucagccgcaacucuacacaugaaauguacuggauuuccaauggaaccggcaacaucgugagcucugugaauauggucagccggcugcuucugaacagauuuaccaugacacaccgccggcccacgaucgagaaggauguggaccucggggccggaaccagacauguuaacgcggaaccugagacacccaauauggacgugauuggcgagcgcaucaaacggauuaaggaagaacacuccucuaccuggcacuaugaugacgaaaacccuuacaaaacaugggccuaucaugggagcuacgaggucaaggcuaccggauccgccagcuccaugaucaauggcgugguuaaacugcugacaaagcccugggauguggucccgauggugacccaaauggcuaugacggacaccacaccuuucggccagcagagaguuuuuaaggaaaaaguggauacccgcacaccccggccuaugcccgggaccagaaaggucauggagauuacggccgaguggcucuggcgcacacugggacggaacaaaaagccuagacuuugcacccgcgaagaguucaccaagaaggugagaaccaaugcugccaugggcgcggucuuuacggaagagaaccaaugggacucugcccgggcugccguggaagaugaggaguucuggaagcugguugaccgcgaaagagagcuccacaaacuggggaaguguggaagcugcguguauaauaugaugggcaaacgggaaaagaaacuuggggaguuuggcaaggcuaaaggauccagagccaucugguacauguggcugggcgcccgguaccucgaguucgaagcgcugggguuucugaacgaggaucauugguucucucgcgaaaauagcuauuccggagucgagggcgaagggcuccacaagcugggauacauccuuagagacauuucuaagauccccggcggggcuauguaugccgaugacaccgccggcugggacacacggauuaccgaggaugaccugcauaacgaggagaagaucacacagcagauggauccggagcaccgccagcucgcuaaugccauuuuuaagcugaccuaccaaaacaaaguggugaagguucagagaccuacacccaaaggaaccgugauggacaucaucagccggaaggaucagcgcggcuccgggcaggucggaacguauggccuuaauacauucaccaacauggaagcucaacuggugagacagauggagggggaaggaguucucagcaaggccgaccuggagaauccccaucugcucgagaaaaagauuacccaguggcuggaaacaaaaggcguggagcggcuuaagcgcauggcgaucucuggggaugacugcgucgugaaaccuauugaugacagauuugccaacgcucugcucgcccugaacgauaugggcaagguccggaaggacaucccgcaguggcaacccuccaaaggauggcaugauuggcaacaggugccuuucuguagccaccauuuccacgaacuuauuaugaaggacggccgcaaacugguugugcccugcagaccucaggacgagcucaucgggcgggcucgcaucucucaaggagccggcuggucccugaaggaaaccgcgugucuggggaaagccuacgcucagauguggagccucauguauuuucacagacgggaucugagacuugccucuaaugcuauuugcuccgccguccccgugcauuggaucccuacaagccgcacgaccugguccauucacgcucaucaccaguggaugacaaccgaggacaugcugacaguuuggaaccggguguggaucgaggauaaucccuggauggaagacaagaccccggucacgaccugggaggaugugccuuaccucggaaagagagaagaccaaugguguggcagccugauugggcuuacaucucgcgccaccugggcgcagaacauccugacagccauucaacaggugcggagccucaucggcaaugaggaguuccuggauuacaugcccuccaugaaaagauuucgcaaggaagaggaaucugagggagcuaucugguga

SEQ ID NO: 20480 - RNA, 9873 nt, Artificial Sequence
  derived and/or modified CDS sequence (opt5) from DENV-3__GU131936__SS-prME
accagccugugccucaugaugaugcugcccgccacccuugcuuuccaccugacgucccgggacggcgagccucggaugaucguggggaagaacgaacgcggaaaaucucuccuguuuaagaccgccagcggcauuaauauguguacacuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacguggggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacagcuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgaguccaucgagggcaaagugguucaguaugaaaaccugaaguacaccgugauuaucacaguccacacgggggaccagcaucaggugggaaaugacacccaaggcguuacaguggagaucacaccccaggcuagcacagucgaagccgugcugccugaguauggcacccucgggcuggaaugcucuccccgcacgggacuugauuucaacgagaugauucugcucaccaugaaaaauaaggcuuggaugguccacagacagugguuuuucgaccugccucuucccuggacauccggcgccaccacagagaccccgacguggaaccggaaagaacugcucgugacauuuaagaaugcccaugcuaaaaagcaagagguugugguccuggggagccaggaaggagcgaugcacaccgcccugacaggcgcuaccgagauccagaacucugggggcaccuccauuuucgccggacaccucaagugucgccugaaaauggauaaacuugaacugaaaggcaugagcuacgccaugugccucaauacauuugugcugaagaaagagguuuccgagacgcagcaugggaccauccugauuaagguggaauacaagggagaggacgcuccuuguaaaauccccuucucuacagaagauggccaagggaaggcccacaacggaagacuuaucaccgcgaacccugucgugaccaagaaggaggagcccgugaauauugaagcugagcccccuuucggcgaaagcaacaucguuauugggaucggcgacaaagcccucaagauuaauugguauaagaaaggauccagcaucggcaagauguuugaggccaccgcuagaggggccagacgcauggcuauccugggagauacggccugggacuucggcucugucgggggagugcugaacucccucggcaaaauggugcaucagauuuuugggagcgcguacacagcccuguucucuggcgucagcuggaucaugaagauuggaaucggcgugcuucugaccuggauugggcucaauuccaaaaacaccucuaugagcuuuuccugcaucguuauuggaaucaucacacuguaucugggcgcugugguccaggccgauauggggugugugauuaauuggaagggaaaggaacuuaaaugcggcaacgggaucuucguuaccaaugaggugcacacauggacggagcaguacaaguuucaagcugacagcccgaaacggcucgccaccgcgauugccggcgcuugggaaaacggagucuguggcaucagaucuacaacccgcauggagaaucugcuguggaagcagauugccaacgaacucaauuauauccugugggagaacaauaucaaacuuacagugguugugggggauauuaucggaguccuggaacagggcaagcgggcucucacaccccagccuauggagcugaaauacuccuggaagacgugggggaaggccaaaauugugaccgccgagacacaaaacagcucuuucaucauugacggacccaacaccccugaaugccccuccgcuagcagagcguggaaugugugggaggucgaagacuauggcuuuggcguuuucacaaccaacaucuggcugaaacuucgcgagguguacacacaguccugugaucaucggcucaugucugccgcuaucaaagacgaaagagccgugcacgccgauaugggguacuggauugagagccagaagaauggauccuggaaacuggagaaggcuucuuuuaucgaagucaagaccugcacguggccgaaaagccacacacugugguccaacggcgugcucgagagcgacaugauuaucccuaagucucuggccgggcccauuucccagcauaaucaccgcccuggauaucauacccaaaccgcgggccccuggcaccuugggaaacuggaacucgauuucaacuacugcgagggaacaaccguugugaucgcugagaauuguggcacgcggggcccuagccugagaacaaccacagucucugggaagcugauccacgaauggugcugucgcuccugcacccuucccccgcuccgguauaugggagaggacggcuguugguacgggauggaaauuagaccuaucaacgagaaagaagagaauauggucaagagccugguuucugccggaagcggcaagguggauaacuuuacaauggggguccugugccucgccauucuguucgaggaagugaugcggggaaaauucggcaagaaacauaugaucgcuggcguucuuuuuaccuucgugcugcuccuguccgggcagauuacguggcgcgacauggcccacacccugaucaugauuggaagcaaugcgucugauagaaugggcaugggggucacauaucuugcucugaucgccaccuuuaagauccagcccuuccucgcccugggauuuuuccuccggaaacugacauccagagagaaccuucugcucggcguggggcuggcuauggccaccacgcugcaacuucccgaagacauugagcagauggcuaauggaaucgcccugggccucaugacacugaagcucauuacccaguuugaaacauaccagcuguggaccgcgcuugugagccugaccuguuccaacacaaucuucacgcucaccgucgccuggcgcacagcuacccugauucuggccggcguuucucuucugccucucugccaaagcuccucuaugcggaagacagauuggcugccgaugaccguggcugccaugggggugcccccucucccccuguuuaucuucagccuuaaagacacgccuaagagacgcuccuggccccugaaugagggagucauggccgugggccugguuucuauccucgcuagcucccugcuuagaaacgaugugccuauggcggggccccuggucgccggaggccuccugauugcuuguuaugugaucacagggaccagcgccgaccucaccguugagaaagccgcugacgugacaugggaagaggaagccgagcagaccggagucucucauaaccugaugauuacaguggaugacgauggcacgaugaagaucaaagacgaugaaaccgagaauauucuuacaguccugcugaagaccgcgcuccugaucguguccggcaucuuuccguacagcauuccugcuacacuucugguuuggcacaccuggcagaaacagacgcaacggucuggggugcucugggacguccccuccccucccgagacccagaaggccgaacuggaggaaggaguguaccgcaucaagcagcagggcauuuucgggaaaacacaaguuggagugggcguccagaaggaggggguguuucauaccauguggcacgugacaagaggagccguucucacccacaacggcaaacggcuggagccgaauugggcuagcgucaagaaagaucuuaucucuuauggcgggggauggcgccuguccgcccaguggcaaaagggcgaagagguccaggugauugcggucgaaccugggaagaaccccaaaaauuuccagacaaugccuggaaucuuccagacgaccacaggcgagauuggggcuaucgcccuggacuuuaagcccggaaccagcggcucccccaucauuaacagagaaggcaaagugguugggcucuacggaaauggcguggucaccaagaacgggggauaugugagcggcaucgcccaaacaaaugcugagccugaugggccgacgcccgagcuggaagaggaaauguucaaaaagcggaaccuuaccauuauggaccugcauccuggcucuggaaagacacgcaaauaccuccccgccaucguuagagaggcuauuaagcggcgccugagaacccucauccuggccccuacacggguggucgcggccgaaauggaggaggcucuuaaaggccugcccaucagauaucagaccacggccacaaagagcgaacacaccgggcgcgagauuguggaucugaugugccaugcuaccuuuacaaugcggcuccuguccccuguuagagugccgaauuacaaccuugucaucauggacgaagcccacuucaccgaucccgccucuauugcugcgcgcggauauaucagcacacgggugggcaugggggaggccgcugccauuuuuaugaccgccacgccucccggaacagcugaagccuucccucaguccaaugcgcccauccaggacgaggagagagacaucccggaacgcucuuggaacagcggcaaugaguggauuaccgauuuuguggggaaaacagucugguucguuccuuccaucaaggcuggcaacgacauugccaacugucugcggaagaauggcaaaaaggugauccaacucucuagaaaaaccuuugauacggaauaccagaagacccgccugaacgacugggauuucguggucacaaccgacauuagcgagaugggagccaauuuuaaagcugaucgggugaucgaccccagacggugccugaagcccguuauucucacagaugggccugagcgcgugauccuugccggacccaugccugucaccgcggccuccgcugcccagagacggggccgcguggggagaaacccgcagaaggaaaaugaccaauacaucuucaugggacagccccugaacaaugaugaggaccaugcucacuggacagaagccaaaaugcugcucgacaacauuaauaccccugagggcaucauucccgcucuguucgaaccugagcgggaaaagagcgccgcgaucgauggggaauauagacuuaaaggcgagucucgcaagacguuuguugaacugaugcggagaggagaccuccccguguggcuggcccacaaagucgcuuccgagggcauuaaguacacagaucgcaaauggugcuucgacggggaacggaacaaucagauccuggaggagaacauggauguggaaaucuggaccaaggagggagaaagaaagaaacuccgcccgcgguggcuugacgccagaaccuauagcgauccucuggcucugaaggaguuuaaagacuucgccgccggccgcaagucuauugcucucgaucuggucacagaaaucgggagagugcccucccaucuugcgcaccggacccgcaaugcccuggacaaccucguuaugcugcauacaagcgagcacggaggcagagcuuaccggcacgccguggaggaacugccugagacgauggaaacccuccuucugcugggccucaugauucugcuuacagggggagccaugcuguuucucaucuccggcaaagggauuggaaagaccucuaucggccugaucugugugauugucagcuccgggaugcuguggauggcugauguuccccuccaguggaucgccagcgcgauugugcuugaguucuuuaugauggugcugcugaucccugagcccgaaaagcaacgcacaccgcaggacaaucagcucgccuaugucgugauuggaauccugacccuugcugccauuguugcugccaacgagaugggccugcucgaaacgaccaaaagagaucugggcaugucuaaggagccugggguggucucccccacaagcuaccuggacguggaccuccaucccgcgucugccuggacccuuuaugcugucgccacaaccgugaucacgccuaugcugcggcacacaaucgaaaauagcaccgcuaacguuucccuggccgcuauugccaaccaagcggugguccucaugggacuggauaaaggcuggccgaucucuaagauggaccuuggggugccccugcucgcccugggaugcuacagccagguuaauccucugacacucaccgcugccgugcuucugcuggucacccauuacgcuauuaucggccccgggcuccaggccaaagccacaagagaggcgcagaagcgcacggcugccggaauuaugaagaacccuaccguggauggcaucaugacaaucgaccuggaucccgugauuuaugacuccaaauucgagaagcaacuuggccagguuaugcugcucguccugugugcugugcagcugcuccuuaugcggaccucuugggcccugugcgaagcccugacacucgcuaccgggccuaucacgacacugugggagggaagcccgggcaaauuuuggaauaccaccauugccguguccauggcgaacaucuucagagggagcuaccuugccggagcuggccuggccuuuucuauuaugaaguccgucgggacaggacgccggggcaccggcagccagggggaaacacucggagagaaauggaagaagaaacugaaucaacuguccagaaaggaguucgaucucuauaaaaagucuggcaucacggagguugaccggaccgaggcuaaagaagggcuuaagcgcggagagacaacccaccaugccgugagcagaggcuccgcgaaacugcagugguuuguggaacggaacauggucauccccgaggggcgcgugauugaucugggauguggcagaggcggguggucuuacuauugcgccggacucaagaagguuacagaagugcggggcuacaccaaagggggaccuggccacgaggagcccgucccuaugagcacguauggguggaauaucgugaagcugauguccggaaaagacguuuucuaccuucccccggaaaagugugauacccugcucugcgacauuggcgagagcucuccuucccccacaguggaagagagccgcaccaucagaguccugaaaaugguggagcccuggcugcggucuaaccaguucuguauuaaggugcucaauccuuacaugcccacagucaucgaacaccuugagcgccugcagagaaaguauggcgggaugcugguucggaacccucucuccagaaauagcacccaugaaauguacuggauuucuaacggaacaggcaauaucgugagcuccgugaacauggucucucgccugcuucugaaucgguuuaccaugacgcacagacgcccgacaaucgagaaagauguggaccucggggcuggaacccggcauguuaacgccgaacccgagaccccuaacauggacgugauuggcgagagaaucaagcgcauuaaagaagaacacagcuccacauggcacuaugaugacgaaaaucccuacaagacgugggcuuaucaugggagcuacgaggucaaagccaccggauccgcuucuagcaugaucaacggcgugguuaagcugcugacaaagccuugggaugugguccccauggugacccaaauggccaugacagacaccacaccguucggccagcagcggguuuuuaaagaaaagguggauaccagaacgccucgccccaugccugggacccggaaagucauggagauuacagcggaguggcucuggagaacccugggacgcaauaagaaaccccggcuuugcacaagagaagaguucaccaagaaggugcgcacgaacgccgcuaugggcgccgucuuuacagaagagaaucaaugggacuccgcuagagccgccguggaagaugaggaguucuggaaacugguugacaaggaacgggagcuccacaaacuggggaaguguggaucuugcguguauaacaugaugggcaaacgcgaaaagaaacuuggggaguuuggcaaggcgaagggaagcagagcuaucugguacauguggcugggcgcccgguaccucgaguucgaagcccugggguuucugaaugaggaucauugguucuccagagaaaacucuuauagcggagucgagggcgaagggcuccacaaacugggauacauccuucgggacauuuccaagaucccuggcggggcuauguaugccgaugacaccgcuggcugggacacacgcauuaccgaggaugaccugcauaaugaggagaagaucacgcagcagauggaucccgagcacagacagcucgccaacgcgauuuuuaagcugaccuaccaaaauaaaguggugaagguucagcggccgacaccuaagggaaccgugauggacaucaucagccgcaaagaucagagaggcucugggcaggucggaacauauggccuuaacaccuucacaaauauggaagcccaacuggugcggcagauggagggggaaggaguucucuccaaggcugaccuggagaacccccaucugcucgagaaaaagauuacccaguggcuggaaacgaaaggcguggagcgccuuaagagaauggccaucagcggggaugacugcgucgugaagcccauugaugaccgguuugcuaaugcccugcucgcgcugaacgauaugggcaaaguccgcaaggacaucccucaguggcaaccgucuaaaggauggcaugauuggcaacaggugcccuucuguucccaccauuuccacgaacuuauuaugaaggacggcagaaaacugguugugccuugccggccccaggacgagcucaucgggcgcgccagaaucagccaaggagcuggcuggucucugaaggaaacagccugucuggggaaggcuuacgcccagauguggucccucauguauuuucaccggcgcgaucugagacuugcuagcaacgccauuugcuccgcggucccugugcauuggauccccaccagccggaccacauggucuauucacgcccaucaccaguggaugaccacagaggacaugcugacgguuuggaauagaguguggaucgaggauaacccuuggauggaagacaaaacccccgucacaaccugggaggaugugccguaccucggaaagcgcgaagaccaaugguguggcagccugauugggcuuacaucccgggcuaccugggcccagaauauccugacggccauucaacaggugagaucucucaucggcgaugaggaguuccuggacuacaugccuagcaugaaacgcuuucggaaggaagaggaaaccgagggagcuaucugguga

SEQ ID NO: 20481 - RNA, 9873 nt, Artificial Sequence
  derived and/or modified CDS sequence (opt5) from DENV-3__GU131937__SS-prME
acaagccugugccucaugaugaugcugcccgccacgcuugcuuuccaccugacgucccgggacggcgagccucggaugaucguggggaagaaugaacgcggaaagucucuccuguuuaagacagccagcggcaucaauauguguacacuuaucgcgauggaucugggggagaugugcgacgauaccgugacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacagcuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcuccgggaucuucguuaccaacgaggugcacacauggacggagcaguacaaguuucaagcugacagccccaaacggcucgccaccgcgauugccggcgcuugggaaaauggagucuguggcaucagaucuacaacccgcauggagaaccugcuguggaagcagauugccaaugaacucaacuauauccugugggagaauaacaucaaacuuacagugguugugggggauauuaucggaguccuggaacagggcaagcggacccucacgccucagcccauggagcugaaauacuccuggaagaccugggggaaggcuaaaauugugacagccgagacccaaaauagcucuuucaucauugacggaccuaacacacccgaaugcccguccacccugagagccuggaacgugugggaggucgaagacuauggcuuuggcguuuucacaaccaauaucuggcuuaagcuccgcgagguguacacgcagagcugugaucaucggcugauguccgcugcgaucaaagacgaaagagccgugcacgcugauaugggguacuggauugagucucagaagaacggaagcuggaaacuggagaaggccuccuuuaucgaagucaagacaugcaccuggccuaaaucucacacccucuggagcaauggcgugcuggaguccgacaugauuauccccaagagccuugccgggccuauuucucagcauaacuaucgccccggauaccacacacaaaccgcuggcccuuggcaucuggggaaacucgaacuggauuucaauuauugcgagggaacgacaguugugaucaccgagaacuguggcacacggggccccucccugagaaccacaaccgucagcgggaaacuuauccacgaauggugcugucgcucuugcacgcucccgccucugcgguacaugggagaggacggcuguugguaugggauggaaauuagacccaucaaugagaaagaagagaacauggugaagucccugguuagcgccggaucuggcaagguggauaauuuuaccauggggguccucugccuggcgauucuuuucgaggaagugaugcggggaaaauucggcaagaaacacaugaucgcuggcguucuguuuacauucgugcuccugcugagcgggcagauuaccuggcgcgacauggcccauacacuuaucaugauuggauccaacgccagcgauagaaugggcaugggggucaccuaccuggcucucaucgccacguuuaagauccagcccuuccuggcgcucggauuuuuccugcggaaacuuacaucuagagagaaucugcuccugggcguggggcuggcuauggccaccacacuucaacugccugaagacauugagcagauggccaacggaaucgcucucggccugaugacccucaagcugauuacccaguuugaaacauaucagcuuuggacggcccuggugucccucaccuguagcaauacaaucuucacccugacagucgcuuggcgcaccgccacgcugauucuugcgggcguuucccugcucccgcugugccaaucuagcuccaugcggaagacagauuggcuccccaugaccguggccgcuaugggggugccuccccugccucuuuuuaucuucucucugaaagacacccccaagagacgcagcuggccucugaacgagggagucauggccgugggccucguuuccauccuggcuucuagccuucugagaaaugaugugcccauggccgggccgcucgucgccggaggccugcucauugcuuguuacgugaucacagggaccuccgcggaccugacaguugagaaagccgcugacgugacgugggaagaggaagccgagcagaccggagucagccacaaccuuaugauuacaguggaugacgauggcaccaugcggaucaaggacgaugaaacagagaacauucugaccguccugcucaaaacggcccugcuuaucgugucuggcaucuuuccuuacuccauucccgcuacccugcucguuuggcauacauggcagaagcagacccaacgcagcggggugcugugggacgucccuucucccccggagacacagaaagccgaacucgaggaaggaguguauagaaucaagcagcagggcauuuucgggaagacccaaguuggagugggcguccagaaagaggggguguuucacacaauguggcaugugacgcggggagcgguucugacccacaauggcaagcgccuugagccuaacugggcuuccgucaaaaaggaucugaucagcuacggcgggggauggagacugucugcccaguggcaaaaaggcgaagagguccaggugauugccgucgaacccgggaagaauccuaagaacuuccagacaaugcccggaaucuuccagaccaccacaggcgagauuggggcuaucgcccucgacuuuaaacccggaacguccggcagcccuaucauuaaucgggaaggcaaggugguugggcuguauggaaacggcguggucaccaaaaaugggggauacguguccggcaucgcgcaaacaaacgcugagccggaugggcccaccccugagcuugaagaggaaauguucaagaaacgcaaucugacaauuauggaccuccaccccggcagcggaaagaccagaaaguaucugccugccaucguucgggaggccauuaaacgcagacuccggacgcugauccuugcucccacaagaguggucgccgcugaaauggaggaggcccugaagggccugccuauccgcuaccagaccaccgcgacaaaaucugaacauaccgggcgggagauuguggaucucaugugccacgccacauuuaccaugagacugcuuagcccgguucgcgugcccaacuauaaucuggucaucauggacgaagcucauuucacggauccugccuccauugcugcccggggauacaucucuacaagagugggcaugggggaggccgcugcgauuuuuaugaccgccacacccccuggaaccgcugaagccuucccccagagcaacgccccgauccaggacgaggagcgcgacaucccugaacgguccuggaacucuggcaacgaguggauuacggauuuuguggggaagaccgucugguucguucccagcaucaaagcuggcaaugacauugccaacugucucagaaagaacggaaagaaagugauccaacugucccgcaagacauuugauaccgaauaccagaaaacacggcugaaugacugggauuucguggucaccacagacauuucugagaugggcgcgaacuuuaaggcugauagagugaucgacccccggcgcugccucaaaccuguuauucuuaccgaugggcccgagagagugauccuggccggaccuaugccggucacggccgcuagcgccgcgcagcggcgcggcagaguggggcggaauccccagaaggaaaacgaccaauauaucuucacaggacagccucugaauaacgaugaggaccacgcccauuggaccgaagcuaagaugcuccuggacaauauuaacacccccgagggcaucauuccugcccuuuucgaacccgagagagagaaauccgcugccaucgauggggaauaccgccugaagggcgagagccggaaaacauuuguugaacucaugagacgcggagaccugccgguguggcuggcucacaaggucgccucugagggcauuaaauauaccgaucggaaguggugcuucgacggggaaagaaauaaccagauccucgaggagaauauggauguggaaaucuggacaaaagagggagaacgcaagaaacuucggccuagauggcuggacgcgcgcacguacuccgauccccuggcccucaaagaguuuaaggacuucgcugccggcagaaaaagcauugcucuggaucuugucaccgaaaucgggcgggugccuucucaccuggcccaucgcacaagaaacgcccucgacaaucugguuaugcugcacaccuccgagcauggaggccgggcuuaucgccacgcgguggaggaacuccccgagacaauggaaacccuucugcugcucggccugaugauuagccuuacagggggagccaugcuguuucucaucuccggcaaggggauuggaaaaaccucuaucggccugaucugugugauugucagcuccgggaugcuguggauggcugauguuccucuccaguggaucgccagcgccauugugcuugaguucuuuaugauggugcugcugauccccgagccggaaaagcaaagaacaccucaggacaaccagcucgcuuacgucgugauuggaauccugacccuugccgcgauuguugccgcuaaugagaugggccugcucgaaacaaccaagcgggaucugggcaugucuaaagagcccgggguggucucccccacgagcuaucuggacguggaccuccacccugccucugcuuggacacuuuacgccgucgcgaccacagugaucaccccgaugcugagacauaccaucgaaaacagcacagccaauguuucccuggcugccauugcuaaccaagccgugguccucaugggacuggauaagggcuggcccaucucuaaaauggaccuuggggugccucugcucgcucugggaugcuacagccagguuaacccccugacgcucaccgccgcggugcuucugcuggucacacacuaugccauuaucggcccugggcuccaggcuaaggccacccgcgaggcucagaaacggacagccgccggaauuaugaagaaucccaccguggauggcaucaugacgaucgaccuggauccugugauuuacgacuccaaguucgagaaacaacuuggccagguuaugcugcucguccugugugcggugcagcugcuccuuaugagaacaucuugggcucugugcgaagcccugacccucgcuaccgggccgaucacaacccugugggagggaagccccggcaaguuuuggaacacaacgauugccguguccauggccaauaucuuccgcgggagcuaucuugcuggagccggccuggcguuuucuauuaugaaauccgucgggaccggacggagaggcacaggcagccagggggaaacccucggagagaaguggaaaaagaagcugaaccaacugucccggaaagaguucgaucucuacaagaaaucuggcaucacagagguugaccgcaccgaggccaaggaagggcuuaaaagaggagagacgacccaucacgcugugagccggggcuccgccaagcugcagugguuuguggaacgcaauauggucaucccugaggggagagugauugaucugggauguggccggggcggguggucuuauuacugcgcuggacucaaaaagguuacagaagugcgcggcuauaccaaagggggacccggccaugaggagccuguccccaugagcacauacggguggaacaucgugaaacugauguccggaaaggacguuuucuaccuuccgccugaaaaaugugauacccugcucugcgacauuggcgagagcucucccucccccacaguggaagagaauagaaccauccggguccugaagaugguggagccuuggcugcgcaacaaucaguucuguauuaaagugcucaaccccuauaugccuacggucaucgaacaccuugagagacugcagcggaaguacggcgggaugcugguuagaaauccgcucagccgcaacucuacacacgaaauguauuggauuuccaauggaaccggcaacaucgugagcucugugaauauggucagccggcugcuucugaacagauuuaccaugacacaucgccggcccacgaucgagaaggauguggaccucggggccggaaccagacacguuaacgcggaaccugagacacccaauauggacgugauuggcgagcgcaucaaacggauuaaggaagaacacuccucuaccuggcacuacgaugacgaaaacccuuauaaaacaugggccuaccacgggagcuaugaggucaaggcuaccggauccgccagcuccaugaucaauggcgugguuaaacugcugacaaagcccugggauguggucccgauggugacccaaauggcuaugacggacaccacaccuuucggccagcagagaguuuuuaaggaaaaaguggauacccgcacaccccggccuaugcccgggaccagaaaggucauggagauuacggccgaguggcucuggcgcacacugggacggaacaaaaagccuagacuuugcacccgcgaagaguucaccaagaaggugagaaccaaugcugccaugggcgcggucuuuacggaagagaaccaaugggacucugcccgggcugccguggaagaugaggaguucuggaagcugguugaccgcgaaagagagcuccauaaacuggggaaguguggaagcugcguguacaauaugaugggcaaacgggaaaagaaacuuggggaguuuggcaaggcuaaaggauccagagccaucugguacauguggcugggcgcccgguaucucgaguucgaagcgcugggguuucugaacgaggaucacugguucucucgcgaaaauagcuacuccggagucgagggcgaagggcuccauaagcugggauauauccuuagagacauuucuaagauccccggcggggcuauguacgccgaugacaccgccggcugggacacacggauuaccgaggaugaccugcacaacgaggagaaaauuacacagcagauggauccggaacaucgccagcucgcuaaugccauuuuuaagcugaccuaucaaaacaaaguggugaagguucagagaccuacacccaaaggaaccgugauggacaucaucagccggaaggaucagcgcggcuccgggcaggucggaacguacggccuuaauacauucaccaacauggaagcucaacuggugagacagauggagggggaaggaguucucagcaaggccgaccuggagaauccccaucugcucgagaaaaagauuacccaguggcuggaaacaaaaggcguggagcggcuuaagcgcauggcgaucucuggggaugacugcgucgugaaaccuauugaugacagauuugccaacgcucugcucgcccugaacgauaugggcaagguccggaaggacaucccgcaguggcaacccuccaaaggauggcacgauuggcaacaggugccuuucuguagccaucacuuccaugaacuuauuaugaaggacggccgcaaacugguugugcccugcagaccucaggacgagcucaucgggcgggcucgcaucucucaaggagccggcuggucccugaaggaaaccgcgugucuggggaaagccuaugcucagauguggagccucauguacuuucacagacgggaucugagacuugccucuaaugcuauuugcuccgccguccccgugcacuggaucccuacaagccgcacgaccugguccauucaugcucaccaucaguggaugacaaccgaggacaugcugacaguuuggaaccggguguggaucgaggauaaucccuggauggaagacaagaccccggucacgaccugggaggaugugccuuaccucggaaagagagaagaccaaugguguggcagccugauugggcuuacaucucgcgccaccugggcgcagaacauccugacagccauucaacaggugcggagccucaucggcgaugaggaguuccuggacuauaugcccuccaugaaaagauuucgcaaggaagaggaaucugagggagcuaucugguga

SEQ ID NO: 20482 - RNA, 9873 nt, Artificial Sequence
  derived and/or modified CDS sequence (opt5) from DENV-3__GU131938__SS-prME
accagccugugccucaugaugaugcugcccgccacccuugcuuuccaccugacgucccgggacggcgagccucggaugaucguggggaagaacgaacgcggaaaaucucuccuguuuaagaccgccagcggcauuaauauguguacacuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcacagacgggacaagcgcucuguggcccuggcuccucacguggggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacagcuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgaguccaucgagggcaaagugguucaguaugaaaaccugaaguacaccgugauuaucacaguccacacgggggaccagcaucaggugggaaaugacacccaaggcguuacaguggagaucacaccccaggcuagcacagucgaagccgugcugccugaguauggcacccucgggcuggaaugcucuccccgcacgggacuugauuucaacgagaugauucugcucaccaugaaaaauaaggcuuggaugguccacagacagugguuuuucgaccugccucuucccuggacauccggcgccaccacagagaccccgacguggaaccggaaagaacugcucgugacauuuaagaaugcccaugcuaaaaagcaagagguugugguccuggggagccaggaaggagcgaugcacaccgcccugacaggcgcuaccgagauccagaacucugggggcaccuccauuuucgccggacaccucaagugucgccugaaaauggauaaacuugaacugaaaggcaugagcuacgccaugugccucaauacauuugugcugaagaaagagguuuccgagacgcagcaugggaccauccugauuaagguggaauacaagggagaggacgcuccuuguaaaauccccuucucuacagaagauggccaagggaaggcccacaacggaagacuuaucaccgcgaacccugucgugaccaagaaggaggagcccgugaauauugaagcugagcccccuuucggcgaaagcaacaucguuauugggaucggcgacaaagcccucaagauuaauugguauaagaaaggauccagcaucggcaagauguuugaggccaccgcuagaggggccagacgcauggcuauccugggagauacggccugggacuucggcucugucgggggagugcugaacucccucggcaaaauggugcaucagauuuuugggagcgcguacacagcccuguucucuggcgucagcuggaucaugaagauuggaaucggcgugcuucugaccuggauugggcucaauuccaaaaacaccucuaugagcuuuuccugcaucguuauuggaaucaucacacuguaucugggcgcugugguccaggccgauauggggugugugauuaauuggaagggaaaggaacuuaaaugcggcaacgggaucuucguuaccaaugaggugcacacauggacggagcaguacaaguuucaagcugacagcccgaaacggcucgccaccgcgauugccggcgcuugggaaaacggagucuguggcaucagaucuacaacccgcauggagaaucugcuguggaagcagauugccaacgaacucaauuauauccugugggagaacaauaucaaacuuacagugguugugggggauauuaucggaguccuggaacagggcaagcgggcucucacaccccagccuauggagcugaaauacuccuggaagacgugggggaaggccaaaauugugaccgccgagacacaaaacagcucuuucaucauugacggacccaacaccccugaaugccccuccgcuagcagagcguggaaugugugggaggucgaagacuauggcuuuggcguuuucacaaccaacaucuggcugaaacuucgcgagguguacacacaguccugugaucaucggcucaugucugccgcuaucaaagacgaaagagccgugcacgccgauaugggguacuggauugagagccagaagaauggauccuggaaacuggagaaggcuucuuuuaucgaagucaagaccugcacguggccgaaaagccacacacugugguccaacggcgugcucgagagcgacaugauuaucccuaagucucuggccgggcccauuucccagcauaaucaccgcccuggauaucauacccaaaccgcgggccccuggcaccuugggaaacuggaacucgauuucaacuacugcgagggaacaaccguugugaucgcugagaauuguggcacgcggggcccuagccugagaacaaccacagucucugggaagcugauccacgaauggugcugucgcuccugcacccuucccccgcuccgguauaugggagaggacggcuguugguacgggauggaaauuagaccuaucaacgagaaagaagagaauauggucaagagccugguuucugccggaagcggcaagguggauaacuuuacaauggggguccugugccucgccauucuguucgaggaagugaugcggggaaaauucggcaagaaacauaugaucgcuggcguucuuuuuaccuucgugcugcuccuguccgggcagauuacguggcgcgacauggcccacacccugaucaugauuggaagcaaugcgucugauagaaugggcaugggggucacauaucuugcucugaucgccaccuuuaagauccagcccuuccucgcccugggauuuuuccuccggaaacugacauccagagagaaccuucugcucggcguggggcuggcuauggccaccacgcugcaacuucccgaagacauugagcagauggcuaauggaaucgcccugggccucaugacacugaagcucauuacccaguuugaaacauaccagcuguggaccgcgcuugugagccugaccuguuccaacacaaucuucacgcucaccgucgccuggcgcacagcuacccugauucuggccggcguuucucuucugccucucugccaaagcuccucuaugcggaagacagauuggcugccgaugaccguggcugccaugggggugcccccucucccccuguuuaucuucagccuuaaagacacgccuaagagacgcuccuggccccugaaugagggagucauggccgugggccugguuucuauccucgcuagcucccugcuuagaaacgaugugccuauggcggggccccuggucgccggaggccuccugauugcuuguuaugugaucacagggaccagcgccgaccucaccguugagaaagccgcugacgugacaugggaagaggaagccgagcagaccggagucucucauaaccugaugauuacaguggaugacgauggcacgaugaagaucaaagacgaugaaaccgagaauauucuuacaguccugcugaagaccgcgcuccugaucguguccggcaucuuuccguacagcauuccugcuacacuucugguuuggcacaccuggcagaaacagacgcaacggucuggggugcucugggacguccccuccccucccgagacccagaaggccgaacuggaggaaggaguguaccgcaucaagcagcagggcauuuucgggaaaacacaaguuggagugggcguccagaaggaggggguguuucauaccauguggcacgugacaagaggagccguucucacccacaacggcaaacggcuggagccgaauugggcuagcgucaagaaagaucuuaucucuuauggcgggggauggcgccuguccgcccaguggcaaaagggcgaagagguccaggugauugcggucgaaccugggaagaaccccaaaaauuuccagacaaugccuggaaucuuccagacgaccacaggcgagauuggggcuaucgcccuggacuuuaagcccggaaccagcggcucccccaucauuaacagagaaggcaaagugguugggcucuacggaaauggcguggucaccaagaacgggggauaugugagcggcaucgcccaaacaaaugcugagccugaugggccgacgcccgagcuggaagaggaaauguucaaaaagcggaaccuuaccauuauggaccugcauccuggcucuggaaagacacgcaaauaccuccccgccaucguuagagaggcuauuaagcggcgccugagaacccucauccuggccccuacacggguggucgcggccgaaauggaggaggcucuuaaaggccugcccaucagauaucagaccacggccacaaagagcgaacacaccgggcgcgagauuguggaucugaugugccaugcuaccuuuacaaugcggcuccuguccccuguuagagugccgaauuacaaccuugucaucauggacgaagcccacuucaccgaucccgccucuauugcugcgcgcggauauaucagcacacgggugggcaugggggaggccgcugccauuuuuaugaccgccacgccucccggaacagcugaagccuucccucaguccaaugcgcccauccaggacgaggagagagacaucccggaacgcucuuggaacagcggcaaugaguggauuaccgauuuuguggggaaaacagucugguucguuccuuccaucaaggcuggcaacgacauugccaacugucugcggaagaauggcaaaaaggugauccaacucucuagaaaaaccuuugauacggaauaccagaagacccgccugaacgacugggauuucguggucacaaccgacauuagcgagaugggagccaauuuuaaagcugaucgggugaucgaccccagacggugccugaagcccguuauucucacagaugggccugagcgcgugauccuugccggacccaugccugucaccgcggccuccgcugcccagagacggggccgcguggggagaaacccgcagaaggaaaaugaccaauacaucuucaugggacagccccugaacaaugaugaggaccaugcucacuggacagaagccaaaaugcugcucgacaacauuaauaccccugaggcuaucauucccgcccuguucgaaccugagcgggaaaagagcgcggccaucgauggcgaauauagacuuaaaggggagucucgcaagacguuuguugaacugaugcggagaggcgaccuccccguguggcuggcucacaaagucgccuccgagggaauuaaguacacagaucgcaaauggugcuucgacggcgaacggaacaaucagauccuggaggagaacauggauguggaaaucuggaccaaggagggggaaagaaagaaacuccgcccgcgguggcuugacgcuagaaccuauagcgauccucuggcccugaaggaguuuaaagacuucgccgcuggacgcaagucuauugcgcucgaucuggucacagaaaucggcagagugcccucccaucuugcccaccggacccgcaaugcucuggacaaccucguuaugcugcauacaagcgagcacgggggacgggccuaccggcacgccguggaggaacugccugagacgauggaaacccuccuucugcugggccucaugauucugcuuacaggcggggcuaugcuguuucucaucuccggaaaaggcauugggaagaccucuaucggacugaucugugugauugucagcuccggcaugcuguggauggccgauguuccccuccaguggaucgcgagcgccauugugcuugaguucuuuaugauggugcugcugaucccugagcccgaaaagcaacgcacaccgcaggacaaucagcucgcuuaugucgugauugggauccugacccuugccgcuauuguugccgcgaacgagaugggacugcucgaaacgaccaaaagagaucugggcaugucuaaggagccuggcguggucucccccacaagcuaccuggacguggaccuccaucccgccucugcuuggacccuuuaugccgucgcuacaaccgugaucacgccuaugcugcggcacacaaucgaaaauagcaccgccaacguuucccuggcugccauugcgaaccaagccgugguccucauggggcuggauaaaggauggccgaucucuaagauggaccuuggcgugccccugcucgcucuggggugcuacagccagguuaauccucugacacucaccgccgcugugcuucugcuggucacccauuacgccauuaucggacccggccuccaggccaaagcgacaagagaggcucagaagcgcacggccgcugggauuaugaagaacccuaccguggauggaaucaugacaaucgaccuggaucccgugauuuaugacuccaaauucgagaagcaacuuggccagguuaugcugcucguccugugugccgugcagcugcuccuuaugcggaccucuugggcccugugcgaagcucugacacucgccaccggcccuaucacgacacugugggaggggagcccgggaaaauuuuggaauaccaccauugcgguguccauggccaacaucuucagaggcagcuaccuugcuggggccggacuggcuuuuucuauuaugaaguccgucggcacagggcgccggggaaccggcagccagggcgaaacacucggggagaaauggaagaagaaacugaaucaacuguccagaaaggaguucgaucucuauaaaaagucuggaaucacggagguugaccggaccgaggccaaagaaggccuuaagcgcggggagacaacccaccaugcggugagcagaggauccgccaaacugcagugguuuguggaacggaacauggucauccccgagggccgcgugauugaucugggguguggaagaggcggcuggucuuacuauugcgcugggcucaagaagguuacagaagugcggggauacaccaaaggcgggccuggacacgaggagcccgucccuaugagcacguauggcuggaauaucgugaagcugauguccgggaaagacguuuucuaccuucccccggaaaagugugauacccugcucugcgacauuggagagagcucuccuucccccacaguggaagagagccgcaccaucagaguccugaaaaugguggagcccuggcugcggucuaaccaguucuguauuaaggugcucaauccuuacaugcccacagucaucgaacaccuugagcgccugcagagaaaguauggcggcaugcugguucggaacccucucuccagaaauagcacccaugaaauguacuggauuucuaacgggacaggaaauaucgugagcuccgugaacauggucucucgccugcuucugaaucgguuuaccaugacgcacagacgcccgacaaucgagaaagauguggaccucggcgccgggacccggcauguuaacgcugaacccgagaccccuaacauggacgugauuggagagagaaucaagcgcauuaaagaagaacacagcuccacauggcacuaugaugacgaaaaucccuacaagacgugggccuaucauggcagcuacgaggucaaagcuaccggguccgccucuagcaugaucaacggagugguuaagcugcugacaaagccuugggaugugguccccauggugacccaaauggcgaugacagacaccacaccguucggccagcagcggguuuuuaaagaaaagguggauaccagaacgccucgccccaugccuggcacccggaaagucauggagauuacagccgaguggcucuggagaacccuggggcgcaauaagaaaccccggcuuugcacaagagaagaguucaccaagaaggugcgcacgaacgcugccaugggagcugucuuuacagaagagaaucaaugggacuccgccagagccgcgguggaagaugaggaguucuggaaacugguugacaaggaacgggagcuccacaaacugggcaagugugggucuugcguguauaacaugaugggaaaacgcgaaaagaaacuuggcgaguuugggaaggcuaagggcagcagagccaucugguacauguggcugggagcccgguaccucgaguucgaagcucugggcuuucugaaugaggaucauugguucuccagagaaaacucuuauagcggggucgagggagaaggccuccacaaacugggguacauccuucgggacauuuccaagaucccuggaggcgccauguaugcugaugacaccgccgggugggacacacgcauuaccgaggaugaccugcauaaugaggagaagaucacgcagcagauggaucccgagcacagacagcucgcgaacgccauuuuuaagcugaccuaccaaaauaaaguggugaagguucagcggccgacaccuaagggcaccgugauggacaucaucagccgcaaagaucagagaggaucuggccaggucgggacauauggacuuaacaccuucacaaauauggaagcucaacuggugcggcagauggagggcgaagggguucucuccaaggccgaccuggagaacccccaucugcucgagaaaaagauuacccaguggcuggaaacgaaaggaguggagcgccuuaagagaauggcuaucagcggcgaugacugcgucgugaagcccauugaugaccgguuugccaaugcgcugcucgcccugaacgauauggggaaaguccgcaaggacaucccucaguggcaaccgucuaaaggcuggcaugauuggcaacaggugcccuucuguucccaccauuuccacgaacuuauuaugaaggacggaagaaaacugguugugccuugccggccccaggacgagcucaucggccgcgcuagaaucagccaaggggccggauggucucugaaggaaacagcuugucugggcaaggccuacgcucagauguggucccucauguauuuucaccggcgcgaucugagacuugccagcaacgcgauuugcuccgccgucccugugcauuggauccccaccagccggaccacauggucuauucacgcucaucaccaguggaugaccacagaggacaugcugacgguuuggaauagaguguggaucgaggauaacccuuggauggaagacaaaacccccgucacaaccugggaggaugugccguaccucgggaagcgcgaagaccaaugguguggaagccugauuggccuuacaucccgggccaccugggcccagaauauccugacggcuauucaacaggugagaucucucaucggggaugaggaguuccuggacuacaugccuagcaugaaacgcuuucggaaggaagaggaaaccgagggcgccaucugguga

SEQ ID NO: 20483 - RNA, 9873 nt, Artificial Sequence
  derived and/or modified CDS sequence (opt5) from DENV-3__GU131939__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaagcuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugacaaaaaaggaggagcccauuaauaucgaagcugagccuccguucggcgaaucuaacauugugaucgggauuggcgacaaagcccucaagaucaauugguauaagaaaggaagcuccaucggcaagauguuugaggccaccgcucggggggccagacgcauggcuauucugggagauacggccugggacuucggcagcguugggggaguccugaacucucucggcaaaauggugcaucagaucuuuggguccgcguacacagcccuguucagcggcgugucuuggauuaugaagaucggaauuggcguccuucugaccuggaucgggcucaauagcaaaaacaccuccaugucuuuuagcugcauugugaucggaaucauuacacuguaucugggcgcuguugugcaggccgauauggggugugucaucaauuggaagggaaaggaacuuaaaugcggcaacgggauuuucgugaccaaugagguucacacauggacggagcaguacaaguuucaagcugacucccccaaacggcucgccaccgcgaucgccggcgcuugggaaaacggaguguguggcauuagaagcacaacccgcauggagaaucugcuguggaagcagaucgccaacgaacucaauuauauccugugggagaacaauauuaaacuuacagucgugguuggggauaucauuggagugcuggaacagggcaagcggacccucacgccucagcccauggagcugaaauacucuuggaagaccugggggaaggcuaaaaucgucacagccgagacccaaaacuccagcuucauuaucgacggaccuaacacacccgaaugcccgucugccuccagagcuuggaaugugugggagguggaagacuauggcuuuggcgucuucaccacaaacaucuggcugaagcuucgcgagguuuacacccagagcugugaucaucggcucauguccgcggccauuaaagacgaaagagcugugcacgccgauaugggguacuggaucgagucucagaagaauggaagcuggaaacuggagaaggccuccuuuauugaagugaagacgugcacauggccuaaaucucacacccuguggagcaacggcguccucgaguccgacaugaucauucccaagagccuggcugggccuaucucucagcauaaucaccgccccggauaucauacccaaacagccggcccuuggcaccuugggaaacuggaacucgauuucaacuacugcgagggaaccacggugguuaucgcggagaauuguggcacacggggccccucccugagaaccacaaccgugagcgggaagcugauucacgaauggugcugucgcucuugcacacuuccgccucuccgguauaugggagaggacggcuguugguacgggauggaaaucagacccauuaacgagaaagaagagaauauggucaagucccuggugagcgcuggaucuggcaagguugauaacuuuaccaugggggugcugugccucgccauccuguucgaggaagucaugcggggaaaauucggcaagaaacauaugauugccggcgugcuuuuuacguucguucugcuccugagcgggcagaucaccuggcgcgacauggcucacacacugauuaugaucggauccaaugccagcgauagaaugggcaugggggugaccuaucuugcgcugaucgcuacauuuaagauucagcccuuccucgcccugggauuuuuccuccggaaacugaccucuagagagaaccuucugcucggcgucgggcuggccauggcuacgacacugcaacuuccugaagacaucgagcagauggccaauggaauugcucugggccucaugacccugaagcucaucacacaguuugaaaccuaccagcuguggaccgcccuugugucccugacauguagcaacacgauuuucacccucacaguggcguggcgcaccgccacacugauccuggcuggcgucucccuucugccgcucugccaaucuagcuccaugcggaagaccgauuggcugcccaugacgguugccgcuaugggggugccuccccucccucuguuuaucuucucucuuaaagacacacccaagagaaaaagcuggccucugaaugagggagugauggccgucggccugguguccauucucgccucuagccugcuucgcaacgauguucccauggcugggccgcugguggcgggaggccuccugaucgccuguuaugucauuaccgggaccuccgcugaccucacaguggagaaggccgccgacguuaccugggaagaggaagcugagcagacaggagugagccauaaccugaugaucacggucgaugacgauggcaccaugagaauuaaagacgaugaaacagagaauauccuuaccgugcugcugaagacagcccuccugaucgucucuggcauuuuuccuuacuccauccccgcgacccuucugguguggcacacguggcagaaacagacccaacggagcgggguucucugggacgugccuucucccccggagacacagaaggcugaacuggaggaaggagucuaccgcauuaagcagcagggcaucuucgggaaaacccaagugggaguuggcgugcagaaggagggggucuuucauacaauguggcacgugaccagaggagccgugcucacacacaacggcaaacggcuggagccuaauugggccuccguuaagaaagaucuuauuagcuauggcgggggauggcgccugucugcucaguggcaaaagggcgaagagguccaggugaucgccguggaacccgggaagaacccuaaaaauuuccagacgaugcccggaauuuuccagaccacaaccggcgagaucggggcgaucgcucuggacuuuaagcccggaaccuccggcagcccuauuaucaacagagaaggcaaagucguggggcucuacggaaauggcguugugacaaagaacgggggauaugucuccggcauugcccaaacgaaugccgagccggaugggcccaccccugagcuggaagaggaaauguucaaaaagcggaaccuuacaaucauggaccugcaucccggcagcggaaagacccgcaaauaccucccugcuauugugagagaggccaucaagcggcgccugagaacacucauccuggcucccacccggguuguggccgcggaaauggaggaggcccuuaaaggccugccuauuagauaucagacgacagcuaccaagucugaacacaccgggcgcgagaucgucgaucugaugugccaugccacauuuaccaugcggcuccugagcccggugagaguucccaauuacaaccuuauuaucauggacgaagcucacuucacagauccugccuccauugccgcucgcggauauaucucuacccgggugggcaugggggaggcggccgcuaucuuuaugacggccacacccccuggaaccgccgaagcuuucccccagagcaaugccccgauucaggacgaggagagagacaucccugaacgcuccuggaacucuggcaaugaguggauuacagauuuugucgggaaaaccgugugguucgugcccagcaucaaggcgggcaacgacauugcuaacugucugcggaagaauggaaaaagagucauccaacucucccgcaagacguuugauaccgaauaccagaaaacacggcugaacgacugggauuucguugugaccacagacauuucugagaugggcgccaauuuuaaggccgauagagugaucgacccccggcgcugccugaaaccugucauccucaccgaugggcccgagagagugauucuugcuggaccuaugccgguuacagccgcgagcgccgcucagcggcgcggcagaguggggcggaacccccagaaggaaaaugaccaauacaucuucaccggacagccucugaacaaugaugaggaccaugcccacuggacggaagcuaagaugcugcucgacaacauuaauacacccgagggcaucauuccugcccuguucgaacccgagagagagaaauccgcugccaucgauggggaauaucgccuuaagggcgagagccggaaaaccuuugucgaacugaugagacgcggagaccucccgguguggcuggcgcacaagguugccucugagggcaucaaauacaccgaucggaaguggugcuucgacggggaaagaaacaaucagauucuggaggagaacauggauguggaaaucuggacaaaagagggagaacgcaagaagcuccggccuagauggcuugacgcucgcaccuauuccgauccccuggcccugaaagaguuuaaggacuucgcugccggcagaaaaagcauugcccucgaucuggucacagaaaucgggcgggugccuucucaucuugcucaccgcacgagaaaugcgcuggacaaccucgucaugcugcauaccuccgagcacggaggccgggccuaccgccacgcuguggaggaacugcccgagacaauggaaacccuccuucugcugggccucaugauucugcuuacagggggagccaugcuguuucucaucagcggcaaggggaucggaaaaaccuccauuggccugaucuguguuauugugucuagcgggaugcuguggauggccgaugugccucuccaguggaucgcuuccgccauuguccuugaguucuuuaugaugguucugcugauccccgagccggaaaagcaaagaacgccucaggacaaucagcucgcguauguggugauuggaauccugacccuugccgcuaucgucgccgcuaacgagaugggccugcucgaaacaaccaagcgggaucugggcaugagcaaagagcccggggugguuucucccacauccuaccuggacguggaccuccauccugccagcgcguggacccuuuaugccgucgcuacgacagugauuaccccgaugcugagacacacaaucgaaaauucuaccgccaacgucagccuggcugccauugcuaaccaagccgugguucucaugggacuggauaagggcuggcccaucuccaaaauggaccuuggggugccucugcucgcgcugggaugcuacucucaggucaauccccugacccucacagccgcugugcuucugcugguuacgcauuacgccauuaucggcccugggcuccaggcuaaggccacccgcgaggcccagaaacggacagcggcuggaaucaugaagaaccccaccguggauggcauuaugacaaucgaccuggauccugucauuuaugacagcaaguucgagaaacaacuuggccaggugaugcugcucgugcugugugccguucagcugcuccuuaugagaaccuccugggcucugugcgaagcccugacgcucgccacagggccgaucaccacccugugggagggaucucccggcaaguuuuggaauacaaccauugcugucagcauggccaacaucuuccgcggguccuaccuugcgggagccggccuggcuuuuagcaucaugaaaucuguggggacaggacggagaggcacgggcucccagggggaaacccucggagagaaguggaaaaagaagcugaaucaacugagccggaaagaauucgaucucuauaagaaauccggcauuacagagguggaccgcaccgaggccaaggaagggcuuaaaagaggagagacaacccaccaugcugucucucggggcagcgccaagcugcagugguuuguugaacgcaacauggugaucccugaggggagagugauugaucugggauguggccggggcgggugguccuacuauugcgcgggacucaaaaaggucacggaagugcgcggcuacaccaaggggggacccggccacgaggagccuguucccaugucuacauauggguggaauaucgugaaacugaugagcggaaaggacgucuucuaccuuccgccugaaaaaugugauacccugcucugcgacauuggcgaguccagccccucucccacaguggaagaguccagaaccauccggguucugaagaugguggagccuuggcugcgcaacaaucaguucuguauuaaaguccucaaccccuacaugccuaaugugaucgaacaccuugagagacugcagcggaaguauggcgggaugcuggugagaaacccgcucagccgcaauucuacacaugaaauguacuggaucuccaacggaaccggcaauauugucagcucuguuaacauggugagccggcugcuucugaacagauuuacgaugacacaccgccggcccaccaucgagaaggauguggaccucggggccggaaccagacaugucaaugcugaaccugagacacccaacauggacgugauuggcgagcgcaucaaacggauuaaggaagagcacuccucuacguggcacuaugaugacgaaaauccuuacaaaaccugggccuaucaugggagcuacgagguuaaggcuacaggauccgccagcuccaugaucaacggcguggucaaacugcugaccaagcccugggaugugguuccgauggugacacaaauggcuaugaccgacacaaccccuuucggccagcagagagucuuuaaggaaaaaguggauacgcgcaccccccggccuaugcccgggacaagaaagguuauggagaucaccgccgaguggcucuggcgcacacugggacggaauaaaaagccuagacuuugcacccgcgaagaguucacgaaaaaggugagaacaaacgcggccaugggcgcugucuuuaccgaagagaaucaaugggacucugcccgggcugccguggaagaugaggaguucuggaagcuggucgacaaagaacgcgagcuccacaagcuggggaaauguggaagcugcguguauaacaugaugggcaagagagaaaaaaagcuuggggaguuuggcaaagccaagggaucccgggcgauuugguacauguggcugggcgcuagauaccucgaguucgaagcccugggguuucugaaugaggaucauugguucucucgggaaaacagcuauuccggaguugagggcgaagggcuccacaagcugggauacauccuucgcgacauuucuaaaauccccggcggggccauguaugcugaugacacagccggcugggacaccagaauuacggaggaugaccugcauaaugaggaaaagaucacccagcagauggauccggagcaccggcagcucgcuaacgccaucuuuaaacugacauaccaaaauaagguggucaaagugcagcgcccuacccccaagggaacagugauggacauuaucagcagaaaggaucagcggggcuccgggcagguuggaaccuauggccuuaacacauucaccaauauggaagcgcaacuggugcgccagauggagggggaaggaguccucagcgaggccgaccuggagaacccccaccugcucgaaaaaaagauuacgcaguggcuggagacaaaaggcguggaaagacuuaagcggauggcuaucucuggggaugacugcguugugaaaccuauugaugaccgcuuugccaacgcucugcucgcccugaaugauaugggcaaggucagaaaggacaucccgcaguggcaacccuccaaaggauggcaugauuggcagcaggugccuuucuguagccaccauuuccacgagcuuaucaugaaggacggccggaaacuggucgugcccugccgcccucaggacgaacucauugggagagcgcggaucucucaaggagccggcuggucccugaaggagaccgcuugucuggggaaagccuacgcucagauguggagccucauguauuuucaccgcagagaucugcggcuugccucuaacgcuauuugcuccgccguucccgugcauuggaucccuaccagcagaacaaccugguccauucacgcgcaucaccaguggaugacaacggaggacaugcugaccgucuggaaucgcguguggaucgaagauaaccccuggauggaggacaagacaccgguuaccacaugggaagaugugccuuaccucggaaagcgggaggaccaaugguguggcagccugauugggcuuaccucuagagccacgugggcucagaauauccugaccgccauccagcagguccgcagccucauuggcgaugaggaauuccuggacuacaugcccuccaugaaacgguuuagaaaggaggaagagucugaaggagccaucugguga

SEQ ID NO: 20484 - RNA, 9873 nt, Artificial Sequence
  derived and/or modified CDS sequence (opt5) from DENV-3__GU131940__SS-prME
acaagccugugccucaugaugaugcugcccgccacgcuugcuuuccaccugacgucccgggacggcgaaccucggaugaucguggggaagaacgaacgcggaaaaucucuccuguuuaagacagccuccggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaagaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcaccgugguccaggcugauauggggugugccauuaauuggaagggaaaggaacuuaaaugcggcuccgggaucuucgugacaaacgagguucacacguggaccgagcaguacaaguuucaagcugacagccccaaacggcucgccacagcgauugccggcgcuugggaaaauggaguguguggcaucagaucuaccacacgcauggagaaccugcuguggaagcagauugccaaugaacucaacuauauccugugggagaauaacaucaaacuuaccgucgugguuggggauauuaucggagugcuggaacagggcaagcggacgcucaccccucagcccauggagcugaaauacuccuggaagacaugggggaaggcuaaaauugucaccgccgagacacaaaauagcucuuucaucauugacggaccuaacacccccgaaugcccguccgccagcagagcuuggaacgugugggagguggaagacuauggcuuuggcgucuucacaaccaauaucuggcugaaacuucgcgagguuuacacgcaguccugugaucaucggcucaugucugcggccaucaaagacgaaagagcugugcacgccgauaugggguacuggauugagagccagaagaacggauccuggaaacuggagaaggccucuuuuaucgaagugaagacaugcaccuggccuaaaagccacacccugugguccaauggcguccucgagagcgacaugauuauccccaagucucuggcugggccuauuucccagcauaaccaccgccccggauaucauacacaaaccgccggcccuuggcaccuugggaaacuggaacucgauuucaauuacugcgagggaacgacagugguuaucaccgagaacuguggcacacggggccccagccugagaaccacaaccgugucugggaagcugauccacgaauggugcugucgcuccugcacgcuuccgccucuccgguauaugggagaggacggcuguugguacgggauggaaauuagacccaucaaugagaaagaagagaacauggucaagagccuggugucugcgggaagcggcaagguugauaauuuuaccaugggggugcugugccucgcuauucuguucgaggaagucaugcggggaaaauucggcaagaaacauaugaucgccggcgugcuuuuuacauucguucugcuccuguccgggcagauuaccuggcgcgacauggcccacacacugaucaugauuggaagcaacgcuucugauagaaugggcaugggggugaccuaucuugcccugaucgcgacguuuaagauccagcccuuccucgcucugggauuuuuccuccggaaacugacauccagagagaaucuucugcucggcgucgggcuggccauggccaccacacugcaacuuccugaagacauugagcagauggcuaacggaaucgcccugggccucaugacccugaagcucauuacccaguuugaaacauaccagcuguggacggcucuugugagccugaccuguuccaauacaaucuucacccucacaguggccuggcgcaccgcgacgcugauucuggccggcgucucucuucugccgcucugccaaagcuccucuaugcggaagacagauuggcugcccaugaccguugcugccaugggggugccuccccucccucuguuuaucuucagccuuaaagacacccccaagagacgcuccuggccucugaacgagggagugauggcugucggccuggugucuauccucgccagcucccugcuuagaaaugauguucccauggccgggccgcugguggcuggaggccuccugauugcguguuaugucaucacagggaccagcgccgaccucacaguggagaaagcugccgacguuacgugggaagaggaagccgagcagaccggagugucucauaaccugaugauuacagucgaugacgauggcaccaugcggaucaaggacgaugaaacagagaacauucuuaccgugcugcugaaaacggcucuccugaucgucuccggcaucuuuccuuacagcauucccgccacccuucugguguggcacacauggcagaagcagacccaacgcucugggguucucugggacgugccuucucccccggagacacagaaagcggaacuggaggaaggagucuacagaaucaagcagcagggcauuuucgggaagacccaagugggaguuggcgugcagaaagagggggucuuucauacaauguggcacgugacgcggggagcugugcucacccacaauggcaagcgccuggagccuaacugggccagcguuaaaaaggaucuuaucagcuauggcgggggauggagacugaaugcccaguggcaaaaaggcgaagagguccaggugauugcuguggaacccgggaagaacccuaagaauuuccagacaaugcccggaaucuuccagaccaccacaggcgagauuggggccaucgcgcuggacuuuaaacccggaacguccggcagcccuaucauuaaccgggaaggcaaggucguggggcucuacggaaauggcguugugaccaaaaacgggggauaugucuccggcaucgcucaaacaaaugccgagccggaugggcccaccccugagcuggaagaggaaauguucaagaaacgcaaccuuacaauuauggaccugcaucccggcagcggaaagaccagaaaguaccucccugccaucgugcgggaggcuauuaaacgcagacugcggacgcucauccuggcccccacaagaguuguggcugccgaaauggaggaggcgcuuaagggccugccuauccgcuaucagaccaccgccacaaaaucugaacacaccgggcgggagauugucgaucugaugugccaugcuacauuuaccaugagacuccugagcccggugcgcguucccaauuacaaccuugugaucauggacgaagcccacuucacggauccugcuuccauugccgcccggggauauaucucuacaagagucggcaugggggaggcugcggccauuuuuaugaccgcuacacccccuggaaccgccgaagccuucccccagagcaaugcuccgauccaggacgaggagcgcgacaucccugaacgguccuggaacucuggcaaugaguggauuacggauuuuguggggaagaccgugugguucguccccagcaucaaagccggcaacgacauugcgaacugucugagaaagaauggaaagaaaguuauccaacucucccgcaagacauuugauaccgaauaccagaaaacacggcugaacgacugggauuucguggugaccacagacauuucugagaugggcgcuaauuuuaaggccgauagagucaucgacccccggcgcugccugaaaccugugauucucaccgaugggcccgagagaguuauccuugccggaccuaugccggugacggcugccagcgcggcccagcggcgcggcagagucgggcggaacccccagaaggaaaaugaccaauacaucuucacaggacagccucugaacaaugaugaggaccaugcucacuggaccgaagccaagaugcugcucgacaacauuaauacccccgagggcaucauuccugcucuguucgaacccgagagagagaaauccgccgcuaucgauggggaauaucgccuuaagggcgagagccggaaaacauuuguggaacugaugagacgcggagaccucccgguuuggcuggccuacaagguggcgucugagggcauuaaauauaccgaucggaaguggugcuucgacggggaaagaaacaaucagauccuggaggagaacauggaugucgaaaucuggacaaaagagggagaacgcaagaagcuccggccuagauggcuugacgcccgcacguacuccgauccccuggcucugaaagaguuuaaggacuucgccgcuggcagaaaaagcauugcccucgaucuggugaccgaaaucgggcgggucccuucucaccuugcccaucgcacaagaaaugcucuggacaaccucgugaugcugcacaccuccgagcauggaggccgggcguaucgccacgccguugaggaacugcccgagacaauggaaacccuccuucugcugggccucaugauucugcuuacaggcggggcuaugcuguuucucaucagcgggaaggggauuggaaaaaccuccaucggccugaucugugugauugugucuagcgggaugcuguggauggccgaugucccucuccaguggaucgccuccgcuauuguucuugaguucuuuaugauggugcugcugauccccgagccggaaaagcaaagaacaccucaggacaaucagcucgccuacguggucauuggaauccugacccuugcggccauuguggcugccaacgagaugggccugcucgaaacaaccaagcgggaucugggcaugagcaaagagcccgggguugugucucccacguccuaucuggacgucgaccuccacccugcuagcgccuggacacuuuacgcgguggccaccacagucaucaccccgaugcugagacauaccaucgaaaauucuacagcuaacgugagccuggccgcuauugccaaccaagcuguugugcucaugggacuggauaagggcuggcccaucuccaaaauggaccuuggggucccucugcucgcccugggaugcuacucucaggugaauccccugacgcucaccgcggccguucuucugcuggugacacacuaugcuauuaucggcccugggcuccaggccaaggcuacccgcgaggcccagaaacggacagccgcgggaauuaugaagaaccccaccgucgauggcaucaugacgaucgaccuggauccugugauuuacgacagcaaguucgagaaacaacuuggccaggugaugcugcucguucugugugcuguccagcugcuccuuaugagaacauccugggcccugugcgaagcucugacccucgccaccgggccgaucacaacccugugggagggaucucccggcaaguuuuggaauacaacgauugccgugagcauggcuaacaucuuccgcggguccuaucuugccggagcgggccuggccuuuagcauuaugaaaucuguggggaccggacggagaggcacaggcucccagggggaaacccucggagagaaguggaaaaagaagcugaaucaacugagccggaaagaguucgaucucuacaagaaauccggcaucacagaggucgaccgcaccgaggcuaaggaagggcuuaaaagaggagagacgacccaucacgccguuucucggggcagcgcuaagcugcagugguuuguggaacgcaacauggugaucccugaggggagagucauugaucugggauguggccggggcgggugguccuauuacugcgccggacucaaaaaggugacagaaguucgcggcuauaccaaagggggacccggccaugaggagccugugcccaugucuacauacggguggaauaucgucaaacugaugagcggaaaggacguguucuaccuuccgccugaaaaaugugauacccugcucugcgacauuggcgaguccagccccucucccacaguugaagaguccagaaccauccgggugcugaagauggucgagccuuggcugcgcaacaaucaguucuguauuaaagugcucaaccccuauaugccuacggugaucgaacaccuugagagacugcagcggaaguacggcgggaugcuggucagaaauccgcucagccgcaacucuacacacgaaauguauuggauuuccaauggaaccggcaacaucguuagcucugugaauauggugagccggcugcuucugaacagauuuaccaugacacaucgccggcccacgaucgagaaggaugucgaccucggggcgggaaccagacacgugaacgccgaaccugagacacccaauauggacguuauuggcgagcgcaucaaacggauuaaggaagaacacuccucuaccuggcacuacgaugacgaaaacccuuauaaaacaugggcuuaccacgggagcuaugaggugaaggccaccggauccgcuagcuccaugaucaauggcgucgugaaacugcugacaaagcccugggauguugugccgauggucacccaaauggccaugacggacaccacaccuuucggccagcagagaguguuuaaggaaaaaguugauacccgcacaccccggccuaugcccgggaccagaaaggugauggagauuacggcugaguggcucuggcgcacacugggacggaacaaaaagccuagacuuugcacccgcgaagaguucaccaagaaggucagaaccaaugccgcgaugggcgccguguuuacggaagagaaccaaugggacucugcucgggccgcugucgaagaugaggaguucuggaagcugguggaccgcgaaagagagcuccauaaacuggggaaguguggaagcugcguuuacaauaugaugggcaaacgggaaaagaaacuuggggaguuuggcaaggccaaaggauccagagccaucugguacauguggcugggcgcgcgguaucucgaguucgaagcucugggguuucugaacgaggaucacugguucucucgcgaaaauagcuacuccggaguggagggcgaagggcuccauaagcugggauauauccuuagagacauuucuaagauccccggcggggccauguacgccgaugacaccgcuggcugggacacacggauuaccgaggaugaccugcacaacgaggagaagaucacacagcagauggauccggagcaucgccagcucgccaaugcuauuuuuaagcugaccuaucaaaacaaagucgugaaggugcagagaccuacacccaaaggaaccguuauggacaucaucagccggaaggaucagcgcggcuccggacaggugggaacguacggccuuaauacauucaccaacauggaagcccaacuggucagacagauggagggggaaggagugcucagcaaggcggaccuggagaauccccaucugcucgagaaaaagauuacccaguggcuggaaacaaaaggcguugagcggcuuaagcgcauggccaucucuggggaugacugcguggucaaaccuauugaugacagauuugcuaacgcccugcucgcucugaacgauaugggcaaggugcggaaggacaucccgcaguggcaacccuccaaaggauggcacgauuggcagcaggucccuuucuguagccaucacuuccaugaacuuauuaugaaggacggccgcaaacuggugguucccugcagaccucaggacgagcucaucgggcgggcccgcaucucucaaggagcgggcuggucccugaaggaaaccgccugucuggggaaggcuuaugcccagauguggagccucauguacuuucacagacgggaucugagacuugcuucuaaugccauuugcuccgcugugcccguccacuggaucccuacaagccgcacgaccugguccauucaugcccaccaucaguggaugacaaccgaggacaugcugacaguguggaaccggguuuggaucgaggauaaucccuggauggaagacaagaccccggugacgaccugggaggaugucccuuaccucggaaagagagaagaccaaugguguggcagccugauugggcuuacaucucgcgcgaccugggcccagaacauccugacagcuauucaacaggugcggagccucaucggcgaugaggaguuccuggacuauaugcccuccaugaaaagauuucgcaaggaagaggaaucugagggagccaucugguga

SEQ ID NO: 20485 - RNA, 9873 nt, Artificial Sequence
  derived and/or modified CDS sequence (opt5) from DENV-3__GU131942__SS-prME
acaagccugugccucaugaugauguuccccgccacccuggcuuuucaccuuacgucccgggacggcgagccucggaugaucguggggaagaacgaacgcggaaaaucucuccuguucaagaccgccagcggcauuaauauguguacacugaucgcgauggaucuuggggagaugugcgacgauaccgucacauacaaauguccgcugauugcugaaguugagcccgaagacaucgauugcugguguaaccucaccuccacaugggugaccuauggaacgugcaaucaggccggcgagcaccggcgggacaagcgcucuguggcccuggcuccucacgucgggaugggacuggauaccagaacacagaccuggaugagcgccgagggcgcuuggagacagguggaaaaaguugagacaugggcccuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaaguccaaacccacgcuggacaucgagcuccagaagaccgaagcuacacaacuggccacccuucgcaaacuguguauugagggaaagaucacaaauauuaccacggauagcagaugcccuacacagggcgaagcgacccucccggaggaacaggaccagaacuauguguguaaacacaccuacguggaucggggcugggggaauggaugcggccuguuugggaagggaucucuugucacaugcgccaaguuccaaugucuggagcccaucgagggcaaagugguucaguaugaaaaccucaaguacaccgugauuaucacaguccacacgggggaccagcaucaggugggaaaugacacccaaggcguuacaguggagaucaccccucaggcuuccacagucgaagccgugcugcccgaguauggcacccuggggcucgaaugcagcccucgcacgggacuggauuuuaacgagaugauucuucugaccaugaaaaauaaggcuuggaugguccacagacagugguucuuugaccucccccugccguggacaucuggcgccaccacagagaccccuacguggaaccggaaagaacuucuggugacauucaagaaugcccaugcuaaaaagcaagagguugugguccucgggucccaggaaggagcgaugcacaccgcccugacaggcgcuaccgagauccagaacagcgggggcaccucuauuuuugccggacaccugaagugucgccucaaaauggauaagcuggaacuuaaaggcauguccuacgccaugugccugaauacauucgugcucaagaaagagguuagcgagacgcagcaugggaccauccugauuaagguggaauacaagggagaggacgcucccuguaaaaucccuuucuccacagaagauggccaagggaaggcccacucuggaagacugaucaccgcgaaccccgucgugaccaagaaggaggagcccgugaacauugaagcugagccuccguuuggcgaaagcaauaucguuauugggaucggcgacaaagcccuuaagauuaacugguauaagaaaggauccagcaucggcaagauguucgaggccaccgcuagaggggcuagacgcauggcuauccucggagauacggccugggacuuuggcucugucgggggagugcugaauagccugggcaaaauggugcaucagauuuucgggagcgcguacacagcccucuuuucuggcgucagcugggugaugaagaucggaauuggcguucugcuuaccuggaucgggcugaacuccaaaaauaccucuaugagcuucuccugcauugugaucggaauuaucacacucuaucugggcgcugucgugcaggccgauaugggguguguuaucaacuggaagggaaaggaacugaaaugcggcagcgggauuuuugugaccaaugagguccacacauggacggagcaguacaaguuccaagcugacucucccaaacggcuugccaccgcgaucgccggcgcuugggaaaacggaguguguggcauuagauccacaacccgcauggagaaucuccuguggaagcagaucgccaacgaacugaauuauauucucugggagaacaauaucaaacugacaguuguggucggggauaucauuggagugcuugaacagggcaagcggacccugacgccucagcccauggagcucaaauacagcuggaagaccugggggaaggcuaaaaucgugacagccgagacccaaaacucuuccuuuauuaucgacggaccuaauacacccgaaugcccgagcgccuccagagcuuggaacgucugggagguugaagacuauggcuucggcguguuuaccacaaacauuuggcugaagcugcgcgagguguacacccagucuugugaucaucggcuuaugagcgcggccaucaaagacgaaagagcuguccacgccgauaugggguacuggaucgagucccagaagaauggaucuuggaaacucgagaaggccagcuucauugaagugaagacgugcacauggccuaaaucccacacccuguggagcaacggcguucuggagucugacaugaucauucccaagucccucgcugggccuaucagccagcauaaucaccgccccggauaucauacccaaacagccggcccuuggcaccuggggaaacuugaacuggauuuuaacuacugcgagggaaccacgguggucauuacagagaauuguggcacccggggccccucucucagaacaaccacaguguccgggaagcugauccacgaauggugcugucgcagcugcacccugccgccucuucgguauaugggagaggacggcuguugguacgggauggaaaucagacccauuaacgagaaagaagagaauaugguuaagucucucgugagcgcgggauccggcaaggucgauaacuucacgaugggggugcugugccuggcuauccucuucgaggaaguuaugcggggaaaauuuggcaagaaacauaugauugccggcgugcuguucaccuuuguccuucugcucagcgggcagaucacauggcgcgacauggcccacacccugauuaugaucggaucuaaugcuuccgauagaaugggcaugggggugacauaucuggcccuuauugcgaccuucaagauccagcccuuucuggcucucggauucuuucugcggaaacucacgagcagagagaaccugcuucugggcguggggcucgccauggccacaacccugcaacugccugaagacaucgagcagauggcuaauggaauugcccuuggccugaugacacucaagcugaucacccaguucgaaaccuaccagcucuggacagcucuggucucccuuacguguucuaacaccguuuuuacacugaccguggccuggcgcacagcgacccucauucuggccggcgugagccugcuuccgcugugccaauccucuagcaugcggaagacggauuggcuccccaugacagucgcugccaugggggugccuccccugccucucuucaucuuuucccugaaagacacccccaagagacgcucuuggccucuuaaugagggaguuauggcugugggccuggucagcauucuggccuccagccuccugagaaacgaugugcccauggccgggccgcuuguugcuggaggccugcucaucgcguguuaugugaucaccgggacaucugccgaccugaccgucgagaaagcugccgacgugacaugggaagaggaagccgagcagacgggagucucccauaaucucaugauuaccguggaugacgauggcacaaugcggaucaaggacgaugaaaccgagaacauucugacaguucuucugaaaaccgcucugcucaucgugagcggcauuuucccuuacucuauccccgccacgcugcuugucuggcacaccuggcagaagcagacacaacgcuccggggugcugugggacguuccuucucccccggagacccagaaagcggaacucgaggaaggaguguacagaaucaagcagcagggcauuuuugggaagacacaagucggagugggcgugcagaaagaggggguuuuccauaccauguggcacgucacacggggagcugugcugacgcacaacggcaagcgccucgagccuaauugggccuccgugaaaaaggaucugaucuccuauggcgggggauggagacuuaacgcccaguggcaaaaaggcgaagagguccaggugauugcuguugaacccgggaagaauccuaagaacuuccagaccaugcccggaaucuuucagacaaccaccggcgagauuggggccaucgcgcuggacuucaaacccggaacaagcggcuccccuauuaucaaucgggaaggcaagguggucgggcuguacggaaacggcgugguuacgaaaaaugggggauaugugagcggcaucgcucaaaccaacgccgagccggaugggcccacaccugagcucgaagaggaaauguuuaagaaacgcaaucugaccauuauggaccuucaucccggcucuggaaagacaagaaaguaccugccugccaucguccgggaggcuauuaaacgcagacuccggacccugauccucgcccccacgagagugguugcugccgaaauggaggaggcgcugaagggccuuccuauucgcuaucagacaaccgccaccaaaagcgaacacacagggcgggagaucguggaucugaugugccaugcuaccuucacaaugagacugcucuccccgguccgcgugcccaacuacaaucuggugaucauggacgaagcccacuuuaccgauccugcuucuauugccgcccggggauauaucagcacgagagucggcaugggggaggcugcggccauuuucaugacagcuacacccccuggaacagccgaagccuuuccccaguccaacgcuccgauccaggacgaggagcgcgacauuccugaacggucuuggaauagcggcaacgaguggaucaccgauuucguugggaagacggugugguuugugcccuccaucaaagccggcaaugacauugcgaacugucuuagaaagaacggaaagaaagucauccaacugucucgcaagaccuucgauacagaauaccagaaaacccggcucaaugacugggauuuugugguuacaaccgacauuagcgagaugggcgcuaacuucaaggccgauagagugaucgacccccggcgcugccugaaaccugucauucugacagaugggcccgagagagugauccucgccggaccuaugccgguuaccgcugccuccgcggcccagcggcgcggcagaguggggcggaauccccagaaggaaaacgaccaauacauuuucacgggacagccucuuaauaacgaugaggaccaugcucacuggacagaagccaagaugcugcuggacaauaucaacacccccgagggcaucauuccugcucucuuugaacccgagagagagaaaagcgccgcuaucgauggggaauaucgccugaagggcgagucucggaaaaccuucgucgaacuuaugagacgcggagaccugccgguguggcucgcccacaaggucgcguccgagggcauuaaauacacagaucggaaguggugcuuugacggggaaagaaauaaccagauccuggaggagaauauggauguggaaauuuggaccaaagagggagaacgcaagaagcugcggccuagauggcucgacgcccgcacauauagcgauccccuugcucugaaagaguucaaggacuuugccgcuggcagaaaaucuaucgcccuggaucucguuacggaaaucgggcgggugccuucccaucuggcccaccgcaccagaaacgcucuugacaaucuggugaugcuccauacaagcgagcacggaggccgggcguaccgccacgccgucgaggaacugcccgagaccauggaaacacugcuccuucugggccugaugauucuccugaccgggggagcuaugcuuuuccugaucuccggcaaggggauuggaaaaacgucuaucggccucauuuguguuaucgugagcuccgggaugcuguggauggccgaugugccucugcaguggaucgccagcgcuauuguccucgaguuuuucaugauggugcuucugauccccgagccggaaaagcaaagaaccccucaggacaaccagcuggccuauguugugauuggaauccucacacuggcggccauugucgcugccaaugagaugggccuucuggaaaccacaaagcgggaucucggcaugucuaaagagcccgggguggucucccccaccagcuaccuggacguggaccugcauccugcuucugccuggacgcucuaugcgguugccacaaccgugaucacaccgaugcuuagacacaccauugaaaacagcaccgcuaaugucucccuggccgcuaucgccaaccaagcugugguucugaugggacucgauaagggcuggcccaucucuaaaauggaccugggggugccucuucuggcccucggaugcuacagccaggucaacccccugacacugacggcggccgugcuccuucuggugacccauuacgcuauuaucggcccugggcugcaggccaaggcuacacgcgaggcccagaaacggaccgccgcgggaauuaugaagaaucccacaguugauggcaucaugaccauugaccucgauccugucaucuaugacuccaaguuugagaaacaacugggccaggugaugcuucuggugcucugugcuguccagcugcugcucaugagaacgucuugggcccuuugcgaagcucugacacuggccaccgggccgaucaccacacucugggagggaagccccggcaaguucuggaacaccacaauugccguuuccauggcuaauaucuuucgcgggagcuaccuggccggagcgggccuugccuucucuauuaugaaauccgugggggcuggacggagaggcacgggcagccagggggaaacccugggagagaaguggaaaaagaagcucaaccaacugucccggaaagaauuugaucuguauaagaaaucuggcaucacagagguggaccgcaccgaggccaaggaagggcucaaaagaggagagacaacccaccaugcugucagccggggcuccgccaaacuucagugguucguggaacgcaauaugguuauuccugaggggagagugaucgaucugggauguggccggggcggguggucuuacuauugcgcgggacugaaaaaggucacggaagugcgcggcuacaccaaagggggacccggccacgaggagccuguucccaugagcacauauggguggaacaucgugaaacucauguccggaaaggacgucuucuaccugccgccugaaaaaugugauacccuucugugcgacauuggcgagagcucucccucccccacaguggaagagagcagaaccauccgggugcucaagauggucgagccuuggcugcgcaauaaccaguuuuguauuaaaguucugaaucccuacaugccuacagugaucgaacaccucgagagacuucagcggaaguauggcgggaugcuggugagaaacccgcugucucgcaauuccacccaugaaauguacuggauuagcaacggaacgggcaauaucgucucuagcgugaacaugguuucccggcuccugcuuaauagauucacaaugacccaccgccggcccaccauugagaaggauguggaccugggggccggaacaagacaugucaacgcugaaccugagacgcccaacauggacgugaucggcgagcgcaucaaacggauuaaggaagaacacucuagcaccuggcacuaugaugacgaaaauccuuacaaaacaugggccuaucauggguccuacgagguuaaggcuaccggaagcgccuccucuaugaucaacggcguggucaaacuccugacaaagcccugggaugugguuccgauggugacccaaauggcuaugacagacaccacgccuuuuggccagcagagagucuucaaggaaaaaguggauacccgcacaccccggccuaugcccgggaccagaaaggucauggagauuacagccgaguggcuguggcgcacccucggacggaauaaaaagccuagacugugcacgcgcgaagaguuuaccaagaaggugagaaccaacgcggccaugggcgcuguuuucacagaagagaaucaaugggacagcgcccgggcugccguggaagaugaggaguuuuggaaacuugucgaccgcgaaagagagcugcacaaacucgggaaguguggauccugcguguauaacaugaugggcaaacgggaaaagaaacugggggaguucggcaaggccaaaggaucuagagcgaucugguacauguggcuuggcgcucgguaccuggaguuugaagcccucggguuccugaaugaggaucauugguuuagccgcgaaaacuccuauucuggaguggagggcgaagggcugcacaagcucggauacauucugagagacaucagcaagauccccggcggggccauguaugcugaugacaccgccggcugggacacgcggauuaccgaggaugaccuucauaaugaggagaagaucacacagcagauggauccggagcaccgccagcuggcuaacgccauuuucaagcucaccuaccaaaauaaaguugugaagguccagagaccuacacccaaaggaaccgugauggacaucauuucccggaaggaucagcgcggcagcgggcagguuggaacauauggccugaacaccuuuacgaauauggaagcgcaacuugugagacagauggagggggaaggaguccugucuaaggccgaccucgagaacccccaucugcuggagaaaaagaucacacaguggcucgaaaccaaaggcguggagcggcugaagcgcauggcuaucuccggggaugacugcgucgugaaaccuauugaugacagauucgccaaugcccuucuggcccucaacgauaugggcaagguucggaaggacaucccgcaguggcaacccagcaaaggauggcaugauuggcaacaggugccuuucuguucucaccauuuucacgaacugauuaugaaggacggccgcaaacuugucgugcccugcagaccucaggacgagcugaucgggcgggcgcgcauuucccaaggagccggcuggagccucaaggaaaccgcuugucuggggaaagccuacgcucagauguggucucugauguauuuccacagacgggaucucagacuggccuccaacgcuaucugcagcgccguucccgugcauuggaucccuacaucccgcaccacauggagcauucacgcgcaucaccaguggaugacgaccgaggacaugcuuacagucuggaaucggguguggaucgaggauaaccccuggauggaagacaagaccccggugacaaccugggaggauguuccuuaccugggaaagagagaagaccaaugguguggcucucucauugggcugacgagccgcgccaccugggcucagaauauccuuacagccauucagcagguccggucccugaucggcgaugaggaguuucucgacuacaugcccucuaugaaaagauuccgcaaggaagaggaaagcgagggagccauuugguga

SEQ ID NO: 20486 - RNA, 9873 nt, Artificial Sequence
  derived and/or modified CDS sequence (opt5) from DENV-3__GU131943__SS-prME
accagccugugccucaugaugaugcugcccgccacccuugcuuuccaccugacgucccgggacggagaaccucggaugaucguggggaagaacgaacgcggaaagucucuccuguuuaagaccgccuccggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuaucuggaaccggaaagaacugcucgugacguuuaagaaugcccaugcuaaaaagcaagagguugugguccuggggucccaggaaggagcgaugcacacagcccugaccggcgcuacagagauucagaacagcgggggcaccucuaucuucgccggacaccucaagugucgccugaaaauggauaaacuugaacugaaaggcauguccuacgccaugugccucaauaccuuugugcugaagaaagagguuagcgagacacagcaugggacgauucugaucaagguggaauacaagggagaggacgcucccuguaaaaucccuuucuccaccgaagauggccaagggaaggcccacaacggaagacuuauuacagcgaaccccgucgugaccaaaaaggaggagcccgugaauaucgaagcugagccuccguucggcgaaucuaacauuguuaucgggauuggcgacaaagcccucaagaucaauugguauaagaaaggaagcuccaucggcaagauguuugaggccacagcuagaggggccagacgcauggcuauucugggagauaccgccugggacuucggcagcgucgggggagugcugaacucucucggcaaaauggugcaucagaucuuuggguccgcguacacggcccuguucagcggcgucucuuggauuaugaagaucggaauuggcgugcuucugacauggaucgggcucaauagcaaaaacaccuccaugucuuuuagcugcauuguuaucggaaucauuacccuguaucugggcgcugugguccaggccgauauggggugugcuaucaauuggaagggaaaggaacuuaaaugcggcuccgggauuuucgugacaaacgagguucacaccuggacagagcaguacaaguuucaagccgacagccccaaacggcucgcgacggccaucgcuggcgccugggaaaauggaguguguggcauuagaucuaccacacgcauggagaaccugcuguggaagcagaucgcuaaugaacucaacuauauccugugggagaauaacauuaaacuuaccgucgugguuggggauaucauuggagugcuggaacagggcaagcggacacucaccccucagcccauggagcugaaauacuccuggaagacgugggggaaggccaaaaucgucaccgccgagacacaaaauagcucuuucauuaucgacggaccuaacacccccgaaugcccguccgcuagcagagcguggaacgugugggagguggaagacuauggcuuuggcgucuucacaaccaauaucuggcugaaacuucgcgagguuuacacacaguccugugaucaucggcucaugucugccgcuauuaaagacgaaagagccgugcacgccgauaugggguacuggaucgagagccagaagaacggauccuggaaacuggagaaggcuucuuuuauugaagugaagaccugcacguggccuaaaagccacacacugugguccaauggcguccucgagagcgacaugaucauucccaagucucuggccgggccuaucucccagcauaaccaccgccccggauaucauacccaaaccgcgggcccuuggcaccuugggaaacuggaacucgauuucaauuacugcgagggaacaaccgugguuaucacggagaacuguggcacacggggccccagccugagaaccacaaccgugucugggaagcugauucacgaauggugcugucgcuccugcacacuuccgccucuccgguauaugggagaggacggcuguugguacgggauggaaaucagacccauuaaugagaaagaagagaacauggucaagagccuggugucugcuggaagcggcaagguugauaauuuuaccaugggggugcugugccucgccauccuguucgaggaagucaugcggggaaaauucggcaagaaacauaugauugccggcgugcuuuuuacguucguucugcuccuguccgggcagaucaccuggcgcgacauggcucacacacugauuaugaucggaagcaacgccucugauagaaugggcaugggggugaccuaucuugcgcugaucgcuacauuuaagauucagcccuuccucgcccugggauuuuuccuccggaaacugaccuccagagagaaucuucugcucggcgucgggcuggccauggcuacgacacugcaacuuccugaagacaucgagcagauggccaacggaauugcucugggccucaugacccugaagcucaucacacaguuugaaaccuaccagcugugggccgcgcuugugagccugaccuguuccaauacaauuuucacgcucaccguggccuggcgcacagcuacccugauccuggccggcgucucucuucugccgcucugccaaagcuccucuaugcggaagacagauuggcugcccaugaccguugcugccaugggggugccuccccucccucuguuuaucuucagccuuaaagacacgcccaagagacgcuccuggccucugaacgagggagugauggccgucggccuggugucuauucucgcuagcucccugcuuagaaaugauguucccauggcggggccgcugguggccggaggccuccugaucgcuuguuaugucauuacagggaccagcgccgaccucaccguggagaaagccgcugacguuacaugggaagaggaagccgagcagaccggagugucucauaaccugaugaucacagucgaugacgauggcacgaugcggauuaaggacgaugaaaccgagaacauccuuacagugcugcugaaaaccgcgcuccugaucgucuccggcauuuuuccuuacagcauccccgcuacacuucugguguggcacaccuggcagaagcagacgcaacgcucugggguucucugggacgugccuucucccccggagacccagaaagccgaacuggaggaaggagucuacagaauuaagcagcagggcaucuucgggaagacacaagugggaguuggcgugcagaaagagggggucuuucauaccauguggcacgugacacggggagccgugcucacccacaauggcaagcgccuggagccuaacugggcuagcguuaaaaaggaucuuauuagcuauggcgggggauggagacugaaugcccaguggcaaaaaggcgaagagguccaggugaucgcgguggaacccgggaagaacccuaagaauuuccagacaaugcccggaauuuuccagacgaccacaggcgagaucggggcuaucgcccuggacuuuaaacccggaaccuccggcagcccuauuaucaaccgggaaggcaaggucguggggcucuacggaaauggcguugugaccaaaaacgggggauaugucuccggcauugcccaaacaaaugcugagccggaugggcccacgccugagcuggaagaggaaauguucaagaaacgcaaccuuaccaucauggaccugcaucccggcagcggaaagacaagaaaguaccucccugccauugugcgggaggcuaucaaacgcagacugcggacccucauccuggcccccacaagaguuguggcggccgaaauggaggaggcucuuaagggccugccuauucgcuaucagaccacggccacaaaaucugaacacaccgggcgggagaucgucgaucugaugugccaugcuaccuuuacaaugagacuccugagcccggugcgcguucccaauuacaaccuugugauuauggacgaagcccacuucaccgauccugccuccaucgcugcgcggggauauauuucuacaagagucggcaugggggaggccgcugccaucuuuaugaccgccacgcccccuggaacagcugaagccuucccccagagcaaugcgccgauccaggacgaggagcgcgacauuccugaacgguccuggaacucuggcaaugaguggaucaccgauuuuguggggaagacagugugguucguccccagcauuaaagcuggcaacgacaucgccaacugucugagaaagaauggaaagaaaguuauucaacucucccgcaagaccuuugauacggaauaccagaaaacccggcugaacgacugggauuucguggugacaaccgacaucucugagaugggcgccaauuuuaaggcugauagagucauugacccccggcgcugccugaaaccugugauccucacagaugggcccgagagaguuauccuugccggaccuaugccggugaccgcggccagcgcugcccagcggcgcggcagagucgggcggaacccccagaaggaaaaugaccaauacauuuucacaggacagccucugaacaaugaugaggaccaugcucacuggaccgaagccaagaugcugcucgacaacaucaauacgcccgagggcauuaucccugcucuguucgaacccgagagagagaaauccgccgcgauugauggggaauaucgccuuaagggcgagagccggaaaacauuuguggaacugaugagacgcggagaccucccgguuuggcuggcccacaagguggcuucugagggcaucaaauacaccgaucggaaguggugcuucgacggggaaagaaacaaucagauccuggaggagaacauggaugucgaaauuuggaccaaagagggagaacgcaagaagcuccggccuagauggcuugacgcccgcacauauuccgauccccuggcucugaaagaguuuaaggacuucgccgccggcagaaaaagcaucgcucucgaucuggugaccgaaauugggcgggucccuucucaucuugcgcaccgcacaagaaaugcccuggacaaccucgugaugcugcauacguccgagcacggaggccgggcuuaccgccacgccguugaggaacugcccgagaccauggaaacacuccuucugcugggccucaugauccugcuuaccgggggagccaugcuguuucucauuagcggcaaggggaucggaaaaacauccaucggccugauuugugugaucgugucuagcgggaugcuguggauggcugaugucccucuccaguggauugccuccgcgaucguucuugaguucuuuaugauggugcugcugauucccgagccggaaaagcaaagaaccccucaggacaaucagcucgccuauguggucaucggcauucugacgcuugcugccaucguggcugccaacgagaugggccugcucgaaaccacaaagcgggaucugggcaugagcaaagagcccgggguugugucucccaccuccuaccuggacgucgaccuccauccugcgagcgccuggacacuuuaugcuguggccaccacggucaucacaccgaugcugagacacaccauugaaaauucuacagcuaacgugagccuggccgcuaucgccaaccaagcgguugugcucaugggacuggauaagggcuggcccauuuccaaaauggaccuuggggucccucugcucgcccugggaugcuacucucaggugaauccccugacccucaccgcugccguucuucugcuggugacacauuacgcuaucauuggcccugggcuccaggccaaggccacgcgcgaggcgcagaaacggaccgcugccggaaucaugaagaaccccacagucgauggcaucaugaccauugaccuggauccugugaucuaugacagcaaguucgagaaacaacuuggccaggugaugcugcucguucugugugcuguccagcugcuccuuaugagaacauccugggcccugugcgaagcccugacccucgcuacggggccgauuacaacccugugggagggaucucccggcaaguuuuggaauaccacaaucgccgugagcauggcgaacauuuuccgcggguccuaccuugccggagcuggccuggccuuuagcaucaugaaaucuguggggaccggacggagaggcacaggcucccagggggaaacgcucggagagaaguggaaaaagaagcugaaucaacugagccggaaagaguucgaucucuauaagaaauccggcaucaccgaggucgaccgcacagaggcuaaggaagggcuuaaaagaggagagaccacacaccaugccguuucucggggcagcgcgaagcugcagugguuuguggaacgcaacauggugauuccugaggggagagucaucgaucugggauguggccggggcgggugguccuacuauugcgccggacucaaaaaggugaccgaaguucgcggcuacacgaaaggcgggcccgggcacgaggagccugugcccaugucuaccuauggguggaauauugucaaacugaugagcggaaaggacguguucuaccuuccgccugaaaaaugugauacacugcucugcgacaucggcgaguccagccccucucccaccguugaagaguccagaacaauucgggugcugaagauggucgagccuuggcugcgcaacaaucaguucuguaucaaagugcucaaccccuacaugccuaccgugauugaacaccuugagagacugcagcggaaguauggcgggaugcuggucagaaauccgcucagccgcaacucuacacaugaaauguacuggaucuccaauggaaccggcaacaucguuagcucugugaauauggugagccggcugcuucugaacagauuuacgaugacacaccgccggcccaccauugagaaggaugucgaccucggggcuggaaccagacaugugaacgccgaaccugagacacccaauauggacguuaucggcgagcgcauuaaacggaucaaggaagaacacuccucuacguggcacuaugaugacgaaaacccuuacaaaaccugggcuuaucaugggagcuacgaggugaaggccacaggauccgcuagcuccaugauuaauggcgucgugaaacugcugaccaagcccugggauguugugccgauggucacacaaauggccaugaccgacacaaccccuuucggccagcagagaguguuuaaggaaaaaguugauacgcgcacaccccggccuaugcccgggacaagaaaggugauggagaucaccgcggaguggcucuggcgcacacugggacggaacaaaaagccuagacuuugcacccgcgaagaguucacgaaaaaggucagaacaaaugccgcuaugggcgccguguuuaccgaagagaaccaaugggacucugcucgggccgccgucgaagaugaggaguucuggaagcugguggaccgcgaaagagagcuccacaaacuggggaaguguggaagcugcguuuauaauaugaugggcaaacgggaaaagaaacuuggggaguuuggcaaggcgaaaggauccagagcuaucugguacauguggcugggcgcccgguaccucgaguucgaagcccugggguuucugaacgaggaucauugguucucucgcgaaaauagcuauuccggaguggagggcgaagggcuccacaagcugggauacauucuuagagacaucucuaagauucccggcggggcuauguaugccgaugacacagcuggcugggacacccggaucacggaggaugaccugcauaacgaggagaagauuacccagcagauggauccggagcaccgccagcucgccaaugcgaucuuuaagcugacauaccaaaacaaagucgugaaggugcagagaccuacccccaaaggaacaguuauggacaucauuagccggaaggaucagcgcggcuccggacaggugggaaccuauggccuuaauacauucaccaacauggaagcccaacuggucagacagauggagggggaaggagugcucagcaaggcugaccuggagaauccccaucugcucgagaaaaagaucacgcaguggcuggaaacaaaaggcguugagcggcuuaagcgcauggccauuucuggggaugacugcguggucaaaccuaucgaugacagauuugcuaacgcccugcucgcgcugaacgauaugggcaaggugcggaaggacauuccgcaguggcaacccuccaaaggauggcaugauuggcagcaggucccuuucuguagccaccauuuccacgaacuuaucaugaaggacggccgcaaacuggugguucccugcagaccucaggacgagcucaucgggcgggcccgcauuucucaaggagcuggcuggucccugaaggaaaccgccugucuggggaaggcuuacgcccagauguggagccucauguauuuucacagacgggaucugagacuugcuucuaaugccaucugcuccgcggugcccguccauuggauuccuaccagccgcacaaccugguccauccacgcccaucaccaguggaugacaacggaggacaugcugaccguguggaaccggguuuggauugaggauaaucccuggauggaagacaagacaccggugaccacaugggaggaugucccuuaccucggaaagagagaagaccaaugguguggcagccugaucgggcuuaccucucgcgcuacgugggcccagaacauucugaccgccauccaacaggugcggagccucaucggcgaugaggaguuccuggacuacaugcccuccaugaaaagauuucgcaaggaagaggaaucugagggagcuauuugguga

SEQ ID NO: 20487 - RNA, 9873 nt, Artificial Sequence
  derived and/or modified CDS sequence (opt5) from DENV-3__GU131945__SS-prME
accagccugugccucaugaugaugcugcccgccacccuugcuuuccaccugacgucccgggacggcgagccucggaugaucguggggaagaacgaacgcggaaaaucucuccuguuuaagaccgccagcggcauuaauauguguacacuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcaucggcgggacaagcgcucuguggcccuggcuccucacguggggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacagcuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgaguccaucgagggcaaagugguucaguaugaaaaccugaaguacaccgugauuaucacaguccacacgggggaccagcaucaggugggaaaugacacccaaggcguuacaguggagaucacaccccaggcuagcacagucgaagccgugcugccugaguauggcacccucgggcuggaaugcucuccccgcacgggacuugauuucaacgagaugauucugcucaccaugaaaaauaaggcuuggaugguccacagacagugguuuuucgaccugccucuucccuggacauccggcgccaccacagagaccccgacguggaaccggaaagaacugcucgugacauuuaagaaugcccaugcuaaaaagcaagagguugugguccuggggagccaggaaggagcgaugcacaccgcccugacaggcgcuaccgagauccagaacucugggggcaccuccauuuucgccggacaccucaagugucgccugaaaauggauaaacuugaacugaaaggcaugagcuacgccaugugccucaauacauuugugcugaagaaagagguuuccgagacgcagcaugggaccauccugauuaagguggaauacaagggagaggacgcuccuuguaaaauccccuucucuacagaagauggccaagggaaggcccacaacggaagacuuaucaccgcgaacccugucgugaccaagaaggaggagcccgugaauauugaagcugagcccccuuucggcgaaagcaacaucguuauugggaucggcgacaaagcccucaagauuaauugguauaagaaaggauccagcaucggcaagauguuugaggccaccgcuagaggggccagacgcauggcuauccugggagauacggccugggacuucggcucugucgggggagugcugaacucccucggcaaaauggugcaucagauuuuugggagcgcguacacagcccuguucucuggcgucagcuggaucaugaagauuggaaucggcgugcuucugaccuggauugggcucaauuccaaaaacaccucuaugagcuuuuccugcaucguuauuggaaucaucacacuguaucugggcgcugugguccaggccgauauggggugugugauuaauuggaagggaaaggaacuuaaaugcggcaacgggaucuucguuaccaaugaggugcacacauggacggagcaguacaaguuucaagcugacagcccgaaacggcucgccaccgcgauugccggcgcuugggaaaacggagucuguggcaucagaucuacaacccgcauggagaaucugcuguggaagcagauugccaacgaacucaauuauauccugugggagaacaauaucaaacuuacagugguugugggggauauuaucggaguccuggaacagggcaagcgggcucucacaccccagccuauggagcugaaauacuccuggaagacgugggggaaggccaaaauugugaccgccgagacacaaaacagcucuuucaucauugacggacccaacaccccugaaugccccuccgcuagcagagcguggaaugugugggaggucgaagacuauggcuuuggcguuuucacaaccaacaucuggcugaaacuucgcgagguguacacacaguccugugaucaucggcucaugucugccgcuaucaaagacgaaagagccgugcacgccgauaugggguacuggauugagagccagaagaauggauccuggaaacuggagaaggcuucuuuuaucgaagucaagaccugcacguggccgaaaagccacacacugugguccaacggcgugcucgagagcgacaugauuaucccuaagucucuggccgggcccauuucccagcauaaucaccgcccuggauaucauacccaaaccgcgggccccuggcaccuugggaaacuggaacucgauuucaacuacugcgagggaacaaccguugugaucgcugagaauuguggcacgcggggcccuagccugagaacaaccacagucucugggaagcugauccacgaauggugcugucgcuccugcacccuucccccgcuccgguauaugggagaggacggcuguugguacgggauggaaauuagaccuaucaacgagaaagaagagaauauggucaagagccugguuucugccggaagcggcaagguggauaacuuuacaauggggguccugugccucgccauucuguucgaggaagugaugcggggaaaauucggcaagaaacauaugaucgcuggcguucuuuuuaccuucgugcugcuccuguccgggcagauuacguggcgcgacauggcccacacccugaucaugauuggaagcaaugcgucugauagaaugggcaugggggucacauaucuugcucugaucgccaccuuuaagauccagcccuuccucgcccugggauuuuuccuccggaaacugacauccagagagaaccuucugcucggcguggggcuggcuauggccaccacgcugcaacuucccgaagacauugagcagauggcuaauggaaucgcccugggccucaugacacugaagcucauuacccaguuugaaacauaccagcuguggaccgcgcuugugagccugaccuguuccaacacaaucuucacgcucaccgucgccuggcgcacagcuacccugauucuggccggcguuucucuucugccucucugccaaagcuccucuaugcggaagacagauuggcugccgaugaccguggcugccaugggggugcccccucucccccuguuuaucuucagccuuaaagacacgccuaagagacgcuccuggccccugaaugagggagucauggccgugggccugguuucuauccucgcuagcucccugcuuagaaacgaugugccuauggcggggccccuggucgccggaggccuccugauugcuuguuaugugaucacagggaccagcgccgaccucaccguugagaaagccgcugacgugacaugggaagaggaagccgagcagaccggagucucucauaaccugaugauuacaguggaugacgauggcacgaugaagaucaaagacgaugaaaccgagaauauucuuacaguccugcugaagaccgcgcuccugaucguguccggcaucuuuccguacagcauuccugcuacacuucugguuuggcacaccuggcagaaacagacgcaacggucuggggugcucugggacguccccuccccucccgagacccagaaggccgaacuggaggaaggaguguaccgcaucaagcagcagggcauuuucgggaaaacacaaguuggagugggcguccagaaggaggggguguuucauaccauguggcacgugacaagaggagccguucucacccacaacggcaaacggcuggagccgaauugggcuagcgucaagaaagaucuuaucucuuauggcgggggauggcgccuguccgcccaguggcaaaagggcgaagagguccaggugauugcggucgaaccugggaagaaccccaaaaauuuccagacaaugccuggaaucuuccagacgaccacaggcgagauuggggcuaucgcccuggacuuuaagcccggaaccagcggcucccccaucauuaacagagaaggcaaagugguugggcucuacggaaauggcguggucaccaagaacgggggauaugugagcggcaucgcccaaacaaaugcugagccugaugggccgacgcccgagcuggaagaggaaauguucaaaaagcggaaccuuaccauuauggaccugcauccuggcucuggaaagacacgcaaauaccuccccgccaucguuagagaggcuauuaagcggcgccugagaacccucauccuggccccuacacggguggucgcggccgaaauggaggaggcucuuaaaggccugcccaucagauaucagaccacggccacaaagagcgaacacaccgggcgcgagauuguggaucugaugugccaugcuaccuuuacaaugcggcuccuguccccuguuagagugccgaauuacaaccuugucaucauggacgaagcccacuucaccgaucccgccucuauugcugcgcgcggauauaucagcacacgggugggcaugggggaggccgcugccauuuuuaugaccgccacgccucccggaacagcugaagccuucccucaguccaaugcgcccauccaggacgaggagagagacaucccggaacgcucuuggaacagcggcaaugaguggauuaccgauuuuguggggaaaacagucugguucguuccuuccaucaaggcuggcaacgacauugccaacugucugcggaagaauggcaaaaaggugauccaacucucuagaaaaaccuuugauacggaauaccagaagacccgccugaacgacugggauuucguggucacaaccgacauuagcgagaugggagccaauuuuaaagcugaucgggugaucgaccccagacggugccugaagcccguuauucucacagaugggccugagcgcgugauccuugccggacccaugccugucaccgcggccuccgcugcccagagacggggccgcguggggagaaacccgcagaaggaaaaugaccaauacaucuucaugggacagccccugaacaaugaugaggaccaugcucacuggacagaagccaaaaugcugcucgacaacauuaauaccccugagggcaucauucccgcucuguucgaaccugagcgggaaaagagcgccgcgaucgauggggaauauagacuuaaaggcgagucucgcaagacguuuguugaacugaugcggagaggagaccuccccguguggcuggcccacaaagucgcuuccgagggcauuaaguacacagaucgcaaauggugcuucgacggggaacggaacaaucagauccuggaggagaacauggauguggaaaucuggaccaaggagggagaaagaaagaaacuccgcccgcgguggcuugacgccagaaccuauagcgauccucuggcucugaaggaguuuaaagacuucgccgccggccgcaagucuauugcucucgaucuggucacagaaaucgggagagugcccucccaucuugcgcaccggacccgcaaugcccuggacaaccucguuaugcugcauacaagcgagcacggaggcagagcuuaccggcacgccguggaggaacugccugagacgauggaaacccuccuucugcugggccucaugauucugcuuacagggggagccaugcuguuucucaucuccggcaaagggauuggaaagaccucuaucggccugaucugugugauugucagcuccgggaugcuguggauggcugauguuccccuccaguggaucgccagcgcgauugugcuugaguucuuuaugauggugcugcugaucccugagcccgaaaagcaacgcacaccgcaggacaaucagcucgccuaugucgugauuggaauccugacccuugcugccauuguugcugccaacgagaugggccugcucgaaacgaccaaaagagaucugggcaugucuaaggagccugggguggucucccccacaagcuaccuggacguggaccuccaucccgcgucugccuggacccuuuaugcugucgccacaaccgugaucacgccuaugcugcggcacacaaucgaaaauagcaccgcuaacguuucccuggccgcuauugccaaccaagcggugguccucaugggacuggauaaaggcuggccgaucucuaagauggaccuuggggugccccugcucgcccugggaugcuacagccagguuaauccucugacacucaccgcugccgugcuucugcuggucacccauuacgcuauuaucggccccgggcuccaggccaaagccacaagagaggcgcagaagcgcacggcugccggaauuaugaagaacccuaccguggauggcaucaugacaaucgaccuggaucccgugauuuaugacuccaaauucgagaagcaacuuggccagguuaugcugcucguccugugugcugugcagcugcuccuuaugcggaccucuugggcccugugcgaagcccugacacucgcuaccgggccuaucacgacacugugggagggaagcccgggcaaauuuuggaauaccaccauugccguguccauggcgaacaucuucagagggagcuaccuugccggagcuggccuggccuuuucuauuaugaaguccgucgggacaggacgccggggcaccggcagccagggggaaacacucggagagaaauggaagaagaaacugaaucaacuguccagaaaggaguucgaucucuauaaaaagucuggcaucacggagguugaccggaccgaggcuaaagaagggcuuaagcgcggagagacaacccaccaugccgugagcagaggcuccgcgaaacugcagugguuuguggaacggaacauggucauccccgaggggcgcgugauugaucugggauguggcagaggcggguggucuuacuauugcgccggacucaagaagguuacagaagugcggggcuacaccaaagggggaccuggccacgaggagcccgucccuaugagcacguauggguggaauaucgugaagcugauguccggaaaagacguuuucuaccuucccccggaaaagugugauacccugcucugcgacauuggcgagagcucuccuucccccacaguggaagagagccgcaccaucagaguccugaaaaugguggagcccuggcugcggucuaaccaguucuguauuaaggugcucaauccuuacaugcccacagucaucgaauaucuugagcgccugcagagaaaguacggcgggaugcugguucggaacccucucuccagaaauagcacccacgaaauguauuggauuucuaacggaacaggcaauaucgugagcuccgugaacauggucucucgccugcuucugaaucgguuuaccaugacgcauagacgcccgacaaucgagaaagauguggaccucggggcuggaacccggcacguuaacgccgaacccgagaccccuaacauggacgugauuggcgagagaaucaagcgcauuaaagaagaacacagcuccacauggcacuacgaugacgaaaaucccuauaagacgugggcuuaccacgggagcuaugaggucaaagccaccggauccgcuucuagcaugaucaacggcgugguuaagcugcugacaaagccuugggaugugguccccauggugacccaaauggccaugacagacaccacaccguucggccagcagcggguuuuuaaagaaaagguggauaccagaacgccucgccccaugccugggacccggaaagucauggagauuacagcggaguggcucuggagaacccugggacgcaauaagaaaccccggcuuugcacaagagaagaguucaccaagaaggugcgcacgaacgccgcuaugggcgccgucuuuacagaagagaaucaaugggacuccgcuagagccgccguggaagaugaggaguucuggaaacugguugacaaggaacgggagcuccauaaacuggggaaguguggaucuugcguguacaacaugaugggcaaacgcgaaaagaaacuuggggaguuuggcaaggcgaagggaagcagagcuaucugguacauguggcugggcgcccgguaucucgaguucgaagcccugggguuucugaaugaggaucacugguucuccagagaaaacucuuacagcggagucgagggcgaagggcuccauaaacugggauauauccuucgggacauuuccaagaucccuggcggggcuauguacgccgaugacaccgcuggcugggacacacgcauuaccgaggaugaccugcacaaugaggagaagaucacgcagcagauggaucccgagcauagacagcucgccaacgcgauuuuuaagcugaccuaucaaaauaaaguggugaagguucagcggccgacaccuaagggaaccgugauggacaucaucagccgcaaagaucagagaggcucugggcaggucggaacauacggccuuaacaccuucacaaauauggaagcccaacuggugcggcagauggagggggaaggaguucucuccaaggcugaccuggagaacccccaucugcucgagaaaaagauuacccaguggcuggaaacgaaaggcguggagcgccuuaagagaauggccaucagcggggaugacugcgucgugaagcccauugaugaccgguuugcuaaugcccugcucgcgcugaacgauaugggcaaaguccgcaaggacaucccucaguggcaaccgucuaaaggauggcacgauuggcaacaggugcccuucuguucccaucacuuccaugaacuuauuaugaaggacggcagaaaacugguugugccuugccggccccaggacgagcucaucgggcgcgccagaaucagccaaggagcuggcuggucucugaaggaaacagccugucuggggaaggcuuaugcccagauguggucccucauguacuuucaccggcgcgaucugagacuugcuagcaacgccauuugcuccgcggucccugugcacuggauccccaccagccggaccacauggucuauucaugcccaccaucaguggaugaccacagaggacaugcugacgguuuggaauagaguguggaucgaggauaacccuuggauggaagacaaaacccccgucacaaccugggaggaugugccguaccucggaaagcgcgaagaccaaugguguggcagccugauugggcuuacaucccgggcuaccugggcccagaauauccugacggccauucaacaggugagaucucucaucggcgaugaggaguuccuggacuauaugccuagcaugaaacgcuuucggaaggaagaggaaaccgagggagcuaucugguga

SEQ ID NO: 20488 - RNA, 9873 nt, Artificial Sequence
  derived and/or modified CDS sequence (opt5) from DENV-3__GU131946__SS-prME
accagccugugccucaugaugaugcugcccgccacccuugcuuuccaccugacgucccgggacggagagccucggaugaucguggggaagaacgaacgcggaaagucucuccuguuuaagaccgccagcggaauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggcauucugaacucucucggcaaaauggugcaucagaucuuuggguccgcguacacagcccuguucagcggcgugucuuggauuaugaagaucggaauuggcguccuucugaccuggaucgggcucaauagcaaaaacaccuccaugucuuuuagcugcauugugaucggaaucauuacacuguaucugggcgcuguugugcaggccgauauggggugugucaucaauuggaagggaaaggaacuuaaaugcggcuccgggauuuucgugaccaacgagguucacacauggacggagcaguacaaguuucaagcugacagccccaaacggcucgccaccgcgaucgccggcgcuugggaaaauggaguguguggcauuagaucuacaacccgcauggagaaccugcuguggaagcagaucgccaaugaacucaacuauauccugugggagaauaacauuaaacuuacagucgugguuggggauaucauuggagugcuggaacagggcaagcggacccucacgccucagcccauggagcugaaauacuccuggaagaccugggggaaggcuagaaucgucacagccgagacccaaaauagcucuuucauuaucgacggaccuaacacacccgaaugcccguccgccagccgcgcuuggaacgugugggagguggaagacuauggcuuuggcgucuucaccacaaauaucuggcugaaacuucgggagguuuacacccaguccugugaucauagacucaugucugcggccauuaaggacgaacgcgcugugcacgccgauaugggguacuggaucgagagccagaaaaacggauccuggaagcuggagaaagccucuuuuauugaagugaagacgugcacauggccuaagagccacacccugugguccaauggcguccucgagagcgacaugaucauucccaaaucucuggcugggccuaucucccagcauaaccaccggcccggauaucauacccaaacagccggcccuuggcaccuugggaagcuggaacucgauuucaauuacugcgagggaaccacggugguuaucacagagaacuguggcaccagaggccccagccugcgcacaaccacagugucugggaaacugauucacgaauggugcugucgguccugcacccuuccgccucucagauauaugggagaggacggcuguugguacgggauggaaauccggcccauuaaugagaaggaagagaacauggucaaaagccuggugucugcgggaagcggcaagguugauaauuuuacgaugggggugcugugccucgcuauccuguucgaggaagucaugcgcggaaaguucggcaaaaagcauaugauugccggcgugcuuuuuaccuucguucugcuccuguccgggcagaucacauggagagacauggcccacacccugauuaugaucggaagcaacgcuucugaucggaugggcaugggggugacauaucuugcccugaucgcgaccuuuaaaauucagcccuuccucgcucugggauuuuuccucagaaagcugacgucccgcgagaaucuucugcucggcgucgggcuggccauggccacaacccugcaacuuccugaagacaucgagcagauggcuaacggaauugcccugggccucaugacacugaaacucaucacccaguuugaaaccuaccagcuguggacagcucuugugagccugacguguuccaauaccauuuucacacucaccguggccuggcggacagcgacccugauccuggccggcgucucucuucugccgcucugccaaagcuccucuaugagaaagacggauuggcugcccaugacaguugcugccaugggggugccuccccucccucuguuuaucuucagccuuaaggacacccccaaacgcagauccuggccucugaacgagggagugauggcugucggccuggugucuauucucgccagcucccugcuucggaaugauguucccauggccgggccgcugguggcuggaggccuccugaucgcguguuaugucauuaccgggacaagcgccgaccucaccguggagaaggcugccgacguuacaugggaagaggaagccgagcagacgggagugucucauaaccugaugaucaccgucgaugacgauggcacaaugcgcauuaaagacgaugaaaccgagaacauccuuacagugcugcugaagaccgcucuccugaucgucuccggcauuuuuccuuacagcauccccgccacgcuucugguguggcacaccuggcagaaacagacacaaagaucugggguucucugggacgugccuucucccccggagacccagaaggcggaacuggaggaaggagucuaccggauuaaacagcagggcaucuucgggaagacacaagugggaguuggcgugcagaaggagggggucuuucauaccauguggcacgugacacgcggagcugugcucacgcacaauggcaaaagacuggagccuaacugggccagcguuaagaaagaucuuauuagcuauggcgggggauggcggcuguccgcccaguggcaaaagggcgaagagguccaggugaucgcuguggaacccgggaaaaauccuaagaacuuccagaccaugcccggaauuuuccagacaaccaccggcgagaucggggccaucgcgcuggacuuuaagcccggaacaagcggcuccccuauuaucaaucgcgaaggcaaagucguggggcucuacggaaacggcguugugacgaagaaugggggauaugucagcggcauugcucaaaccaacgccgagccggaugggcccacaccugagcuggaagaggaaauguucaaaaagagaaaucuuaccaucauggaccugcaucccggcucuggaaaaacacggaaguaccucccugccauugugcgcgaggcuaucaagagacggcugagaacccucauccuggcccccacgcgcguuguggcugccgaaauggaggaggcgcuuaaaggccugccuauucgguaucagacaaccgccaccaagagcgaacacacagggagagagaucgucgaucugaugugccaugcuaccuuuacaaugcgccuccuguccccggugcggguucccaacuacaaucuugugauuauggacgaagcccacuucaccgauccugcuucuaucgccgccagaggauauauuagcacgcgcgucggcaugggggaggcugcggccaucuuuaugacagcuacacccccuggaacagccgaagccuucccccaguccaacgcuccgauccaggacgaggagcgggacauuccugaaagaucuuggaauagcggcaacgaguggaucaccgauuuuguggggaaaacggugugguucguccccuccauuaaggccggcaaugacaucgcgaacugucugcgcaaaaacggaaagaagguuauucaacucucucggaaaaccuuugauacagaauaccagaagaccagacugaaugacugggauuucguggugacaaccgacaucagcgagaugggcgcuaacuuuaaagccgaucgggucauugacccccgcagaugccugaagccugugauccucacagaugggcccgagcggguuauccuugccggaccuaugccggugaccgcugccuccgcggcccagcgcagaggccgggucgggagaaauccccagaaagaaaacgaccaauacauuuucacgggacagccucugaauaacgaugaggaccaugcucacuggacagaagccaagaugcugcucgacaauaucaacacccccgagggcauuaucccugcucuguucgaacccgagcgcgaaaagagcgccgcuauugauggggaauaucggcuuaaaggcgagucuagaaagaccuuucuggaacucaugcgccggggagaccugccgguguggcuggcccacaaaguugcguccgagggcaucaaguacacagauagaaaauggugcuucgacggggaacgcaauaaccagauccucgaggagaauauggauguggaaauuuggaccaaggagggagaacggaagaaacuuagaccucgcuggcuggacgccagaacauauagcgauccccuggcucucaaagaguuuaaagacuucgccgcuggccggaagucuaucgcccuggaucuugucacggaaauugggcgcgugccuucccaucuggcccacagaacccggagcgcucucgacaaccuggucaugcugcauacauccgagcacggaggccgcgcguacagacacgccguggaggaacuccccgagaccauggaaacacuucugcugcucggccugaugauccuucugaccgggggagcuaugcucuuucugauuucuggcaaagggaucggaaagacgagcaucggccugauuuguguuaucguguccagcgggaugcucuggauggccgaugugccucuucaguggauugccucugcuaucguccuggaguucuuuaugaugguucugcucauucccgagccggaaaaacaacggaccccucaggacaaucagcuggccuauguggugaucggcauucuuacacuggcggccaucgucgcugccaacgagaugggccuccuggaaaccacaaagagagaucugggcauguccaaggagcccggggugguuagccccaccucuuaccucgacguggaccuucauccugcuagcgccuggacgcuguaugcggucgccacaaccgugaucacaccgaugcugcgccacaccauugaaaauuccaccgcuaacgucucucucgccgcuaucgccaaucaagcugugguucugaugggacuugauaaaggcuggcccauuagcaagauggaccugggggugccucuccuggcccugggaugcuacucccaggucaacccccucacacuuacggcggccgugcugcugcucguuacccauuacgcuaucauuggcccugggcugcaggccaaagcuacacgggaggcccagaagagaaccgccgcgggaaucaugaaaaaccccacaguggauggcaucaugaccauugaccuugauccugucaucuaugacucuaaguucgagaagcaacugggccaggugaugcuccuggugcugugugcuguucagcuccuucugaugcgcacgagcugggcccugugcgaagcucucacacuggccaccgggccgauuaccacacuuugggagggaucccccggcaaauuuuggaauaccacaaucgccgucagcauggcuaacauuuuccgggggucuuaccuggccggagcgggccucgccuuuuccaucaugaaguccguggggacgggaagacggggcaccggcucccagggggaaacacugggagagaaauggaagaaaaagcugaaucaacucucucgcaaggaguucgaucuuuauaaaaagagcggcaucaccgagguggacagaacagaggcuaaagaagggcugaagcggggagagaccacgcaccaugccgucucccgcggcucugcuaaacugcagugguuuguugaaagaaacauggugauuccugaggggcgggugaucgaucucggauguggccgcggcggguggagcuacuauugcgccggacugaagaaagucaccgaagugagaggcuacacaaaaggcgggcccgggcacgaggagccuguucccauguccaccuauggguggaauauugugaaacuuaugagcggaaaagacgucuucuaccugccgccugaaaagugugauacacuccugugcgacaucggcgagucuucccccagccccaccguggaagagucucggacaauucgcguucugaaaaugguggagccuuggcucagaaacaaucaguucuguaucaagguccuuaaccccuacaugccuaccgugauugaacaccuggagcggcugcagagaaaauauggcgggaugcucgugcgcaauccgcugucccggaacagcacgcaugaaauguacuggaucucuaauggaacaggcaacaucgucagcuccguuaauauggugucuagacuucugcucaaccgcuuuaccaugacccaccggagacccacaauugagaaggauguggaccugggggcgggaacgcgccaugucaaugccgaaccugagacccccaacauggacgugaucggcgagcggauuaagagaaucaaagaagaacacagcuccacauggcacuaugaugacgaaaacccuuacaagaccugggcuuaucaugggagcuacgagguuaaagccacaggauccgcuucuagcaugauuaauggcguggucaagcugcucaccaaacccugggaugugguuccgauggugacacaaauggccaugaccgacacgaccccuuucggccagcagcgcgucuuuaaggaaaagguggauacacggacccccagaccuaugcccgggacacgcaaaguuauggagaucaccgcugaguggcuguggcggacgcuuggaagaaacaagaaaccucgccugugcacaagagaagaguucaccaagaaagugcggacaaaugccgcgaugggcgccgucuuuaccgaagagaaccaaugggacaaugcucgcgccgcuguggaagaugaggaguucuggaagcucgucgacagagaacgggagcugcacaaacuugggaaauguggauccugcaucuauaacaugaugggcaagagagagaagaagcugggggaguuuggcaaagccaagggaucucgggccauuugguacauguggcucggcgcgcgcuaccuggaguucgaagcucugggguuucucaaugaggaucauugguucagcagagaaaacuccuauucuggaguggagggcgaagggcugcacaaacuuggauacauccugcgggacauuagcaagauccccggcggggccauguaugccgaugacacggcuggcugggacacccgcauuacagaggaugaccuccauaaugaggaaaagaucacccagcagauggauccggagcacagacagcuggccaacgcuaucuuuaaacuuacauaccaaaauaagguugugaaaguccagcggccuacccccaagggaacagugauggacauuaucucccgcaaagaucagagaggcagcggacaggugggaaccuauggccugaacacguucacaaauauggaagcccaacucguucggcagauggagggggaaggagugcugucuaaggcggaccuggagaacccccaccuccuggagaagaaaauuacccaguggcuugaaaccaagggcgucgaucgccugaaaagaauggccaucuccggggacgauugcgugguuaagccuauugacgaucgguuugcuaaugcccuccuggcucuuaacgacaugggcaaagugcgcaaggauaucccgcaguggcaacccagcaagggauggcaugacuggcagcaggucccuuucuguucucaccauuuccacgagcugaucaugaaagacggcagaaagcucgugguccccugccggccucaggaugaacugauugggcgcgccagaaucucccaaggagcgggcuggagccugaaagagacagccugucucgggaaggcuuacgcccagauguggucucugauguauuuucaccggagagaccuucgccuggcuuccaacgccauuugcagcgcugugcccguucauuggaucccuaccucccggacaacguggagcauucacgcccaucaccaguggaugaccacagaagauaugcucaccguguggaauagagucuggaucgaggacaaccccuggauggaggauaaaacaccggugaccacgugggaagacguuccuuaccugggaaagcgcgaggaucaaugguguggcucucuuauugggcugaccagccgggcgacaugggcccagaauauccucaccgcuauccaacaggugagaucccugauuggcgacgaagaguuccuggauuacaugcccucuaugaagcgcuuucggaaagaggaagagagcgaaggagccaucugguga

SEQ ID NO: 20489 - RNA, 9873 nt, Artificial Sequence
  derived and/or modified CDS sequence (opt5) from DENV-3__FJ639712__SS-prME
acaagccugugccucaugaugauguuccccgccacccuggcuuuucaccuuacgucccgggacggagaaccucggaugauuguggggaagaacgaacgcggaaaaucucuccuguucaagaccgccagcggcauuaauauguguacacugaucgcgauggaucuuggggaaaugugcgacgauaccgucacauacaaauguccgcugauugcugaaguugagcccgaagacaucgauugcugguguaaccucaccuccacaugggugaccuauggaacgugcaaucaggccggcgagcaccggcgggacaagcgcucuguggcccuggcuccucacgucgggaugggacuggauaccagaacacaaaccuggaugagcgccgagggcgcuuggagacagguggaaaaaguugagacaugggcccuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaaguccaaacccacgcuggacaucgagcuccagaagaccgaagcuacacaacuggccacccuucgcaaacuguguauugagggaaagaucacaaauauuaccacggauagcagaugcccuacacagggcgaagcgacccucccggaggaacaggaccagaacuauguguguaaacacaccuacguggaucggggcugggggaauggaugcggccuguuugggaagggaucucuugucacaugcgccaaguuccaaugucuggagcccaucgagggcaaagugguucaguaugaaaaccucaaguacaccgugauuaucacaguccacacgggggaccagcaucaggugggaaaugacacccaaggcguuacaguggagaucaccccucaggcuuccacagucgaagccgugcugcccgaguauggcacccuggggcucgaaugcagcccucgcacgggacuggauuuuaacgagaugauucuucugaccaugaaaaauaaggcuuggaugguccacagacagugguucuuugaccucccccugccguggacaucuggcgccaccacagagaccccuacguggaaccggaaagaacuucuggugacauucaagaaugcccaugcuaaaaagcaagagguugugguccucgggucccaggaaggagcgaugcacaccgcccugacaggcgcuaccgagauccagaacagcgggggcaccucuauuuuugccggacaccugaagugucgccucaaaauggauaagcuggaacuuaaaggcauguccuacgccaugugccugaauacauucgugcucaagaaagagguuagcgagacgcagcaugggaccauccugauuaagguggaauacaagggagaggacgcucccuguaaaaucccuuucuccacagaagauggccaagggaaggcccacucuggaagacugaucaccgcgaaccccgucgugaccaagaaggaggagcccgugaacauugaagcugagccuccguuuggcgaaagcaauaucguuauugggaucggcgacaaagcccuuaagauuaacugguauaagaaaggauccagcaucggcaagauguucgaggccaccgcuagaggggcuagacgcauggcuauccucggagauacggccugggacuuuggcucugucgggggagugcugaauagccugggcaaaauggugcaucagauuuucgggagcgcguacacagcccucuuuucuggcgucagcugggugaugaagaucggaauuggcguucugcuuaccuggaucgggcugaacuccaaaaauaccucuaugagcuucuccugcauugugaucggaauuaucacacucuaucugggcgcugucgugcaggccgauaugggguguguuaucaacuggaagggaaaggaacugaaaugcggcagcgggauuuuugugaccaaugagguccacacauggacggagcaguacaaguuccaagcugacucucccaaacggcuugccaccgcgaucgccggcgcuugggaaaacggaguguguggcauuagauccacaacccgcauggagaaucuccuguggaagcagaucgccaacgaacugaauuauauucucugggagaacaauaucaaacugacaguuguggucggggauaucauuggagugcuugaacagggcaagcggacccugacgccucagcccauggagcucaaauacagcuggaagaccugggggaaggcuaaaaucgugacagccgagacccaaaacucuuccuuuauuaucgacggaccuaauacacccgaaugcccgagcgccuccagagcuuggaacgucugggagguugaagacuauggcuucggcguguuuaccacaaacauuuggcugaagcugcgcgagguguacacccagucuugugaucaucggcuuaugagcgcggccaucaaagacgaaagagcuguccacgccgauaugggguacuggaucgagucccagaagaauggaucuuggaaacucgagaaggccagcuucauugaagugaagacgugcacauggccuaaaucccacacccuguggagcaacggcguucuggagucugacaugaucauucccaagucccucgcugggccuaucagccagcauaaucaccgccccggauaucauacccaaacagccggcccuuggcaccuggggaaacuugaacuggauuuuaacuacugcgagggaaccacgguggucauuacagagaauuguggcacccggggccccucucucagaacaaccacaguguccgggaagcugauccacgaauggugcugucgcagcugcacccugccgccucuucgguauaugggagaggacggcuguugguacgggauggaaaucagacccauuaacgagaaagaagagaauaugguuaagucucucgugagcgcgggauccggcaaggucgauaacuucacgaugggggugcugugccuggcuauccucuucgaggaaguuaugcggggaaaauuuggcaagaaacauaugauugccggcgugcuguucaccuuuguccuucugcucagcgggcagaucacauggcgcgacauggcccacacccugauuaugaucggaucuaaugcuuccgauagaaugggcaugggggugacauaucuggcccuuauugcgaccuucaagauccagcccuuucuggcucucggauucuuucugcggaaacucacgagcagagagaaccugcuucugggcguggggcucgccauggccacaacccugcaacugccugaagacaucgagcagauggcuaauggaauugcccuuggccugaugacacucaagcugaucacccaguucgaaaccuaccagcucuggacagcucuggucucccuuacguguucuaacaccauuuuuacacugaccguugccuggcgcacagcgacccucauccuggccggcgugagccugcuuccgcugugccaauccucuagcaugcggaagacggauuggcuccccaugacaguggcugccaugggggucccuccccugccucucuucaucuuuucccugaaagacacccccaagagacgcucuuggccucuuaaugagggagugauggcuguuggccuggugagcauccuggccuccagccuccugagaaacgauguccccauggccgggccgcuuguggcuggaggccugcucaucgcguguuauguuauuaccgggacaucugccgaccugaccguggagaaagcugccgacgucacaugggaagaggaagccgagcagacgggagugucccauaaucucaugaucaccgucgaugacgauggcacaaugcggauuaaggacgaugaaaccgagaacauccugacagugcuucugaaaaccgcucugcucauuguuagcggcaucuucccuuacucuauccccgccacgcugcuuguguggcacaccuggcagaagcagacacaacgcuccgggguccugugggacgugccuucucccccggagacccagaaagcggaacucgaggaaggaguuuacagaauuaagcagcagggcaucuuugggaagacacaagugggagucggcgugcagaaagaggggguguuccauaccauguggcacguuacacggggagcuguccugacgcacaacggcaagcgccucgagccuaauugggccuccgugaaaaaggaucugauuuccuauggcgggggauggagacuuaacgcccaguggcaaaaaggcgaagaggugcaggucaucgcuguggaacccgggaagaauccuaagaacuuccagaccaugcccggaauuuuucagacaaccaccggcgagaucggggccauugcgcuggacuucaaacccggaacaagcggcuccccuaucaucaaucgggaaggcaagguuguggggcuguacggaaacggcgucgugacgaaaaaugggggauauguuagcggcauugcucaaaccaacgccgagccggaugggcccacaccugagcucgaagaggaaauguuuaagaaacgcaaucugaccaucauggaccuucaucccggcucuggaaagacaagaaaguaccugccugccauugugcgggaggcuaucaaacgcagacuccggacccugauucucgcccccacgagagucguggcugccgaaauggaggaggcgcugaagggccuuccuauccgcuaucagacaaccgccaccaaaagcgaacacacagggcgggagaucguugaucugaugugccaugcuaccuucacaaugagacugcucuccccggugcgcguccccaacuacaaucuggugauuauggacgaagcccacuuuaccgauccugcuucuaucgccgcccggggauauauuagcacgagagugggcaugggggaggcugcggccaucuucaugacagcuacacccccuggaacagccgaagccuuuccccaguccaacgcuccgauucaggacgaggagcgcgacaucccugaacggucuuggaauagcggcaacgaguggaucaccgauuucgucgggaagacgguuugguuugugcccuccauuaaagccggcaaugacaucgcgaacugucuuagaaagaacggaaagaaagugauucaacugucucgcaagaccuucgauacagaauaccagaaaacccggcucaaugagugggacuuugucgugacaaccgauaucagcgagaugggcgcuaacuucaaggccgacagaguuauugauccccggcgcugccugaaaccugugauccugacagacgggcccgaaagagucauucucgccggaccuaugccggugaccgcugccuccgcggcccagcggcgcggcagaguugggcggaauccccagaaggagaacgaucaauacaucuucacgggacagccucuuaauaacgacgaagaucaugcucacuggacagaggccaagaugcugcuggacaauaucaacacccccgaaggcauuaucccugcucucuuugagcccgagagagaaaagagcgccgcuauugacggggaguaucgccugaagggcgagucucggaaaaccuucguggagcuuaugagacgcggagaucugccggucuggcucgcccacaagguggcguccgaaggcaucaaauacgccgaccggaaguggugcuuugauggggagagaaauaaccagauucuggaggaaaauauggacgucgagaucuggacaaaagaaggagagcgcaagaagcugcggccuagauggcucgaugcucgcaccuauagcgacccccuugcccugaaagaguucaaggauuuugcugccggcagaaaaucuaucgcccuggaccucgugacagagauugggcggguuccuucccaucuggcucaccgcacgagaaacgcgcuugauaaucuggugaugcuccauaccagcgagcacggaggccgggccuaccgccacgcuguggaagaacugcccgaaacaauggagacccugcuccuucugggccugaugauccuccugacagggggagccaugcuuuuccugauuuccggcaaggggaucggaaaaaccucuauuggccucaucugugucaucguuagcuccgggaugcuguggauggccgacgugccucugcaguggauugcuagcgccaucgugcucgaguuuuucaugaugguccuucugauucccgaaccggagaagcaaagaacgccucaggauaaccagcuggcguaugugguuaucggcauucucacccuggccgcuaucguggccgcuaaugaaaugggccuucuggagacaaccaagcgggaccucggcaugucuaaagaacccggggucgugucccccacaagcuaccuggaugucgaccugcauccugccucugcguggacccucuaugccguggcuacgacaguuauuaccccgaugcuuagacacacaaucgagaacagcaccgccaaugugucccuggcugccaucgcuaaccaagccgucgugcugaugggacucgacaagggcuggcccauuucuaaaauggaucuggggguuccucuucuggcgcucggaugcuacagccaggugaacccccugacccugacagccgcuguccuccuucuggugacgcauuacgccaucauuggcccugggcugcaggcuaaggccacccgcgaggcccagaaacggacagcggcuggaaucaugaagaaucccaccguggacggcauuaugacaaucgaucucgacccuguuaucuaugauuccaaguuugaaaaacaacugggccaggucaugcuucuggugcucugugccgugcagcugcugcucaugagaaccucuugggcucuuugcgaggcccugacgcuggccacagggccgauuaccacccucugggaaggaagccccggcaaguucuggaacacaaccaucgcugucuccauggccaauauuuuucgcgggagcuaccuggcgggagccggccuugcuuucucuaucaugaaauccguugggacaggacggagaggcacgggcagccagggggagacccugggagaaaaguggaaaaagaagcucaaccaacugucccggaaagaguuugaccuguauaagaaaucuggcauuacagagguggaucgcaccgaagccaaggaggggcucaaaagaggagaaacaacccaccaugcugugagccggggcuccgccaaacuucagugguucgucgagcgcaauauggugaucccugaagggagaguuaucgaccugggauguggccggggcggguggucuuacuauugcgcgggacugaaaaaggugacggagguccgcggcuacaccaaaggcgggcccgggcacgaggaaccugugcccaugagcacauauggguggaacauuguuaaacucauguccggaaaggauguguucuaccugccgccugagaaaugugacacccuucugugcgauaucggcgaaagcucucccucccccacagucgaggagagcagaaccauucgggugcucaagaugguggaaccuuggcugcgcaauaaccaguuuuguaucaaaguccugaaucccuacaugccuacaguuauugagcaccucgaaagacuucagcggaaguauggcgggaugcuggugagaaacccgcugucucgcaauuccacccaugagauguacuggaucagcaacggaacgggcaauauugugucuagcgucaacauggugucccggcuccugcuuaauagauucacaaugacccaccgccggcccaccaucgaaaaggacguugaucugggggccggaacaagacaugugaacgcugagccugagacgcccaacauggacgucaucggcgaacgcauuaaacggaucaaggaggaacacucuagcaccuggcacuaugacgaugagaauccuuacaaaacaugggccuaucauggguccuacgaagugaaggcuaccggaagcgccuccucuaugauuaacggcguugugaaacuccugacaaagcccugggacgucgugccgaugguuacccaaauggcuaugacagauaccacgccuuuuggccagcagagaguguucaaggagaaagucgacacccgcacaccccggccuaugcccgggaccagaaaggugauggagaucacagccgaauggcuguggcgcacccucggacggaauaaaaagccuagacugugcacgcgcgaggaauuuaccaagaaggucagaaccaacgcggccaugggcgcuguguucacagaggaaaaucaaugggauagcgcccgggcugccguugaggacgaggaauuuuggaaacuuguggaucgcgagagagaacugcacaaacucgggaaguguggauccugcgucuauaacaugaugggcaaacgggagaagaaacugggggaguucggcaaggccaaaggaucuagagcgauuugguacauguggcuuggcgcucgguaccuggaauuugaggcccucggguuccugaaugaagaccauugguuuagccgcgagaacuccuauucuggaguggaaggcgaggggcugcacaagcucggauacauccugagagauaucagcaagauucccggcggggccauguaugcugacgauaccgccggcugggacacgcggaucaccgaggacgaucuucauaaugaagagaaaauuacacagcagauggacccggaacaccgccagcuggcuaacgccaucuucaagcucaccuaccaaaauaaagugguuaaggugcagagaccuacacccaaaggaaccgucauggauauuaucucccggaaggaccagcgcggcagcggacaggugggaacauauggccugaacaccuuuacgaauauggaggcgcaacuuguuagacagauggaaggggagggagugcugucuaaggccgaucucgagaacccccaucugcuggagaaaaagaucacacaguggcucgagaccaaaggcgucgaacggcugaagcgcauggcuauuuccggggacgauugcguggucaaaccuaucgacgauagauucgccaaugcccuucuggcccucaacgacaugggcaaggugcggaaggauauuccgcaguggcaacccagcaaaggauggcaugacuggcagcagguuccuuucuguucucaccauuuucacgagcugaucaugaaggauggccgcaaacuugugguccccugcagaccucaggacgaacugauugggcgggcgcgcaucucccaaggagccggcuggagccucaaggagaccgcuugucuggggaaagccuacgcucagauguggucucugauguauuuccacagacgggaccucagacuggccuccaacgcuaucugcagcgccgugcccguucauuggauuccuacaucccgcaccacauggagcauccacgcgcaucaccaguggaugacgaccgaggauaugcuuacaguguggaaucgggucuggauugaagacaaccccuggauggaggauaagaccccggugacaaccugggaagacgugccuuaccugggaaagagagaggaucaaugguguggcucucucaucgggcugacgagccgcgccaccugggcucagaauauucuuacagccauccagcagguucggucccugauuggcgacgaggaauuucucgauuacaugcccucuaugaaaagauuccgcaaggaggaagagagcgaaggagccaucugguga

SEQ ID NO: 20490 - RNA, 9873 nt, Artificial Sequence
  derived and/or modified CDS sequence (opt5) from DENV-3__FJ639713__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaagcuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugacaaaaaaggaggagcccgugaauauugaagcugagccuccguucggcgaaucuaacaucguuauugggaucggcgacaaagcccucaagauuaauugguauaagaaaggaagcuccaucggcaagauguuugaggccaccgcucggggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcaacgggaucuucguuaccaaugaggugcacacauggacggagcaguacaaguuucaagcugacucccccaaacggcucgccaccgcgauugccggcgcuugggaaaacggagucuguggcaucagaagcacaacccgcauggagaaucugcuguggaagcagauugccaacgaacucaauuauauccugugggagaacaauaucaaacuuacagugguugugggggauauuaucggaguccuggaacagggcaagcggacccucacgccucagcccauggagcugaaauacucuuggaagaccugggggaaggcuaaaauugugacagccgagacccaaaacuccagcuucaucauugacggaccuaacacacccgaaugcccgucugccuccagagcuuggaaugugugggaggucgaagacuauggcuuuggcguuuucaccacaaacaucuggcugaagcuucgcgagguguacacccagagcugugaucaucggcucauguccgcggccaucaaagacgaaagagcugugcacgccgauaugggguacuggauugagucucagaagaauggaagcuggaaacuggagaaggccuccuuuaucgaagucaagacgugcacauggccuaaaucucacacccuguggagcaacggcgugcucgaguccgacaugauuauccccaagagccuggcugggccuauuucucagcauaaucaccgccccggauaucauacccaaacagccggcccuuggcaccuugggaaacuggaacucgauuucaacuacugcgagggaaccacgguugugaucgcggagaauuguggcacacggggccccucccugagaaccacaaccgucagcgggaagcugauccacgaauggugcugucgcucuugcacacuuccgccucuccgguauaugggagaggacggcuguugguacgggauggaaauuagacccaucaacgagaaagaagagaauauggugaagucccugguuagcgcuggaucuggcaagguggauaacuuuaccauggggguccugugccucgccauucuguucgaggaagugaugcggggaaaauucggcaagaaacauaugaucgccggcguucuuuuuacguucgugcugcuccugagcgggcagauuaccuggcgcgacauggcucacacacugaucaugauuggauccaaugccagcgauagaaugggcaugggggucaccuaucuugcgcugaucgcuacauuuaagauccagcccuuccucgcccugggauuuuuccuccggaaacugaccucuagagagaaccuucugcucggcguggggcuggccauggcuacgacacugcaacuuccugaagacauugagcagauggccaauggaaucgcucugggccucaugacccugaagcucauuacacaguuugaaaccuaccagcuguggaccgcccuugugucccugacauguagcaacacgaucuucacccucacagucgcguggcgcaccgccacacugauucuggcuggcguuucccuucugccgcucugccaaucuagcuccaugcggaagaccgauuggcugcccaugacgguggccgcuaugggggugccuccccucccucuguuuaucuucucucuuaaagacacacccaagagacgcagcuggccucugaaugagggagucauggccgugggccugguuuccauccucgccucuagccugcuuagaaacgaugugcccauggcugggccgcuggucgcgggaggccuccugauugccuguuaugugaucaccgggaccuccgcugaccucacaguugagaaagccgccgacgugaccugggaagaggaagcugagcagacaggagucagccauaaccugaugauuacgguggaugacgauggcaccaugcggaucaaggacgaugaaacagagaauauucuuaccguccugcugaaaacagcccuccugaucgugucuggcaucuuuccuuacuccauucccgcgacccuucugguuuggcacacguggcagaagcagacccaacgcagcggggugcucugggacgucccuucucccccggagacacagaaagcugaacuggaggaaggaguguacagaaucaagcagcagggcauuuucgggaagacccaaguuggagugggcguccagaaagaggggguguuucauacaauguggcacgugacccggggagccguucucacacacaacggcaagcgccuggagccuaauugggccuccgucaaaaaggaucuuaucagcuauggcgggggauggagacugucugcucaguggcaaaaaggcgaagaggugcaggugauugccgucgaacccgggaagaacccuaagaauuuccagacgaugcccggaaucuuccagaccacaaccggcgagauuggggcgaucgcucuggacuuuaaacccggaaccuccggcagcccuaucauuaaccgggaaggcaaggugguugggcucuacggaaauggcguggucacaaaaaacgggggauauguguccggcaucgcccaaacgaaugccgagccggaugggcccaccccugagcuggaagaggaaauguucaagaaacgcaaccuuacaauuauggaccugcaucccggcagcggaaagaccagaaaguaccucccugcuaucguucgggaggccauuaaacgcagacugcggacacucauccuggcucccaccagaguggucgccgcggaaauggaggaggcccuuaagggccugccuauccgcuaucagacgacagcuaccaaaucugaacacaccgggcgggagauuguggaucugaugugccaugccacauuuaccaugagacuccugagcccgguucgcgugcccaauuacaaccuugucaucauggacgaagcucacuucacagauccugccuccauugccgcucggggauauaucucuaccagagugggcaugggggaggcggccgcuauuuuuaugacggccacacccccuggaaccgccgaagcuuucccccagagcaaugccccgauccaggacgaggagcgcgacaucccugaacgguccuggaacucuggcaaugaguggauuacagauuuuguggggaagaccgucugguucguucccagcaucaaagcgggcaacgacauugcuaacugucugagaaagaauggaaagaaagugauccaacucucccgcaagacguuugauaccgaauaccagaaaacacggcugaacgacugggauuucguggucaccacagacauuucugagaugggcgccaauuuuaaggccgauagagugaucgacccccggcgcugccugaaaccuguuauucucaccgaugggcccgagagagugauccuugcuggaccuaugccggucacagccgcgagcgccgcucagcggcgcggcagaguggggcggaacccccagaaggaaaaugaccaauacaucuucaccggacagccucugaacaaugaugaggaccaugcccacuggacggaagcuaagaugcugcucgacaacauuaauacacccgagggcaucauuccugcccuguucgaacccgagagagagaaauccgcugccaucgauggggaauaucgccuuaagggcgagagccggaaaaccuuuguugaacugaugagacgcggagaccucccgguguggcuggcgcacaaggucgccucugagggcauuaaauacaccgaucggaaguggugcuucgacggggaaagaaacaaucagauccuggaggagaacauggauguggaaaucuggacaaaagagggagaacgcaagaagcuccggccuagauggcuugacgcucgcaccuauuccgauccccuggcccugaaagaguuuaaggacuucgcugccggcagaaaaagcauugcccucgaucuggucacagaaaucgggcgggugccuucucaucuugcucaccgcacgagaaaugcgcuggacaaccucguuaugcugcauaccuccgagcacggaggccgggccuaccgccacgcuguggaggaacugcccgagacaauggaaacccuccuucugcugggccucaugauucugcuuacagggggagccaugcuguuucucaucagcggcaaggggauuggaaaaaccuccaucggccugaucugugugauugucucuagcgggaugcuguggauggccgauguuccucuccaguggaucgcuuccgccauugugcuugaguucuuuaugauggugcugcugauccccgagccggaaaagcaaagaacgccucaggacaaucagcucgcguaugucgugauuggaauccugacccuugccgcuauuguugccgcuaacgagaugggccugcucgaaacaaccaagcgggaucugggcaugagcaaagagcccgggguggucucucccacauccuaccuggacguggaccuccauccugccagcgcguggacccuuuaugccgucgcuacgacagugaucaccccgaugcugagacacacaaucgaaaauucuaccgccaacguuagccuggcugccauugcuaaccaagccgugguccucaugggacuggauaagggcuggcccaucuccaaaauggaccuuggggugccucugcucgcgcugggaugcuacucucagguuaauccccugacccucacagccgcugugcuucugcuggucacgcauuacgccauuaucggcccugggcuccaggcuaaggccacccgcgaggcccagaaacggacagcggcuggaauuaugaagaaccccaccguggauggcaucaugacaaucgaccuggauccugugauuuaugacagcaaguucgagaaacaacuuggccagguuaugcugcucguccugugugccgugcagcugcuccuuaugagaaccuccugggcucugugcgaagcccugacgcucgccacagggccgaucaccacccugugggagggaucucccggcaaguuuuggaauacaaccauugcugugagcauggccaacaucuuccgcggguccuaccuugcgggagccggccuggcuuuuagcauuaugaaaucugucgggacaggacggagaggcacgggcucccagggggaaacccucggagagaaguggaaaaagaagcugaaucaacugagccggaaagaauucgaucucuauaagaaauccggcaucacagagguugaccgcucugaggccaaggaagggcuuaaaagaggagagaccacacaccaugcugugagccggggcuccgccaagcugcagugguuuguggaacgcaacauggucaucccugaggggagagugauugaucugggauguggccggggcggguggucuuacuauugcgcgggacucaaaaagguuaccgaagugcgcggcuacacgaaggggggacccggccacgaggagccuguccccaugagcaccuauggguggaauaucgugaaacugauguccggaaaggacguuuucuaccuuccgccugaaaaaugugauacacugcucugcgacauuggcgagagcucucccucccccaccguggaagagagcagaacaauccggguccugaagaugguggagccuuggcugcgcaacaaucaguucuguauuaaagugcucaaccccuacaugccuaccgucaucgaacaccuugagagacugcagcggaagcauggcgggaugcugguuagaaauccgcucucucgcaacuccacacacgaaauguauuggauuagcaauggaaccggcaacaucgugucuagcgugaauauggucucccggcugcuucugaacagauuuacgaugacacaucgccggcccaccaucgagaaggauguggaccucggggccggaaccagacacguuaacgcugaaccugagacacccaauauggacgugauuggcgagcgcaucaaacggauuaaggaagagcacucuagcacguggcauuacgaugacgaaaacccuuauaaaaccugggccuaccacggguccuaugaggucaaggcuacaggaagcgccuccucuaugaucaauggcgugguuaaacugcugaccaagcccugggauguggucccgauggugacacaaauggcuaugaccgacacaaccccuuucggccagcagagaguuuuuaaggaaaaaguggauacgcgcaccccccggccuaugcccgggacaagaaaggucauggagauuaccgccgaguggcucuggcgcacacugggacggaacaaaaagccuagacuuugcacccgcgaagaguucacgaaaaaggugagaacaaaugcggccaugggcgcugucuuuaccgaagagaaccaaugggacagcgcccgggcugccguggaagaugaggaguucuggaagcugguugacaaagaacgcgagcuccauaagcuggggaaauguggauccugcguguacaauaugaugggcaagagagaaaaaaagcuuggggaguuuggcaaagccaagggaucucgggcgaucugguauauguggcugggcgcuagauaccucgaguucgaagcccugggguuucugaacgaggaucacugguucagccgggaaaauuccuacucuggagucgagggcgaagggcuccauaagcugggauauauccuucgcgacauuagcaaaauccccggcggggccauguacgcugaugacacagccggcugggacaccagaauuacggaggaugaccugcacaacgaggaaaagaucacccagcagauggauccggagcaccggcagcucgcuaaugccauuuuuaaacugacauaucaaaacaagguggugaaaguucagcgcccuacccccaagggaacagugauggacaucaucuccagaaaggaucagcggggcagcgggcaggucggaaccuacggccuuaauacauucaccaacauggaagcgcaacuggugcgccagauggagggggaaggaguucucucuaaagccgaccuggagaauccccaucugcucgagaagaaaauuauccaguggcuggaaacgaagggcguggagagacuuaaacggauggcuauuuccggggaugacugcgucgugaagccuaucgaugaccgcuuugccaacgcucugcucgcccugaacgauaugggcaaggucagaaaagacauuccgcaguggcaacccagcaagggauggcacgauuggcagcaggugccuuucuguucucaucacuuccacgaacuuaucaugaaagacggccggaagcugguugugcccugccgcccucaggacgagcucaucgggagagcgcggauuucccaaggagccggcuggagccugaaagaaacagcuugucuggggaaggccuaugcucagauguggucucucauguacuuucaucgcagagaucugcggcuugccuccaaugcuaucugcagcgccguccccgugcacuggauuccuaccuccagaaccacauggagcauccaugcgcaccaucaguggaugaccacagaggacaugcugucuguuuggaaccgcguguggauugaggauaaucccuggauggaagacaagacgccggucaccacaugggaggaugugccuuaucucggaaaacgggaagaccaaugguguggcagccugaucgggcuuaccuccagagccacaugggcucagaacauucugaccgccauccagcaggugcgcucucucaucggcgaugaggaguuccuggacuacaugcccagcaugaagcgguuuagaaaagaagaggaauccgagggagccauuugguga

SEQ ID NO: 20491 - RNA, 9873 nt, Artificial Sequence
  derived and/or modified CDS sequence (opt5) from DENV-3__FJ639714__SS-prME
acaucccugugccucaugaugaugcugcccgccacacuugcuuuccaccugacgucccgggacggcgaaccucggaugaucguggggaagaacgaacgcggaaaaucucuccuguuuaagacagccagcggcauuaauauguguacacuuaucgcgauggaucugggggaaaugugcgacgauacagugacauacaaauguccgcucauugcugaaguugagcccgaagacaucgauugcugguguaaccugaccuccacaugggugaccuauggaacgugcaaucaggccggcgagcacagacgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcaacgggaucuucguuaccaaugaggugcacacauggacggagcaguacaaguuucaagcugacucccccaaacggcucgccaccgcgauugccggcgcuugggaaagcggagucuguggcaucagaucuacaacccgcauggagaaccugcuguggaagcagauugccaaugaacucaacuauauccugugggagaauaacaucaaacuuacagugguugugggggauauuaucggaguccuggaacagggcaagcggacccucacgccucagcccauggagcugaaauacuccuggaagaccugggggaaggcuaaaauugugacagccgagacccaaaauagcucuuucaucauugacggaccuaacacacccgaaugcccguccgccagcagagcuuggaacgugugggaggucgaagacuauggcuuuggcguuuucaccacaaauaucuggcugaaacuucgcgagguguacacccaguccugugaucaucggcucaugucugcggccaucaaagacgaaagagcugugcacgccgauaugggguacuggauugagagccagaagaacggauccuggaaacuggagaaggccucuuuuaucgaagucaagacgugcacauggccuaaaagccacacccugugguccaauggcgugcucgagagcgacaugauuauccccaagucucuggcugggccuauuucccagcauaaccaccgccccggauaucauacccaaacagccggcccuuggcaccuugggaaacuggaacucgauuucaauuacugcgagggaaccacgguugugaucgcggagaacuguggcacacggggccccagccugagaaccacaaccgucucugggaagcugauccacgaauggugcugucgcuccugcacacuuccgccucuccgguauaugggagaggacggcuguugguacgggauggaaauuagacccaucaaugagaaagaagagaacaugguuaagagccuggugucugcuggaagcggcaagguggauaauuuuaccauggggguccugugccucgccauucuguucgaggaagugaugcggggaaaauucggcaagaaacauaugaucgccggcguucuuuuuacguucgugcugcuccuguccgggcagauuaccuggcgcgacauggcucacacacugaucaugauuggaagcaacgccucugauagaaugggcaugggggucaccuaucuugcgcugaucgcuacauuuaagauccagcccuuccucgcccugggauuuuuccuccggaaacugaccuccagagagaaucuucugcucggcguggggcuggccauggcuacgacacugcaacuuccugaagacauugagcagauggccaacggaaucgcucugggccucaugacccugaagcucauuacacaguuugaaaccuaccagcuguggaccgcccuugugagccugacauguuccaauacgaucuucacccucacagucgcguggcgcaccgccacacugauucuggcuggcguuucucuucugccgcucugccaaagcuccucuaugcggaagaccgauuggcugcccaugacgguggccgcuaugggggugccuccccucccucuguuuaucuucagccuuaaagacacacccaagagacgcuccuggccucugaacgagggagucauggccgugggccugguuucuauccucgccagcucccugcuuagaaaugaugugcccauggcugggccgcuggucgcgggaggccuccugauugccuguuaugugaucaccgggaccagcgcugaccucacaguugagaaagccgccgacgugaccugggaagaggaagcugagcagacaggagucucucauaaccugaugauuacgguggaugacgauggcaccaugcggaucaaggacgaugaaacagagaacauucuuaccguccugcugaaaacagcccuccugaucguguccggcaucuuuccuuacagcauucccgcgacccuucugguuuggcacacguggcagaagcagacccaacgcucuggggugcucugggacgucccuucucccccggagacacagaaagcugaacuggaggaaggaguguacagaaucaagcagcagggcauuuucgggaagacccaaguuggagugggcguccagaaagaggggguguuucauacaauguggcacgugacccggggagccguucucacacacaauggcaagcgccuggagccuaacugggccagcgucaaaaaggaucuuaucagcuauggcgggggauggagacuguccgcucaguggcaaaaaggcgaagagguccaggugauugccgucgaacccgggaagaauccuaagaacuuccagacgaugcccggaaucuuccagaccacaaccggcgagauuggggcgaucgcucuggacuuuaaacccggaaccagcggcuccccuaucauuaaucgggaaggcaaggugguugggcucuacggaaacggcguggucaccaagaaugggggauaugugagcggcaucgcccaaacgaacgccgagccggaugggcccaccccugagcuggaagaggaaauguucaagaaacgcaaucuuacaauuauggaccugcaucccggcucuggaaagaccagaaaguaccucccugcuaucguucgggaggccauuaaacgcagacugcggacacucauccuggcucccaccagaguggucgccgcggaaauggaggaggcccuuaagggccugccuauccgcuaucagacgacagcuaccaaaagcgaacacaccgggcgggagauuguggaucugaugugccaugccacauuuaccaugagacuccuguccccgguucgcgugcccaacuacaaucuugucaucauggacgaagcucacuucacagauccugccucuauugccgcucggggauauaucagcaccagagugggcaugggggaggcggccgcuauuuuuaugacggccacacccccuggaaccgccgaggcuuucccccaguccaacgccccgauccaggacgaggagcgcgacaucccugaacggucuuggaauagcggcaacgaguggauuacagauuuuguggggaagaccgucugguucguucccuccaucaaagcgggcaaugacauugcuaacugucugagaaagaacggaaagaaagugauccaacucucucgcaagacguuugauaccgaauaccagaaaacacggcugaaugacugggauuucguggucaccacagacauuagcgagaugggcgccaacuuuaaggccgauagagugaucgacccccggcgcugccugaaaccuguuauucucaccgaugggcccgagagagugauccuugcuggaccuaugccggucacagccgcguccgccgcucagcggcgcggcagaguggggcggaauccccagaaggaaaacgaccaauacaucuucaccggacagccucugaauaacgaugaggaccaugcccacuggacggaagcuaagaugcugcucgacaauauuaacacacccgagggcaucauuccugcccuguucgaacccgagagagagaaaagcgcugccaucgauggggaauaucgccuuaagggcgagucucggaaaaccuuuguugaacugaugagacgcggagaccucccgguguggcuggcgcacaaggucgccuccgagggcauuaaauacaccgaucggaaguggugcuucgacggggaaagaaauaaccagauccuggaggagaauauggauguggaaaucuggacaaaagagggagaacgcaagaagcuccggccuagauggcuugacgcucgcaccuauagcgauccccuggcccugaaagaguuuaaggacuucgcugccggcagaaaaucuauugcccucgaucuggucacagaaaucgggcgggugccuucccaucuugcucaccgcacgagaaacgcgcuggacaaucucguuaugcugcauaccagcgagcacggaggccgggccuaccgccacgcuguggaggaacugcccgagacaauggaaacccuccuucugcugggccucaugauucugcuuacagggggagccaugcuguuucucaucuccggcaaggggauuggaaaaaccucuaucggccugaucugugugauugucagcuccgggaugcuguggauggccgauguuccucuccaguggaucgcuagcgccauugugcuugaguucuuuaugauggugcugcugauccccgagccggaaaagcaaagaacgccucaggacaaccagcucgcguaugucgugauuggaauccugacccuugccgcuauuguugccgcuaaugagaugggccugcucgaaacaaccaagcgggaucugggcaugucuaaagagcccgggguggucucccccacaagcuaccuggacguggaccuccauccugccucugcguggacccuuuaugccgucgcuacgacaaucaucaccccgaugcugagacacacaauugaaaacagcaccgccaaugugucccuggcugccaucgcuaaccaagccguugugcucaugggacuggauaagggcuggcccauuucuaaaauggaccuuggggucccucugcucgcgcugggaugcuacagccaggugaacccccugacccucacagccgcuguucuucugcuggugacgcauuacgccaucauuggcccugggcuccaggcuaaggccacccgcgaggcccagaaacggacagcggcuggaaucaugaagaaucccaccgucgauggcaucaugacaauugaccuggauccugugaucuaugacuccaaguucgagaaacaacuuggccaggugaugcugcucguucugugugccguccagcugcuccuuaugagaaccucuugggcucugugcgaagcccugacgcucgccacagggccgauuaccacccugugggagggaagccccggcaaguuuuggaacacaaccaucgcuguguccauggccaauauuuuccgcgggagcuaccuugcgggagccggccuggcuuuuucuaucaugaaauccguggggacaggacggagaggcacgggcagccagggggaaacccucggagagaaguggaaaaagaagcugaaccaacugucccggaaagaguucgaucucuauaagaaaucuggcaucacagaggucgaccgcaccgaggccaaggaagggcuuaaaagaggagagacaacccaccaugcuguuagccggggcuccgccaagcugcagugguuuguggaacgcaauauggugauuccugaggggagagucaucgaucugggauguggccggggcggguggucuuacuauugcgcgggacucaaaaaggugacggaaguucgcggcuacaccaaagggggacccggccacgaggagccugugcccaugagcacauauggguggaacauugucaaacugauguccggaaaggacguguucuaccuuccgccugaaaaaugugauacccugcucugcgacaucggcgagagcucucccucccccacaguugaagagagcagaaccauucgggugcugaagauggucgagccuuggcugcgcaauaaccaguucuguaucaaagugcucaaucccuacaugccuacagugauugaacaccuugagagacugcagcggaaguauggcgggaugcuggucagaaacccgcucucucgcaauuccacccaugaaauguacuggaucagcaacggaacgggcaauaucguuucuagcgugaacauggugucccggcugcuucugaauagauuuacaaugacccaccgccggcccaccauugagaaggaugucgaccucggggccggaacaagacaugugaacgcugaaccugagacgcccaacauggacguuaucggcgagcgcauuaaacggaucaaggaagaacacucuagcaccuggcacuaugaugacgaaaauccuuacaaaacaugggccuaucauggguccuacgaggugaaggcuaccggaagcgccuccucuaugauuaacggcgucgugaaacugcugacaaagcccugggauguugugccgauggucacccaaauggcuaugacagacaccacgccuuucggccagcagagaguguuuaaggaaaaaguugauacccgcacaccccggccuaugcccgggaccagaaaggugauggagaucacagccgaguggcucuggcgcacccugggacggaauaaaaagccuagacuuugcacgcgcgaagaguucaccaagaaggucagaaccaacgcggccaugggcgcuguguuuacagaagagaaucaaugggacagcgcccgggcugccgucgaagaugaggaguucuggaagcugguggacaaagaacgcgagcuccacaagcuggggaaauguggauccugcguuuauaacaugaugggcaagagagagaagaaacuuggggaguuuggcaaagccaagggaucucgggcgaucugguacauguggcugggcgcuagauaccucgaguucgaagcccugggguuucugaaugaggaucauugguucagccgggaaaacuccuauucuggaguggagggcgaagggcuccacaagcugggauacauucuucgcgacaucagcaaaauucccggcggggccauguaugcugaugacaccgccggcugggacacgagaaucaccgaggaugaccugcauaaugaggaaaagauuacacagcagauggauccgggacaccggcagcucgcuaacgccaucuuuaaacugaccuaccaaaauaaggucgugaaagugcagcgcccuacacccaagggcaccguuauggacaucauuuccagaaaggaucagcgggggagcggacaggugggcacauaugggcuuaacaccuucacgaauauggaggcgcaacugguccgccagauggaaggagagggcgugcucucuaaagccgaccuggaaaacccccaucugcucgagaagaaaaucacacaguggcuggagaccaaggggguugaaagacuuaaacggauggcuauuuccggcgaugacugcguggucaagccuaucgaugaccgcuuugccaaugcucugcucgcccugaacgauaugggaaaggugagaaaagacauuccgcaguggcaacccagcaagggcuggcaugauuggcagcaggucccuuucuguucucaccauuuccacgagcuuaucaugaaagacgggcggaagcuggugguucccugccgcccucaggacgaacucaucggacgggcgcggauuucccaaggcgccggguggagccugaaagagaccgcuugucugggaaaggccuacgcucagauguggucucucauguauuuucaccgcagagaucugcggcuugccuccaacgcuaucugcagcgccgugcccguccauuggauuccuacauccagaaccacauggagcauccacgcgcaucaccaguggaugacgaccgaagacaugcugacaguguggaaucgcguuuggauugaggauaaccccuggauggaggacaagaccccggugacaaccugggaagaugucccuuaccucggcaaacgggaggaccaauggugugggucucugaucggccuuacgagcagagccaccugggcucagaauauucugacagccauccaacaggugcgcucccucaucggagaugaagaguuccuggacuacaugcccucuaugaagcgguuuagaaaagaggaagagaccgaaggcgccauuugguga

SEQ ID NO: 20492 - RNA, 9873 nt, Artificial Sequence
  derived and/or modified CDS sequence (opt5) from DENV-3__FJ639715__SS-prME
accagccugugccucaugaugaugcugcccgccacacuugcuuuccaccugacgucccgggacggcgaaccucggaugaucguggggaagaacgaacgcggaaagucucuccuguuuaagaccgccagcggcauuaauauguguacacuuaucgcgauggaucugggggaaaugugcgacgauaccgucacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccaauauuuucgccggacaccucaagugucgccugaaaauggauaaacuugaacugaaaggcaugucuuacgccaugugccucaacacauuugugcugaagaaagagguuuccgagacgcagcaugggaccauccugauuaagguggaauacaagggagaggacgcucccuguaaaaucccuuucagcacagaagauggccaagggaaggcccacaacggaagacuuaucaccgcgaaucccgucgugaccaagaaggaggagcccauuaacaucgaagcugagccuccguucggcgaauccaauauugugaucgggauuggcgacaaagcccucaagaucaacugguauaagaaaggaucuagcaucggcaagauguuugaggccaccgcuagaggggccagacgcauggcuauucugggagauacggccugggacuucggcuccguugggggaguccugaauagccucggcaaaauggugcaucagaucuuugggucugcguacacagcccuguucuccggcgugagcuggauuaugaagaucggaauuggcguccuucugaccuggaucgggcucaacucuaaaaauaccagcauguccuuuucuugcauugugaucggaaucauuacacuguaucugggcgcuguugugcaggccgauauggggugugucaucaacuggaagggaaaggaacuuaaaugcggcaaugggauuuucgugaccaacgagguucacacauggacggagcaguacaaguuucaagcugacagccccaaacggcucgccaccgcgaucgccggcgcuugggaaaauggaguguguggcauuagauccacaacccgcauggagaaccugcuguggaagcagaucgccaaugaacucaacuauauccugugggagaauaacauuaaacuuacagucgugguuggggauaucauuggagugcuggaacagggcaagcggacccucacgccucagcccauggagcugaaauacagcuggaagaccugggggaaggcuaaaaucgucacagccgagacccaaaacucuuccuucauuaucgacggaccuaauacacccgaaugcccgagcgccucuagagcuuggaacgugugggagguggaagacuauggcuuuggcgucuucaccacaaauaucuggcugaaacuucgcgagguuuacacccaguccugugaucaucggcucaugagcgcggccauuaaagacgaaagagcugugcacgccgauaugggguacuggaucgagucccagaagaacggaucuuggaaacuggagaaggccagcuuuauugaagugaagacgugcacauggccuaaaucccacacccuguggucuaauggcguccucgagagcgacaugaucauucccaagucccuggcugggccuaucagccagcauaaccaccgccccggauaucauacccaaacagccggcccuuggcaccuugggaaacuggaacucgauuucaauuacugcgagggaaccacggugguuaucgcggagaacuguggcacacggggccccucucugagaaccacaaccguguccgggaagcugauucacgaauggugcugucgcagcugcacacuuccgccucuccgguauaugggagaggacggcuguugguacgggauggaaaucagacccauuaaugagaaagaagagaacauggucaagucucugguguccgcuggaagcggcaagguugauaauuuuaccaugggggugcugugccucgccauccuguucgaggaagucaugcggggaaaauucggcaagaaacauaugauugccggcgugcuuuuuacguucguucugcuccugucugggcagaucaccuggcgcgacauggcucacacacugauuaugaucggaagcaacgccuccgauagaaugggcaugggggugaccuaucuugcgcugaucgcuacauuuaagauucagcccuuccucgcccugggauuuuuccuccggaaacugaccagcagagagaaucuucugcucggcgucgggcuggccauggcuacgacacugcaacuuccugaagacaucgagcagauggccaacggaauugcucugggccucaugacccugaagcucaucacacaguuugaaaccuaccagcuguggaccgcccuugugucucugacauguuccaauacgauuuucacccucacaguggcguggcgcaccgccacacugauccuggcuggcgucagccuucugccgcucugccaauccucuagcaugcggaagaccgauuggcugcccaugacgguugccgcuaugggggugccuccccucccucuguuuaucuucucccuuaaagacacacccaagagaaaaucuuggccucugaacgagggagugauggccgucggccuggugagcauucucgccuccucucugcuucgcaacgauguucccauggcugggccgcugguggcgggaggccuccugaucgccuguuaugucauuaccgggaccagcgcugaccucacaguggagaaggccgccgacguuaccugggaagaggaagcugagcagacaggagugucccauaaucugaugaucacggucgaugacgauggcaccaugagaauuaaagacgaugaaacagagaacauccuuaccgugcugcugaagacagcccuccugaucgucagcggcauuuuuccuuacucuauccccgcgacccuucugguguggcacacguggcagaaacagacccaacgguccgggguucucugggacgugccuucucccccggagacacagaaggcugaacuggaggaaggagucuaccgcauuaagcagcagggcaucuucgggaaaacccaagugggaguuggcgugcagaaggagggggucuuucauacaauguggcacgugaccagaggagccgugcucacacacaauggcaaacggcuggagccuaacugggccuccguuaagaaagaucuuauuuccuauggcgggggauggcgccugagcgcucaguggcaaaagggcgaagagguccaggugaucgccguggaacccgggaagaauccuaaaaacuuccagacgaugcccggaauuuuccagaccacaaccggcgagaucggggcgaucgcucuggacuuuaagcccggaaccucuggcuccccuauuaucaauagagaaggcaaagucguggggcucuacggaaacggcguugugacaaagaaugggggauaugucagcggcauugcccaaacgaacgccgagccggaugggcccaccccugagcuggaagaggaaauguucaaaaagcggaaucuuacaaucauggaccugcaucccggcuccggaaagacccgcaaauaccucccugcuauugugagagaggccaucaagcggcgccugagaacacucauccuggcucccacccggguuguggccgcggaaauggaggaggcccuuaaaggccugccuauuagauaucagacgacagcuaccaagagcgaacacaccgggcgcgagaucgucgaucugaugugccaugccacauuuaccaugcggcuccugucuccggugagaguucccaacuacaaucuuauuaucauggacgaagcucacuucacagauccugccagcauugccgcucgcggauauaucuccacccgggugggcaugggggaggcggccgcuaucuuuaugacggccacacccccuggaaccgccgaggcuuucccccagucuaacgccccgauucaggacgaggagagagacaucccugaacgcagcuggaauagcggcaacgaguggauuacagauuuugucgggaaaaccgugugguucgugcccucuaucaaggcgggcaacgacauugcuaauugucugcggaagaacggcaaaaaggucauccaacucagcagaaaaacguuugauaccgaauaccagaagacacgccugaaugacugggauuucguugugaccacagacauuuccgagaugggagccaacuuuaaagccgaucgggugaucgaccccagacggugccugaagccugucauccucaccgaugggcccgagcgcgugauucuugcuggaccuaugccgguuacagccgcgucugccgcucagagacggggccgcguggggagaaauccccagaaggaaaacgaccaauacaucuucaccggacagccucugaauaacgaugaggaccaugcccacuggacggaagcuaaaaugcugcucgacaauauuaacacacccgagggcaucauuccugcccuguucgaacccgagcgggaaaagagcgcugccaucgauggggaauauagacuuaaaggcgagucccgcaagaccuuugucgaacugaugcggagaggagaccucccgguguggcuggcgcacaaaguugccagcgagggcaucaaguacaccgaucgcaaauggugcuucgacggggaacggaauaaccagauucuggaggagaauauggauguggaaaucuggacaaaggagggagaaagaaagaaacuccgcccucgguggcuugacgcuagaaccuauucugauccccuggcccugaaggaguuuaaagacuucgcugccggccgcaaguccauugcccucgaucuggucacagaaaucgggagagugccuagccaucuugcucaccggacgcgcaacgcgcuggacaaucucgucaugcugcauaccucugagcacggaggcagagccuaccggcacgcuguggaggaacugcccgagacaauggaaacccuccuucugcugggccucaugauucugcuuacagggggagccaugcuguuucucaucuccggcaaagggaucggaaagaccagcauuggccugaucuguguuauuguguccucugggaugcuguggauggccgaugugccucuccaguggaucgcuagcgccauuguccuugaguucuuuaugaugguucugcugauccccgagccggaaaagcaacgcacgccucaggacaaccagcucgcguauguggugauuggaauccugacccuugccgcuaucgucgccgcuaaugagaugggccugcucgaaacaaccaaaagagaucugggcauguccaaggagcccggggugguuagccccacaucuuaccuggacguggaccuccauccugccuccgcguggacccuuuaugccgucgcuacgacagugauuaccccgaugcugcggcacacaaucgaaaacagcaccgccaacgucucucuggcugccauugcuaaucaagccgugguucucaugggacuggauaaaggcuggcccaucagcaagauggaccuuggggugccucugcucgcgcugggaugcuacucccaggucaacccccugacccucacagccgcugugcuucugcugguuacgcauuacgccauuaucggcccugggcuccaggcuaaagccaccagagaggcccagaagcgcacagcggcuggaaucaugaagaaucccaccguggauggcauuaugacaaucgaccuggauccugucauuuaugacucuaaauucgagaagcaacuuggccaggugaugcugcucgugcugugugccguucagcugcuccuuaugcggaccagcugggcucugugcgaagcccugacgcucgccacagggccgaucaccacccugugggagggaucccccggcaaauuuuggaacacaaccauugcugucucuauggccaauaucuucagagggagcuaccuugcgggagccggccuggcuuuuuccaucaugaaaagcguggggacaggacgccggggcacgggcucucagggggaaacccucggagagaaauggaagaagaaacugaaccaacuguccagaaaggaguucgaucucuauaaaaagagcggcauuacagagguggaccggaccgaggccaaagaagggcuuaagcgcggagagacaacccaccaugcugucuccagaggcucugccaaacugcagugguuuguugaacggaauauggugaucccugaggggcgcgugauugaucugggauguggcagaggcggguggagcuacuauugcgcgggacucaagaaggucacggaagugcggggcuacaccaaagggggacccggccacgaggagccuguucccauguccacauauggguggaacaucgugaagcugaugucuggaaaagacgucuucuaccuuccgccugaaaagugugauacccugcucugcgacauuggcgagagcucccccagccccacaguggaagagucucgcaccaucagaguucugaaaaugguggagccuuggcugcggaauaaccaguucuguauuaagguccucaaucccuacaugccuaacgugaucgaacaccuugagcgccugcagagaaaguauggcgggaugcuggugcggaauccgcucuccagaaacagcacacaugaaauguacuggaucucuaauggaaccggcaacauugucuccagcguuaacauggugucucgccugcuucugaaucgguuuacgaugacacacagacgccccaccaucgagaaagauguggaccucggggccggaacccggcaugucaacgcugaaccugagacacccaauauggacgugauuggcgagagaaucaagcgcauuaaagaagaacacagcuccacguggcacuaugaugacgaaaacccuuacaagaccugggccuaucaugggucuuacgagguuaaagcuacaggaagcgccuccagcaugaucaauggcguggucaagcugcugaccaagcccugggaugugguuccgauggugacacaaauggcuaugaccgacacaaccccuuucggccagcagcgggucuuuaaagaaaagguggauacgagaacaccccgcccuaugcccgggacacggaaaguuauggagaucaccgccgaguggcucuggagaacacugggacgcaacaagaaaccucggcuuugcaccagagaagaguucacgaagaaggugcgcacaaaugcggccaugggcgcugucuuuaccgaagagaaccaaugggacuccgccagagcugccguggaagaugaggaguucuggaaacuggucgacaaggaacgggagcuccacaaacuggggaaguguggaucuugcguguauaauaugaugggcaaacgcgaaaagaaacuuggggaguuuggcaaggccaagggaagcagagcgauuugguacauguggcugggcgcucgguaccucgaguucgaagcccugggguuucugaacgaggaucauugguucuccagagaaaauucuuauagcggaguugagggcgaagggcuccacaaacugggauacauccuucgggacauuuccaagauccccggcggggccauguaugcugaugacacagccggcugggacacccgcauuacggaggaugaccugcauaacgaggagaagaucacccagcagauggauccggagcacagacagcucgcuaaugccaucuuuaagcugacauaccaaaacaaaguggucaaggugcagcggccuacccccaagggaacagugauggacauuaucucucgcaaagaucagagaggcagcgggcagguuggaaccuauggccuuaauacauucaccaacauggaagcgcaacuggugcggcagauggagggggaaggaguccucuccgaggccgaccuggagaacccccaucugcucgaaaagaaaauuacgcaguggcuggagacaaagggcguggaacgccuuaaaagaauggcuaucagcggggaugacugcguugugaagccuauugaugaccgguuugccaaugcucugcucgcccugaacgauaugggcaagguccgcaaagacaucccgcaguggcaacccucuaagggauggcaugauuggcaacaggugccuuucuguucccaccauuuccacgagcuuaucaugaaagacggcagaaagcuggucgugcccugccggccucaggacgaacucauugggcgcgcgagaaucagccaaggagccggcuggucucugaaagagaccgcuugucuggggaaggccuacgcucagauguggucccucauguauuuucaccggcgcgaucugagacuugccagcaaugcuauuugcucugccguucccgugcauuggaucccuaccucccggacaaccuggagcauucacgcgcaucaccaguggaugacaacggaggacaugcugaccgucuggaacagaguguggaucgaagauaaucccuggauggaggacaagacaccgguuaccacaugggaagaugugccuuaccucggaaaacgcgaggaccaaugguguggcucccugauugggcuuaccagccgggccacgugggcucagaacauccugaccgccauccagcaggucagaucucucauuggcgaugaggaguuccuggacuacaugcccagcaugaagcgcuuucggaaagaggaagaguccgaaggagccaucugguga

SEQ ID NO: 20493 - RNA, 9873 nt, Artificial Sequence
  derived and/or modified CDS sequence (opt5) from DENV-3__KF955461__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgacccugccggaggaacaggaccagaauuauguguguaaacacaccuacguggaucggggcugggggaacggaugcggccuuuucgggaagggaagccuggucacaugcgccaaguuucaaugucucgagcccaucgagggcaaagugguucaguaugaaaaucugaaguacaccgugauuaucacaguccacacgggggaccagcaucaggugggaaacgacacccaaggcguuacaguggagaucaccccucaggcuucuacagucgaagccgugcugcccgaguauggcacccucgggcuggaaugcuccccucgcacgggacuugauuucaaugagaugauucugcucaccaugaaaaacaaggcuuggaugguccacagacagugguuuuucgaccugccccuuccguggacaagcggcgccaccacagagaccccuacguggaaucggaaagaacugcucgugacauuuaagaacgcccaugcuaaaaagcaagagguugugguccuggggucucaggaaggagcgaugcacaccgcccugacaggcgcuaccgagauccagaauuccgggggcaccagcauuuucgccggacaccucaagugucgccugaaaauggauaagcuugaacugaaaggcaugucuuacgccaugugccucaacacauuugugcugaagaaagagguuuccgagacgcagcaugggaccauccugauuaagguggaauacaagggagaggacgcucccuguaaaaucccuuucagcacagaagauggccaagggaaggcccacaacggaagacuuaucaccgcgaaucccgucgugacaaaaaaggaggagcccgugaacauugaagcugagccuccguucggcgaauccaauaucguuauugggaucggcgacaaagcccucaagauuaacugguauaagaaaggaucuagcaucggcaagauguuugaggccaccgcucggggggccagacgcauggcuauccugggagauacggccugggacuucggcuccgucgggggagugcugaauagccucggcaaaauggugcaucaggucuuugggucugcguacacagcccuguucuccggcgugagcuggauuaugaagaucggaauuggcguucuucugaccuggaucgggcucaacucuaaaaauaccagcauguccuuuucuugcauugugaucggaauuaucacacuguaucugggcgcugucgugcaggccgauaugggguguguuaucaacuggaagggaaaggaacuuaaaugcggcagcgggauuuucgugaccaaugagguccacacauggacggagcaguacaaguuucaagcugacucccccaaacggcucgccaccgcgaucgccggcgcuugggaaaacggaguguguggcauuagaagcacaacccgcauggagaaucugcuguggaagcagaucgccaacgaacucaauuauauucugugggagaacaauaucaaacuuacaguuguggucggggauaucauuggagugcuggaacagggcaagcggacccucacgccucagcccauggagcugaaauacucuuggaagaccugggggaaggcuaaaaucgugacagccgagacccaaaacuccagcuucauuaucgacggaccuaacacacccgaaugcccgucugccuccagagcuuggaaugucugggagguugaagacuauggcuuuggcguguucaccacaaacauuuggcugaagcuucgcgagguguacacccagagcugugaucaucggcucauguccgcggccaucaaagacgaaagagcuguccacgccgauaugggguacuggaucgagucucagaagaauggaagcuggaaacuggagaaggccuccuuuauugaagugaagacgugcacauggccuaaaucucacacccuguggagcaacggcguucucgaguccgacaugaucauucccaagagccuggcugggccuaucucucagcauaaucaccgccccggauaucauacccaaacagccggcccuuggcaccuugggaaacuggaacucgauuucaacuacugcgagggaaccacgguggcgauuacagagaauuguggcacccggggccccucccugagaacaaccacagucagcgggaagcugauccacgaauggugcugucgcucuugcacccuuccgccucuccgguauaugggagaggacggcuguugguacgggauggaaaucagacccauuaacgagaaagaagagaauauggugaagucccugguuagcgcuggaucuggcaagguggauaacuuuacgauggggguccugugccucgccauccuguucgaggaagugaugcggggaaaauucggcaagaaacauaugauugccggcguucuuuuuaccuucgugcugcuccugagcgggcagaucacauggcgcgacauggcucacacccugauuaugaucggauccaaugccagcgauagaaugggcaugggggucacauaucuugcgcugauugcuaccuuuaagauccagcccuuccucgcccugggauuuuuccuccggaaacugacgucuagagagaaccuucugcucggcguggggcuggccauggcuacaacccugcaacuuccugaagacaucgagcagauggccaauggaauugcucugggccucaugacacugaagcucaucacccaguuugaaaccuaccagcuguggacagcccuugugucccugacguguagcaacaccauuuucacacucaccgucgcguggcgcacagccacccugauccuggcuggcguuucccuucugccgcucugccaaucuagcuccaugcggaagacggauuggcugcccaugacaguggccgcuaugggggugccuccccucccucuguuuauuuucucucuuaaagacacccccaagagacgcagcuggccucugaaugagggagucauggccgugggccugguuuccauccucgccucuagccugcuuagaaacgaugugcccauggcugggccgcuggucgcgggaggccuccugaucgccuguuaugugauuaccgggacauccgcugaccucaccguugagaaagccgccgacgugacaugggaagaggaagcugagcagacgggagucagccauaaccugaugaucaccguggaugacgauggcacaaugcggauuaaggacgaugaaaccgagaauauccuuacaguccugcugaaaaccgcccuccugauugugucuggcaucuuuccuuacuccauccccgcgacgcuucugguuuggcacaccuggcagaagcagacacaacgcagcggggugcucugggacgucccuucucccccggagacccagaaagcugaacuggaggaaggaguguacagaauuaagcagcagggcaucuucgggaagacacaaguuggagugggcguccagaaagaggggguguuucauaccauguggcacgugacacggggagccguucucacgcacaacggcaagcgccuggagccuaauugggccuccgucaaaaaggaucuuauuagcuauggcgggggauggagacugucugcucaguggcaaaaaggcgaagaggugcaggugaucgccgucgaacccgggaagaacccuaagaauuuccagaccaugcccggaauuuuccagacaaccaccggcgagaucggggcgauugcucuggacuuuaaacccggaacauccggcagcccuaucaucaaccgggaaggcaaggugguugggcucuacggaaauggcguggucacgaaaaacgggggauauguguccggcauugcccaaaccaaugccgagccggaugggcccacaccugagcuggaagaggaaauguucaagaaacgcaaccuuaccaucauggaccugcaucccggcagcggaaagacaagaaaguaccucccugcuauuguucgggaggccaucaaacgcagacugcggacccucauucuggcucccacgagaguggucgccgcggaaauggaggaggcccuuaagggccugccuauccgcuaucagacaaccgcuaccaaaucugaacacacagggcgggagaucguggaucugaugugccaugccaccuuuacaaugagacuccugagcccgguucgcgugcccaauuacaaccuugucauuauggacgaagcucacuucaccgauccugccuccaucgccgcucggggauauauuucuacgagagugggcaugggggaggcggccgcuaucuuuaugacagccacccccccuggaacagccgaagcuuucccccagagcaaugccccgauucaggacgaggagcgcgacaucccugaacgguccuggaacucuggcaaugaguggaucaccgauuuuguggggaagacggucugguucguucccagcauuaaagcgggcaacgacaucgcuaacugucugagaaagaauggaaagaaagugauucaacucucccgcaagaccuuugauacagaauaccagaaaacccggcugaacgacugggauuucguggucacaaccgacaucucugagaugggcgccaauuuuaaggccgauagagugauugacccccggcgcugccugaaaccuguuauccucacagaugggcccgagagagugauucuugcuggaccuaugccggucaccgccgcgagcgccgcucagcggcgcggcagaguggggcggaacccccagaaggaaaaugaccaauacaucuucacgggacagccucugaacaaugaugaggaccaugcccacuggacagaagcuaagaugcugcucgacaacaucaauacccccgagggcauuaucccugcccuguucgaacccgagagagagaaauccgcugccauugauggggaauaucgccuuaagggcgagagccggaaaaccuuuguugaacugaugagacgcggagaccucccgguguggcuggcgcacaaggucgccucugagggcaucaaauacacagaucggaaguggugcuucgacggggaaagaaacaaucagauucuggaggagaacauggauguggaaaucuggaccaaagagggagaacgcaagaagcuccggccuagauggcuugacgcucgcacauauuccgauccccuggcccugaaagaguuuaaggacuucgcugccggcagaaaaagcaucgcccucgaucuggucacggaaauugggcgggugccuucucaucuugcucaccgcaccagaaaugcgcuggacaaccucguuaugcugcauacauccgagcacggaggccgggccuaccgccacgcuguggaggaacugcccgagaccauggaaacacuccuucugcugggccucaugauccugcuuaccgggggagccaugcuguuucucauuagcggcaaggggaucggaaaaacguccauuggccugaucugugugaucgucucuagcgggaugcuguggauggccgauguuccucuccaguggauugcuuccgccaucgugcuugaguucuuuaugauggugcugcugauucccgagccggaaaagcaaagaaccccucaggacaaucagcucgcguaugucgugaucggaauucugacacuugccgcuaucguugccgcuaacgagaugggccugcucgaaaccacaaagcgggaucugggcaugagcaaagagcccgggguggucucucccaccuccuaccuggacguggaccuccauccugccagcgcguggacgcuuuaugccgucgcuacaaccgugauuacaccgaugcugagacacaccaucgaaaauucuaccgccaacguuagccuggcugccaucgcuaaccaagccgugguccucaugggacuggauaagggcuggcccauuuccaaaauggaccuuggggugccucugcucgcgcugggaugcuacucucagguuaauccccugacacucacggccgcugugcuucugcuggucacccauuacgccaucauuggcccugggcuccaggcuaaggccacacgcgaggcccagaaacggaccgcggcuggaaucaugaagaaccccacaguggauggcauuaugaccaucgaccuggauccugugaucuaugacagcaaguucgagaaacaacuuggccagguuaugcugcucguccugugugccgugcagcugcuccuuaugagaacguccugggcucugugcgaagcccugacacucgccaccgggccgauuaccacacugugggagggaucucccggcaaguuuuggaauaccacaaucgcugugagcauggccaacauuuuccgcggguccuaccuugcgggagccggccuggcuuuuagcaucaugaaaucugucgggacgggacggagaggcaccggcucccagggggaaacacucggagagaaguggaaaaagaagcugaaucaacugagccggaaagaauucgaucucuauaagaaauccggcauuaccgagguugaccgcacagaggccaaggaagggcuuaaaagaggagagaccacgcaccaugcugugucucggggcagcgccaagcugcagugguuuguggaacgcaacauggucaucccugaggggagagugaucgaucugggauguggccggggcgggugguccuacuauugcgcgggacucaaaaagguuaccgaagugcgcggcuacacaaaggggggacccggccacgaggagccuguccccaugucuaccuauggguggaauauugugaaacugaugagcggaaaggacguuuucuaccuuccgccugaaaaaugugauacacugcucugcgacaucggcgaguccagccccucucccaccguggaagaguccagaacaauucggguccugaagaugguggagccuuggcugaaaaacaaucaguucuguaucaaggugcucaaccccuacaugccuaccgucauugaacaccuugagcgccugcagagaaaguauggcgggaugcugguucggaauccgcucagcagaaacucuacgcaugaaauguacuggaucuccaauggaacaggcaacauugugagcucugugaauauggucagccgccugcuucugaaccgguuuaccaugacccacagacgccccacaaucgagaaagauguggaccucggggccggaacgcggcauguuaacgcugaaccugagacccccaauauggacgugaucggcgagagaauuaagcgcaucaaagaagagcacuccucuacauggcacuaugaugacgaaaacccuuacaagaccugggccuaucaugggagcuacgaggucaaagcuacaggauccgccagcuccaugauuaauggcgugguuaagcugcugaccaagcccugggauguggucccgauggugacacaaauggcuaugaccgacacgaccccuuucggccagcagcggguuuuuaaagaaaagguggauacaagaaccccccgcccuaugcccgggacacggaaagucauggagaucaccgccgaguggcucuggagaacgcugggacgcaacaagaaaccucggcuuugcacaagagaagaguucaccaagaaggugcgcacaaaugcggccaugggcgcugucuuuaccgaagagaaccaaugggacucugccagagcugccguggaagaugaggaguucuggaaacugguugaccgggaacgcgagcuccacaagcuggggaaauguggaagcugcguguauaauaugaugggcaagagagaaaaaaagcuuggggaguuuggcaaagccaagggaucccgggcgauuugguacauguggcugggcgcuagauaccucgaguucgaagcccugggguuucugaacgaggaucauugguucucucgggaaaauagcuauuccggagucgagggcgaagggcuccacaagcugggauacauccuucgcgacaucucuaaaauucccggcggggccauguaugcugaugacacggccggcugggacaccagaaucacagaggaugaccugcauaacgaggaaaagauuacccagcagauggauccggagcaccggcagcucgcuaaugccaucuuuaaacugacauaccaaaacaagguggugaaaguucagcgcccuacccccaagggaacagugauggacauuaucagcagaaaggaucagcggggcuccgggcaggucggaaccuauggccuuaauacguucacaaacauggaagcgcaacuggugcgccagauggagggggaaggaguucucagcaaagccgaccuggagaauccccaccagcuggagaagaaaaucacccaguggcucgaaaccaagggcguggagagacugaaacggauggcuauuucuggggaugacugcgucgugaagccuaucgaugaccgcuuugccaacgcucuucuggcccucaacgauaugggcaaggucagaaaagacauuccgcaauggcagcccuccaagggauggcaugauuggcagcaggugccuuucuguagccaccauuuccacgaacugaucaugaaagacggccggaagcuuguugugcccugccgcccucaagacgagcugauugggagagcgcggaucucucagggagccggcuggucccucaaagaaacagcuugucuggggaaggccuacgcucagauguggagccugauguauuuucaccgcagagaucuccggcuggccucuaaugcuaucugcuccgccguccccgugcauuggauuccuaccagcagaacaacgugguccauccacgcgcaucaccaauggaugaccacagaggacaugcuuaccguuuggaaccgcguguggauugaggauaaucccuggauggaagacaagacaccggucaccacgugggaggaugugccuuaccugggaaaacgggaagaccagugguguggcagccucaucgggcugaccucuagagccacaugggcucagaacauucuuaccgccauccagcaagugcgcagccugauuggcgaugaggaguuccucgacuacaugcccuccaugaagcgguuuagaaaagaagaggaaucugagggagccaucugguga

SEQ ID NO: 20494 - RNA, 9873 nt, Artificial Sequence
  derived and/or modified CDS sequence (opt5) from DENV-3__FJ639719__SS-prME
accagccugugccucaugaugaugcugcccgccacacuugcuuuccaccugacgucccgggacggcgaaccucggaugaucguggggaagaacgaacgcggaaagucucuccuguuuaagaccgccaccggcauuaauauguguacccuuaucgcgauggaucugggggagaugugcgacgauacagugaccuacaaguguccgcucauugcugaaguugagcccgaagacaucgauugcugguguaaccugacaagcaccugggugacguauggaaccugcaaucaggccggcgagcauagacgggacaagcgcuccguggcccuggcuccucacgucgggaugggacucgauacaagaacccagacauggaugucugccgagggcgcuuggcggcaggucgaaaagguugagaccugggcccugcgccaucccggcuucacgauucuugcgcuguuucucgcccacuacaucgggacaagccugauccagaagguggucauuuucauccuucugaugcucgugaccccuuccaugacaaugagauguguuggagugggcaaccgggacuuugucgaagggcugucuggagcuaccuggguggaugugguccuggagcauggcgggugcguuaccacaauggccaagaauaaacccacgcucgacauugagcugcagaagaccgaagcuacacagcuugccacccugcgcaaacucuguaucgagggaaagauuacaaacaucaccacggauagcagaugcccuacacagggcgaagcgauucugccggaggaacaggaccagaauuauguguguaaacacaccuacguggaucggggcugggggaacggaugcggccuuuucgggaagggaucccuggugaccugcgccaaguuucaaugucucgagcccaucgagggcaaagugguucaguaugaaaaucugaaguacacagugaucauuaccguccacacaggggaccagcaucaggugggaaacgacacgcaaggcguuaccguggagaucacaccucaggcuagcaccgucgaagccgugcugcccgaguauggcacacucgggcuggaaugcucuccucgcaccggacuugauuucaaugagaugauucugcucacgaugaaaaacaaggcuuggaugguccacagacagugguuuuucgaccugccccuuccguggaccuccggcgccacaaccgagacaccuaccuggaaucggaaagaacugcucgugacguuuaagaacgcccaugcuaaaaagcaagagguugugguccuggggagccaggaaggagcgaugcacacagcccugaccggcgcuacagagauccaaaauucugggggcaccuccauuuucgccggacaccucaagugucgccugaaaauggauaaacuugaacugaaaggcaugagcuacgccaugugccucaacaccuuugugcugaagaaagagguuucugagacacagcaugggacgauccugaucaagguggaauacaagggagaggacgcucccuguaaaauuccuuucuccaccgaagauggccaagggaaggcccacaacggaagacuuaucacagcgaaucccgucgugaccaaaaaggaggagcccgugaacauugaagcugagccuccguucggcgaaagcaauaucguuauugggaucggcgacaaagcccucaagaucaacugguauaagaaaggauccucuauuggcaagauguuugaggccacagcuagaggggccagacgcauggcuauccugggagauaccgccugggacuucggcagcgucgggggagugcugaauagccucggcaaaauggugcaucagauuuuugggagcgcguacacggcccuguucucuggcgucuccuggaucaugaagauuggaaucggcgugcuucugacauggauugggcucaacagcaaaaauaccucuaugagcuuuuccugcaucguuaucggaauuaucacccuguaucugggcgcugugguccaggccgauauggggugugugauuaacuggaagggaaaggaacuuaaaugcggcucugggaucuucguuacaaaugaggugcacaccuggacagagcaguacaaguuucaagcugacagccccaaacggcucgccacggcgauugccggcgcuugggaaaacggagucuguggcaucagauccaccacacgcauggagaaucugcuguggaagcagaucgccaacgaacucaauuauauucugugggagaacaauaucaaacuuaccgugguugugggggauauuaucggaguccuggaacagggcaagcggacacucaccccucagcccauggagcugaaauacagcuggaagacgugggggaaggcuaaaauugugaccgccgagacacaaaacucuuccuucaucaucgacggaccuaacacccccgaaugcccgagcgccucuagagcuuggaaugugugggaggucgaagacuauggcuuuggcguuuucacaaccaacauuuggcugaaacuucgcgagguguacacacaguccugugaucaucggcucaugagcgcggccaucaaagacgaaagagcugugcacgccgauaugggguacuggauugagucccagaagaauggaucuuggaaacuggagaaggccagcuuuaucgaagucaagaccugcacguggccuaaaucccacacacuguggucuaacggcgugcucgagagcgacaugauuauccccaagucccuggcugggccuaucagccagcauaaucaccgccccggauaucauacccaaaccgccggcccuuggcaccuugggaaacuggaacucgauuucaacuacugcgagggaacaaccguugugauuacggagaauuguggcacacggggccccucucugagaaccacaaccgucuccgggaagcugauccacgaauggugcugucgcagcugcacacuuccgccucuccgguauaugggagaggacggcuguugguacgggauggaaauuagacccaucaacgagaaagaagagaauauggugaagucucugguuuccgcgggaagcggcaagguggauaacuuuaccauggggguccugugccucgcuauucuguucgaggaagugaugcggggaaaauucggcaagaaacauaugaucgccggcguucuuuuuacguucgugcugcuccugucugggcagauuaccuggcgcgacauggcccacacacugaucaugaucggaagcaaugcuuccgauagaaugggcaugggggucacccaucuugcccugauugcgacauuuaagauccagcccuuccucgcucugggauuuuuccuccggaaacugaccagcagagagaaccuucugcucggcguggggcuggccauggccacgacacugcaacuuccugaagacauugagcagauggcuaauggaaucgcccugggccucaugacccugaagcucauuacacaguuugaaaccuaucagcuguggaccgcucuugugucucugacauguuccaacacgaucuucacccucacagucgccuggcgcaccgcgacacugauccuggccggcguuagccuucugccgcucugccaauccucuagcaugcggaagaccgauuggcugcccaugacgguggcugccaugggggugccuccccucccucuguuuauuuucucccuuaaagacacacccaagagacgcucuuggccucugaaugagggagucauggcugugggccugguuagcauccucgccuccucucugcuuagaaacgaugugcccauggccgggccgcuggucgcuggaggccuccugauugcguguuacgugaucaccgggaccagcgccgaccucacaguugagaaagcugccgacgugaccugggaagaggaagccgagcagacaggagucucccacaaccugaugauuacgguggaugacgauggcaccaugcggaucaaggacgaugaaacagagaauauccuuaccguccugcugaaaacagcucuccugauugugagcggcaucuuuccuuauucuauucccgccacccuucugguuuggcauacguggcagaagcagacccaacgcuccggggugcucugggacgucccuucucccccggagacacagaaagcggaacuggaggaaggaguguacagaaucaagcagcagggcauuuucgggaagacccaaguuggagugggcguccagaaagaggggguguuucacacaauguggcacgugacccggggagcuguucucacacauaacggcaagcgccuggagccuaauugggccuccgucaaaaaggaucuuaucuccuacggcgggggauggagacugagcacgcaguggcaaaaaggcgaagagguccaggugauugccgucgaacccgggaagaacccuaagaauuuccagaccaugcccggaaucuuccagacaaccaccggcgagaucggggcuauugcccuggacuuuaaacccggaacaucuggcuccccuaucauuaaccgggaaggcaaggugguugggcucuauggaaauggcguggucacgaaaaacgggggauacgugagcggcaucgcgcaaaccaaugcugagccggaugggcccacaccugagcuggaagaggaaauguucaagaaacgcaaccuuaccauuauggaccugcaccccggcuccggaaagacaagaaaguaucucccugccaucguucgggaggccaucaaacgcagacugcggacccucauucuggcucccacgagaguggucgccgcugaaauggaggaggcccuuaagggccugccuauccgcuaccagacaaccgcgaccaaaagcgaacauacagggcgggagauuguggaucugaugugccacgccaccuuuacaaugagacuccugucuccgguucgcgugcccaauuauaaccuuaucauuauggacgaagcucauuucaccgauccugccagcaucgcugcccggggauacaucuccacgagagucggcaugggggaggccgcugcgauuuuuaugacagccacacccccuggaacagcugaagccuucccccagucuaaugccccgauccaggacgaggagcgcgacauuccugaacggagcuggaacuccggcaaugaguggaucaccgauuuuguggggaagacggugugguucguccccucuauuaaagcuggcaacgacaucgccaacugucugagaaagaauggaaagaaaguuauucaacucagccgcaagaccuuugauacagaauaucagaaaacccggcugaacgacugggauuucguggugacaaccgacaucuccgagaugggcgcgaauuuuaaggcugauagagucaucgacccccggcgcugccugaaaccugugauucucacagaugggcccgagagaguuauccuugccggaccuaugccggugaccgccgcuucugccgcgcagcggcgcggcagagucgggcggaacccccagaaggaaaaugaccaauacauuuucacgggacagccucugaacaaugaugaggaccacgcccacuggacagaagcuaagaugcugcucgacaacaucaauacccccgagggcauuaucccugcccuguucgaacccgagagagagaaaagcgcugccaucgauggggaauaccgccuuaagggcgagucccggaaaaccuuuguggaacugaugagacgcggagaccucccgguuuggcuggcucauaagguggccagcgagggcauuaaauauacagaucggaaguggugcuucgacggggaaagaaacaaucagauccuggaggagaacauggaugucgaaauuuggaccaaagagggagaacgcaagaagcuccggccuagauggcuugacgcgcgcacauacucugauccccuggcccugaaagaguuuaaggacuucgcugccggcagaaaauccaucgcucucgaucuggugacggaaauugggcgggucccuagccaccuugcccaucgcaccagaaaugcccuggacaaccucgugaugcugcacacaucugagcacggaggccgggcuuaucgccaugcgguugaggaacugcccgagaccauggaaacacuccuucugcugggccucaugauccugcuuaccgggggagccaugcuguuucucguguccggcaaggggaucggaaaaacgaccauuggccugaucugugugauugucagcuccgggaugcuguggauggcugauaucccucuccaguggauugccucugccaucguucuugaguucuuuaugauggugcugcugauucccgagccggaaaagcaaagaacaccucaggacaaucagcucgcuuacguggucaucggaauccugacccuugccgcgauuguggccgcuaacgagaugggccugcucgaaacaaccaagcgggaucugggcaugagcaaagagcccgggguugugucccccacgagcuaucuggacgucgaccuccacccugccucugcuuggacacuuuacgccguggcgaccacagucaucaccccgaugcugagacauaccauugaaaauuccacagccaacgugagccuggcugccaucgcuaaccaagccguugugcucaugggacuggauaagggcuggcccauuucuaaaauggaccuuggggucccucugcucgcucugggaugcuauagccaggugaauccccugacgcucaccgccgcgguucuucugcuggugacacacuacgccaucaucggcccugggcuccaggcuaaggccacccgcgaggcucagaaacggacagccgccggaauuaugaagaaccccaccgucgauggcaucaugacgauugaccuggauccugugaucuacgacuccaaguucgagaaacaacuuggccaggugaugcugcucguucugugugcgguccagcugcuccuuaugagaacaucuugggcucugugcgaagcccugacccucgcuaccgggccgauuacaacccugugggagggaagccccggcaaguuuuggaauacaacgaucgccguguccauggccaacaucuuccgcgggucuuaucuugcuggagccggccuggcguuuagcauuaugaaauccguggggaccggacggagaggcacaggcagccagggggaaacccucggagagaaguggaaaaagaagcugaaucaacugucucggaaagaguucgaucucuacaagaaauccggcaucacagaggucgaccgcaccgaggccaaggaagggcuuaaaagaggagagacgacccaucacgcuguuagccggggcuccgccaagcugcagugguuuguggaacgcaacauggugauuccugaggggagagucaucgaucugggauguggccggggcggguggucuuauuacugcgcuggacucaaaaaggugacagaaguucgcggcuauaccaaaggcgggcccgggcacgaggagccugugcccaugagcacauacggguggaauauugucaaacugauguccggaaaggacguguucuaucuuccgccugaaaaaugugauacccugcucugcgacaucggcgagucuagccccucccccacaguugaagagagcagaaccauucgggugcugaagauggucgagccuuggcugaaaaacaaucaguucuguaucaaggugcucaaccccuacaugccuacggugaucgaacaucuugagcgccugcagagaaaguacggcgggaugcugguccggaauccgcucucuagaaacuccacacacgaaauguauuggauuagcaauggaaccggcaacaucguuucuuccgugaauauggugagccgccugcuucugaaccgguuuaccaugacacauagacgccccacgauugagaaagaugucgaccucggggccggaacccggcacgugaacgcggaaccugagacacccaauauggacguuaucggcgagagaauuaagcgcaucaaagaagaacacucuagcaccuggcauuacgaugacgaaaacccuuauaagacaugggccuaccacggguccuaugaggugaaagcuaccggaucugccagcuccaugaucaauggcgucgugaagcugcugacaaagcccugggauguugugccgauggucacccaaauggcuaugacggacaccacaccuuucggccagcagcggguguuuaaagaaaagguugauaccagaacaccccgcccuaugcccgggacccggaaagugauggagauuacggccgaguggcucuggagaacacugggacgcaacaagaaaccucggcuuugcaccagagaagaguucacaaagaagguccgcaccaaugcugccaugggcgcgguguuuacggaagagaaccaaugggacagcgccagagcugccgucgaagaugaggaguucuggaaacugguggaccgggaacgcgagcuccauaagcuggggaaauguggauccugcguuuacaauaugaugggcaagagagagaagaaacuuggggaguuuggcaaagcuaagggaucucgggccaucugguauauguggcugggcgccagauuccucgaguuugaagcgcugggguuccugaacgaggaucacugguuuagccgggaaaauuccuacucuggaguggagggcgaagggcuccauaagcugggauacauucuucgcgacaucagcaaaauucccggcggggcuauguaugccgaugacaccgccggcugggacacaagaaucaccgaggaugaccugcacaacgaggaaaagaucacacagcagauggauccggagcaccggcagcucgcuaaugccauuuucaaacugaccuaccaaaacaaggucgugaaagugcagcgcccuacacccaagggaaccguuauggacaucauuuccagaaaggaucagcggggcucuggacaggugggaacguauggccuuaauacauuuaccaacauggaagcucaacugguccgccagauggagggggaaggagugcucagcaaagccgaccuggagaauccccaucugcucgagaagaaaaucacccaguggcuggaaaacaagggcguugagagacuuaaacggauggcgauuuccggggaugacugcguggucaagccuaucgaugaccgcuucgccaacgcucugcucgcccugaaugauaugggcaaggugagaaaagacaucccgcaguggcaacccagcaagggauggcacgauuggcagcaggucccuuucuguucucaucacuuucacgaacuuauuaugaaagacggccggaagcuggugguucccugccgcccucaggacgagcucaucgggagagcucggauuucccaaggagccggcuggagccugaaagaaacagcgugucuggggaaggccuacgcucagauguggucucucauguauuuccaucgcagagaucugcggcuugccuccaacgcuaucugcagcgccgugcccguccacugggugccuaccucuagaacaacgugguccauucaugcucaccaucaguggaugaccacagaggacaugcugaccguuuggaaucgcguguggaucgaggauaaccccuggauggaagacaagacaccggucaccacgugggaggaugugccuuaccucggaaaacgggaagaccaaugguguggcagccugauugggcuuaccuccagagccacaugggcgcagaauauccugaccgccauccaacaggugcgcagccucauuggcgaugaggaguuucuggacuauaugcccucuaugaagcgguucagaaaagaagaggaaagcgagggagcuaucugguga

SEQ ID NO: 20495 - RNA, 9873 nt, Artificial Sequence
  derived and/or modified CDS sequence (opt5) from DENV-3__KF955332__SS-prME
accagccugugccucaugaugaugcugcccgccacccuugcuuuccaccugacgucccgggacggcgaaccucggaugaucguggggaagaacgaacgcggaaagucucuccuguuuaagaccgccacaggcauuaauauguguacccuuaucgcgauggaucugggggagaugugcgacgauacagucaccuacaaguguccgcucauugcugaaguugagcccgaagacaucgauugcugguguaaccugacaagcaccugggugacguauggaaccugcaaucaggccggcgagcaccggcgggacaagcgcuccguggcccuggcuccucacgucgggaugggacucgauacaagaacccagacauggaugucugccgagggcgcuuggagacagguggaaaaaguugagaccugggcccugcgccaucccggcuucacgauucuugcgcuguuucucgcccacuacaucgggacaagccugauccagaagguggucauuuucauccuucugaugcucgugaccccuuccaugacaaugagauguguuggagugggcaaccgggacuuugucgaagggcugucuggagcuaccuggguggaugugguccuggagcauggcgggugcguuaccacaauggccaagaauaaacccacgcucgacauugagcugcagaagaccgaagcuacacagcuugccacccugcgcaaacucuguaucgagggaaagauuacaaacaucaccacggauagcagaugcccuacacagggcgaagcgauucugccggaggaacaggaccagaauuauguguguaaacacaccuacguggaucggggcugggggaacggaugcggccuuuucgggaagggaucccuggugacaugcgccaaguuucaaugucucgagcccaucgagggcaaagugguucaguaugaaaaucugaaguacacagugaucauuaccguccacacaggggaccagcaucaggugggaaacgacacgcaaggcguuaccguggagaucacaccucaggcuagcaccgucgaagccgugcugcccgaguauggcacacucgggcuggaaugcucuccucgcaccggacuugauuucaaugagaugauucugcucacgaugaaaaacaaggcuuggaugguccacagacagugguuuuucgaccugccccuuccguggaccuccggcgccacaaccgagacaccuaccuggaaucggaaagaacugcucgugacguuuaagaacgcccaugcuaaaaagcaagagguugugguccuggggagccaggaaggagcgaugcacacagcccugaccggcgcuacagagauccaaaauucugggggcaccuccauuuucgccggacaccucaagugucgccugaaaauggauaaacuugaacugaaaggcaugagcuacgccaugugccucaacaccuuugugcugaagaaagagguuucugagacacagcaugggacgauccugaucaagguggaauacaagggagaggacgcucccuguaaaauuccuuucuccaccgaagauggccaagggaaggcccacaacggaagacuuaucacagcgaaucccgucgugaccaaaaaggaggagcccgugaacauugaagcugagccuccguucggcgaaagcaauaucguuauugggaucggcgacaaagcccucaagaucaacugguauaagaaaggauccucuauuggcaagauguuugaggccacagcuagaggggccagacgcauggcuauccugggagauaccgccugggacuucggcagcgucgggggagugcugaauagccucggcaaaauggugcaucagauuuuugggagcgcguacacggcccuguucucuggcgucuccuggaucaugaagauuggaaucggcgugcuucugacauggauugggcucaacagcaaaaauaccucuaugagcuuuuccugcaucguuaucggaauuaucacccuguaucugggcgcugugguccaggccgauauggggugugugauuaacuggaagggaaaggaacuuaaaugcggcucugggaucuucguuacaaaugaggugcacaccuggacagagcaguacaaguuucaagcugacagccccaaacggcucgccacggcgauugccggcgcuugggaaaacggagucuguggcaucagauccaccacacgcauggagaaucugcuguggaagcagaucgccaacgaacucaauuauauucugugggagaacaauaucaaacuuaccgugguugugggggauauuaucggaguccuggaacagggcaagcggacacucaccccucagcccauggagcugaaauacagcuggaagacgugggggaaggcuaaaauugugaccgccgagacacaaaacucuuccuucaucaucgacggaccuaacacccccgaaugcccgagcgccucuagagcuuggaaugugugggaggucgaagacuauggcuuuggcguuuucacaaccaacauuuggcugaaacuucgcgagguguacacacaguccugugaucaucggcucaugagcgcggccaucaaagacgaaagagcugugcacgccgauaugggguacuggauugagucccagaagaauggaucuuggaaacuggagaaggccagcuuuaucgaagucaagaccugcacguggccuaaaucccacacacuguggucuaacggcgugcucgagagcgacaugauuauccccaagucccuggcugggccuaucagccagcauaaucaccgccccggauaucauacccaaaccgccggcccuuggcaccuugggaaacuggaacucgauuucaacuacugcgagggaacaaccguugugauuacggagaauuguggcacacggggccccucucugagaaccacaaccgucuccgggaagcugauccacgaauggugcugucgcagcugcacacuuccgccucuccgguauaugggagaggacggcuguugguacgggauggaaauuagacccaucaacgagaaagaagagaauauggugaagucucugguuuccgcgggaagcggcaagguggauaacuuuaccauggggguccugugccucgcuauucuguucgaggaagugaugcggggaaaauucggcaagaaacauaugaucgccggcguucuuuuuacguucgugcugcuccugucugggcagauuaccuggcgcgacauggcccacacacugaucaugaucggaagcaaugcuuccgauagaaugggcaugggggucaccuaucuugcccugauugcgacauuuaagauccagcccuuccucgcucugggauuuuuccuccggaaacugaccagcagagagaaccuucugcucggcguggggcuggccauggccacgacacugcaacuuccugaagacauugagcagauggcuaauggaaucgcccugggccucaugacccugaagcucauuacacaguuugaaaccuaccagcuguggaccgcucuugugucucugacauguuccaacacgaucuucacccucacagucgccuggcgcaccgcgacacugauccuggccggcguuagccuucugccgcucugccaauccucuagcaugcggaagaccgauuggcugcccaugacgguggcugccaugggggugccuccccucccucuguuuauuuucucccuuaaagacgcucccaagagacgcucuuggccucugaaugagggagucauggccgugggccugguuagcauccucgccuccucucugcuuagaaacgaugugcccauggcugggccgcuggucgcgggaggccuccugauugccuguuaugugaucacagggaccagcgcugaccucaccguugagaaagccgccgacgugacaugggaagaggaagcugagcagaccggagucucccauaaccugaugauuacaguggaugacgauggcacgaugcggaucaaggacgaugaaaccgagaauauccuuacaguccugcugaaaaccgcccuccugauugugagcggcaucuuuccuuacucuauucccgcgacacuucugguuuggcacaccuggcagaagcagacgcaacgcuccggggugcucugggacgucccuucucccccggagacccagaaagcugaacuggaggaaggaguguacagaaucaagcagcagggcauuuucgggaagacacaaguuggagugggcguccagaaagaggggguguuucauaccauguggcacgugacacggggagccguucucacccacaacggcaagcgccuggagccuaauugggccuccgucaaaaaggaucuuaucuccuauggcgggggauggagacugagcacacaguggcaaaaaggcgaagagguccaggugauugcugucgaacccgggaagaacccuaagaauuuccagacgaugcccggaaucuuccagaccacaaccggcgagaucggggccauugcgcuggacuuuaaacccggaaccucuggcuccccuaucauuaaccgggaaggcaaggugguugggcucuacggaaauggcguggucaccaagaacgggggauaugugagcggcaucgcucaaacgaaugccgagccggaugggcccaccccugagcuggaagaggaaauguucaagaaacgcaaccuuacaauuauggaccugcaucccggcuccggaaagaccagaaaguaccucccugccaucguucgggaggcuaucaaacgcagacugcggacacucauucuggcccccaccagaguggucgcugccgaaauggaggaggcgcuuaagggccugccuauccgcuaucagacgacagccaccaaaagcgaacacaccgggcgggagauuguggaucugaugugccaugcuacauuuaccaugagacuccugucuccgguucgcgugcccaauuacaaccuuaucauuauggacgaagcccacuucacagauccugcuagcaucgccgcccggggauauaucuccaccagagucggcaugggggaggcugcggccauuuuuaugacggcuacacccccuggaaccgccgaagccuucccccagucuaaugcuccgauccaggacgaggagcgcgacauuccugaacggagcuggaacuccggcaaugaguggaucacagauuuuguggggaagaccgugugguucguccccucuauuaaagccggcaacgacaucgcgaacugucugagaaagaauggaaagaaaguuauucaacucagccgcaagacguuugauaccgaauaccagaaaacacggcugaacgacugggauuucguggugaccacagacaucuccgagaugggcgcuaauuuuaaggccgauagagucaucgacccccggcgcugccugaaaccugugauucucaccgaugggcccgagagaguuauccuugccggaccuaugccggugacagcugccucugcggcccagcggcgcggcagagucgggcggaacccccagaaggaaaaugaccaauacauuuucaccggacagccucugaacaaugaugaggaccaugcucacuggacggaagccaagaugcugcucgacaacaucaauacacccgagggcauuaucccugcucuguucgaacccgagagagagaaaagcgccgcuaucgauggggaauaucgccuuaagggcgagucccggaaaaccuuuguggaacugaugagacgcggagaccucccgguuuggcuggcccacaagguggcgagcgagggcauuaaauacaccgaucggaaguggugcuucgacggggaaagaaacaaucagauccuggaggagaacauggaugucgaaauuuggacaaaagagggagaacgcaagaagcuccggccuagauggcuugacgcccgcaccuauucugauccccuggcucugaaagaguuuaaggacuucgccgcuggcagaaaauccaucgcccucgaucuggugacagaaauugggcgggucccuagccaucuugcccaccgcacgagaaaugcucuggacaaccucgugaugcugcauaccucugagcacggaggccgggcguaccgccacgccguugaggaacugcccgagacaauggaaacccuccuucugcugggccucaugauccugcuuacagggggagcuaugcuguuucucguguccggcaaggggaucggaaaaaccacgauuggccugaucugugugauugucagcuccgggaugcuguggauggccgauaucccucuccaguggauugccucugcuaucguucuugaguucuuuaugauggugcugcugauucccgagccggaaaagcaaagaaccccucaggacaaucagcucgccuauguggucaucggaauccugacacuugcggccauuguggcugccaacgagaugggccugcucgaaaccacaaagcgggaucugggcaugagcaaagagcccgggguugugucccccaccagcuaccuggacgucgaccuccauccugcuucugccuggacgcuuuaugcgguggccacaaccgucaucacaccgaugcugagacacaccauugaaaauuccaccgcuaacgugagccuggccgcuaucgccaaccaagcuguugugcucaugggacuggauaagggcuggcccauuucuaaaauggaccuuggggucccucugcucgcccugggaugcuacagccaggugaauccccugacacucacggcggccguucuucugcuggugacccauuacgcuaucaucggcccugggcuccaggccaaggcuacacgcgaggcccagaaacggaccgccgcgggaauuaugaagaaccccacagucgauggcaucaugaccauugaccuggauccugugaucuaugacuccaaguucgagaaacaacuuggccaggugaugcugcucguucugugugcuguccagcugcuccuuaugagaacgucuugggcccugugcgaagcucugacacucgccaccgggccgauuaccacacugugggagggaagccccggcaaguuuuggaauaccacaaucgccguguccauggcuaacaucuuccgcgggucuuaccuugccggagcgggccuggccuuuagcauuaugaaauccguggggacgggacggagaggcaccggcagccagggggaaacacucggagagaaguggaaaaagaagcugaaucaacugucucggaaagaguucgaucucuauaagaaauccggcaucaccgaggucgaccgcacagaggcuaaggaagggcuuaaaagaggagagaccacgcaccaugccguuagccggggcuccgcuaagcugcagugguuuguggaacgcaacauggugauuccugaggggagagucaucgaucugggauguggccggggcggguggucuuacuauugcgccggacucaaaaaggugaccgaaguucgcggcuacacaaaaggcgggcccgggcacgaggagccugugcccaugagcaccuauggguggaauauugucaaacugauguccggaaaggacguguucuaccuuccgccugaaaaaugugauacacugcucugcgacaucggcgagucuagccccucccccaccguugaagagagcagaacaauucgggugcugaagauggucgagccuuggcugaaaaacaaucaguucuguaucaaggugcucaaccccuacaugccuaccgugaucgaacaccuugagcgccugcagagaaaguauggcgggaugcugguccggaauccgcucucuagaaacuccacgcaugaaauguacuggauuagcaauggaacaggcaacaucguuucuuccgugaauauggugagccgccugcuucugaaccgguuuaccaugacccacagacgccccacaauugagaaagaugucgaccucggggcgggaacgcggcaugugaacgccgaaccugagacccccaauauggacguuaucggcgagagaauuaagcgcaucaaagaagaacacucuagcacauggcacuaugaugacgaaaacccuuacaagaccugggcuuaucauggguccuacgaggugaaagccacaggaucugcuagcuccaugaucaauggcgucgugaagcugcugaccaagcccugggauguugugccgauggucacacaaauggccaugaccgacacgaccccuuucggccagcagcggguguuuaaagaaaagguugauacaagaacaccccgcccuaugcccgggacacggaaagugauggagauuaccgcugaguggcucuggagaacgcugggacgcaacaagaaaccucggcuuugcacaagagaagaguucaccaagaagguccgcacaaaugccgcgaugggcgccguguuuaccgaagagaaccaaugggacagcgcuagagccgcugucgaagaugaggaguucuggaaacugguggaccgggaacgcgagcuccacaagcuggggaaauguggauccugcguuuauaauaugaugggcaagagagagaagaaacuuggggaguuuggcaaagccaagggaucucgggccaucugguacauguggcugggcgcgagauuccucgaguuugaagcucugggguuccugaacgaggaucauugguuuagccgggaaaauuccuacucuggaguggagggcgaagggcuccacaagcugggauauauucuucgcgacaucagcaaaauucccggcggggccauguacgccgaugacacggcuggcugggacaccagaaucacagaggaugaccugcauaacgaggaaaagaucacccagcagauggauccggagcaccggcagcucgccaaugcuauuuucaaacugacauaucaaaacaaggucgugaaagugcagcgcccuacccccaagggaacaguuauggacaucauuuccagaaaggaucagcggggcucuggacaggugggaaccuacggccuuaauacguuuacaaacauggaagcccaacugguccgccagauggagggggaaggagugcucagcaaaaccgaccuggagaauccccaucugcucgagaagaaaaucacccaguggcuggaaaacaagggcguugagagacuuaaacggauggcgauuuccggggaugacugcguggucaagccuaucgaugaccgcuucgccaacgcucugcucgcccugaaugauaugggcaaggugagaaaagacaucccgcaguggcaacccagcaagggauggcaugauuggcagcaggucccuuucuguucucaccauuuucacgaacuuauuaugaaagacggccggaagcuggugguucccugccgcccucaggacgagcucaucgggagagcucggauuucccaaggagccggcuggagccugaaagaaacagcgugucuggggaaggccuaugcucagauguggucucucauguacuuccaccgcagagaucugcggcuugccuccaacgcuaucugcagcgccgugcccguccauugggugccuaccucuagaacaacgugguccauucacgcucaucaccaguggaugaccacagaggacaugcugaccguuuggaaucgcguguggaucgaggauaaccccuggauggaagacaagacaccggucaccacgugggaggaugugccuuaucucggaaaacgggaagaccaaugguguggcagccugauugggcuuaccuccagagccacaugggcgcagaauauccugaccgccauccaacaggugcgcagccucauuggcgaugaggaguuucuggacuacaugcccucuaugaagcgguucagaaaagaagaggaaagcgagggagcuaucugguga

SEQ ID NO: 20496 - RNA, 9873 nt, Artificial Sequence
  derived and/or modified CDS sequence (opt5) from DENV-3__FJ639720__SS-prME
accagccugugccucaugaugaugcugcccgccacacuugcuuuccaccugacgucccgggacggagagccucggaugaucguggggaagaacgaacgcggaaagucucuccuguuuaagaccgccaccggcauuaauauguguacccuuaucgcgauggaucugggggagaugugcgacgauacagucaccuacaaguguccgcucauugcugaaguugagcccgaagacaucgauugcugguguaaccugacaagcaccugggugacguauggaaccugcaaucaggccggcgagcacagacgggacaagcgcuccguggcccuggcuccucacgucgggaugggacucgauacaagaacccagacauggaugucugccgagggcgcuuggagacagguggaaaaaguugagaccugggcccugcgccaucccggcuucacgauucuugcgcuguuucucgcccacuacaucgggacaagccugauccagaagguggucauuuucauccuucugaugcucgugaccccuuccaugacaaugagauguguuggagugggcaaccgggacuuugucgaagggcugucuggagcuaccuggguggaugugguccuggagcauggcgggugcguuaccacaauggccaagaauaaacccacgcucgacauugagcugcagaagaccgaagcuacacagcuugccacccugcgcaaacucuguaucgagggaaagauuacaaacaucaccacggauagcagaugcccuacacagggcgaagcgauucugccggaggaacaggaccagaauuauguguguaaacacaccuacguggaucggggcugggggaacggaugcggccuuuucgggaagggaucccuggugacaugcgccaaguuucaaugucucgagcccaucgagggcaaagugguucaguaugaaaaucugaaguacacagugaucauuaccguccacacaggggaccagcaucaggugggaaacgacacgcaaggcguuaccguggagaucacaccucaggcuagcaccgucgaagccgugcugcccgaguauggcacacucgggcuggaaugcucuccucgcaccggacuugauuucaaugagaugauucugcucacgaugaaaaacaaggcuuggaugguccacagacagugguuuuucgaccugccccuuccguggaccuccggcgccacaaccgagacaccuaccuggaaucggaaagaacugcucgugacguuuaagaacgcccaugcuaaaaagcaagagguugugguccuggggagccaggaaggagcgaugcacacagcccugaccggcgcuacagagauccaaaauucugggggcaccuccauuuucgccggacaccucaagugucgccugaaaauggauaaacuugaacugaaaggcaugagcuacgccaugugccucaacaccuuugugcugaagaaagagguuucugagacacagcaugggacgauccugaucaagguggaauacaagggagaggacgcucccuguaaaauuccuuucuccaccgaagauggccaagggaaggcccacaacggaagacuuaucacagcgaaucccgucgugaccaaaaaggaggagcccgugaacauugaagcugagccuccguucggcgaaagcaauaucguuauugggaucggcgacaaagcccuccggaucaacugguauaagaagggauccucuauuggcaaaauguuugaggccacagcuagaggggcccgccggauggcuauccugggagauaccgccugggacuucggcagcgucgggggagugcugaauagccucggcaagauggugcaucagauuuuugggagcgcguacacggcccuguucucuggcgucuccuggaucaugaaaauuggaaucggcgugcuucugacauggauugggcucaacagcaagaauaccucuaugagcuuuuccugcaucguuaucggaauuaucacccuguaucugggcgcugugguccaggccgauauggggugugugauuaacuggaaaggaaaggaacuuaagugcggcucugggaucuucguuacaaaugaggugcacaccuggacagagcaguacaaauuucaagcugacagccccaagagacucgccacggcgauugccggcgcuugggaaaacggagucuguggcauccgcuccaccacacggauggagaaucugcuguggaaacagaucgccaacgaacucaauuauauucugugggagaacaauaucaaacuuaccgugguugugggggauauuaucggaguccuggaacagggcaaaagaacacucaccccucagcccauggagcugaaguacagcuggaaaacgugggggaaggcuaagauugugaccgccgagacacaaaacucuuccuucaucaucgacggaccuaacacccccgaaugcccgagcgccucucgcgcuuggaaugugugggaggucgaagacuauggcuuuggcguuuucacaaccaacauuuggcugaaacuucgggagguguacacacaguccugugaucauagacucaugagcgcggccaucaaggacgaacgcgcugugcacgccgauaugggguacuggauugagucccagaaaaauggaucuuggaagcuggagaaagccagcuuuaucgaagucaagaccugcacguggccuaagucccacacacuguggucuaacggcgugcucgagagcgacaugauuauccccaaaucccuggcugggccuaucagccagcauaaucaccggcccggauaucauacccaaaccgccggcccuuggcaccuugggaagcuggaacucgauuucaacuacugcgagggaacaaccguugugauuacggagaauuguggcacaagaggccccucucugcgcaccacaaccgucuccgggaaacugauccacgaauggugcugucggagcugcacacuuccgccucucagauauaugggagaggacggcuguugguacgggauggaaauucggcccaucaacgagaaggaagagaauauggugaaaucucugguuuccgcgggaagcggcaagguggauaacuuuaccauggggguccugugccucgcuauucuguucgaggaagugaugcgcggaaaguucggcaaaaagcauaugaucgccggcguucuuuuuacguucgugcugcuccugucugggcagauuaccuggagagacauggcccacacacugaucaugaucggaagcaaugcuuccgaucggaugggcaugggggucaccuaucuugcccugauugcgacauuuaaaauccagcccuuccucgcucugggauuuuuccucagaaagcugaccagccgcgagaaccuucugcucggcguggggcuggccauggccacgacacugcaacuuccugaagacauugagcagauggcuaauggaaucgcccugggccucaugacccugaaacucauuacacaguuugaaaccuaccagcuguggaccgcucuugugucucugacauguuccaacacgaucuucacccucacagucgccuggcggaccgcgacacugauccuggccggcguuagccuucugccgcucugccaauccucuagcaugagaaagaccgauuggcugcccaugacgguggcugccaugggggugccuccccucccucuguuuauuuucucccuuaaggacacacccaaacgcagaucuuggccucugaaugagggagucauggcugugggccugguuagcauccucgccuccucucugcuucggaacgaugugcccauggccgggccgcuggucgcuggaggccuccugauugcguguuaugugaucaccgggaccagcgccgaccucacaguugagaaggcugccgacgugaccugggaagaggaagccgagcagacaggagucucccauaaccugaugauuacgguggaugacgauggcaccaugcgcaucaaagacgaugaaacagagaauauccuuaccguccugcugaagacagcucuccugauugugagcggcaucuuuccuuacucuauucccgccacccuucugguuuggcacacguggcagaaacagacccaaagauccggggugcucugggacgucccuucucccccggagacacagaaggcggaacuggaggaaggaguguaccggaucaaacagcagggcauuuucgggaagacccaaguuggagugggcguccagaaggaggggguguuucauacaauguggcacgugacccgcggagcuguucucacacacaacggcaaaagacuggagccuaauugggccuccgucaagaaagaucuuaucuccuauggcgggggauggcggcugagcacgcaguggcaaaagggcgaagagguccaggugauugccgucgaacccgggaaaaacccuaagaauuuccagaccaugcccggaaucuuccagacaaccaccggcgagaucggggcuauugcccuggacuuuaagcccggaacaucuggcuccccuaucauuaaccgcgaaggcaaagugguugggcucuacggaaauggcguggucacgaagaacgggggauaugugagcggcaucgcgcaaaccaaugcugagccggaugggcccacaccugagcuggaagaggaaauguucaaaaagagaaaccuuaccauuauggaccugcaucccggcuccggaaaaacacggaaguaccucccugccaucguucgcgaggccaucaagagacggcugagaacccucauucuggcucccacgcgcguggucgccgcugaaauggaggaggcccuuaaaggccugccuauccgguaucagacaaccgcgaccaagagcgaacacacagggagagagauuguggaucugaugugccaugccaccuuuacaaugcgccuccugucuccgguucgggugcccaauuacaaccuuaucauuauggacgaagcucacuucaccgauccugccagcaucgcugccagaggauauaucuccacgcgcgucggcaugggggaggccgcugcgauuuuuaugacagccacacccccuggaacagcugaagccuucccccagucuaaugccccgauccaggacgaggagcgggacauuccugaaagaagcuggaacuccggcaaugaguggaucaccgauuuuguggggaaaacggugugguucguccccucuauuaaggcuggcaacgacaucgccaacugucugcgcaaaaauggaaagaagguuauucaacucagccggaaaaccuuugauacagaauaccagaagaccagacugaacgacugggauuucguggugacaaccgacaucuccgagaugggcgcgaauuuuaaagcugaucgggucaucgacccccgcagaugccugaagccugugauucucacagaugggcccgagcggguuauccuugccggaccuaugccggugaccgccgcuucugccgcgcagcgcagaggccgggucgggagaaacccccagaaagaaaaugaccaauacauuuucacgggacagccucugaacaaugaugaggaccaugcccacuggacagaagcuaagaugcugcucgacaacaucaauacccccgagggcauuaucccugcccuguucgaacccgagcgcgaaaagagcgcugccaucgauggggaauaucggcuuaaaggcgaguccagaaagaccuuuguggaacugaugcgccggggagaccucccgguuuggcuggcucacaaaguggccagcgagggcauuaaguacacagauagaaaauggugcuucgacggggaacgcaacaaucagauccuggaggagaacauggaugucgaaauuuggaccaaggagggagaacggaaaaagcucagaccucgcuggcuugacgcgagaacauauucugauccccuggcccugaaggaguuuaaagacuucgcugccggccggaaguccaucgcuauugaucucgugacggaaaucgggcgcgucccuagccaucuggcccacagaacccggaaugcccuugacaaccuggugaugcuccauacaucugagcacggaggccgcgcuuacagacacgcgguugaggaacugcccgagaccauggaaacacugcuccuucugggccugaugauccuccugaccgggggagccaugcuuuuucugguguccggcaaagggauuggaaagacgaccaucggccucauuugugugaucgucagcuccgggaugcuguggauggcugauauuccucugcaguggaucgccucugccauuguucucgaguucuuuaugauggugcuucugauccccgagccggaaaaacaacggacaccucaggacaaucagcuggcuuauguggucaucggcauucucacccuggccgcgaucguggccgcuaacgagaugggccuucuggaaacaaccaagagagaucucggcaugagcaaggagcccgggguugugucccccacgagcuaccuggacgucgaccugcauccugccucugcuuggacacucuaugccguggcgaccacagucauuaccccgaugcuucgccacaccaucgaaaauuccacagccaacgugagccuggcugccauugcuaaccaagccguugugcugaugggacucgauaaaggcuggcccaucucuaagauggaccugggggucccucuucuggcucucggaugcuacagccaggugaauccccugacgcugaccgccgcgguucuccuucuggugacacauuacgccaucauuggcccugggcugcaggcuaaagccacccgggaggcucagaagagaacagccgccggaaucaugaaaaaccccaccgucgauggcauuaugacgaucgaccucgauccugugauuuaugacuccaaguucgagaagcaacugggccaggugaugcuucugguucucugugcgguccagcugcugcucaugcgcacaucuugggcucuuugcgaagcccugacccuggcuaccgggccgaucacaacccucugggagggaagccccggcaaauuuuggaauacaacgaucgccguguccauggccaacauuuuccgggggucuuaccuggcuggagccggccuugcguuuagcaucaugaaguccguggggaccggaagacggggcacaggcagccagggggaaacccugggagagaaauggaagaaaaagcucaaucaacugucucgcaaggaguucgaucuguauaaaaaguccggcauuacagaggucgacagaaccgaggccaaagaagggcucaagcggggagagacgacccaccaugcuguuagccgcggcuccgccaaacuucagugguuuguggaaagaaacauggugaucccugaggggcgggucauugaucugggauguggccgcggcggguggucuuacuauugcgcuggacugaagaaagugacagaaguuagaggcuacaccaaaggcgggcccgggcacgaggagccugugcccaugagcacauauggguggaauaucgucaagcucauguccggaaaagacguguucuaccugccgccugaaaagugugauacccuucugugcgacauuggcgagucuagccccucccccacaguugaagagagccggaccauccgcgugcucaaaauggucgagccuuggcugaagaacaaucaguucuguaucaaagugcugaaccccuacaugccuacggugauugaacaccucgagagacuucagcggaaguauggcgggaugcuggucagaaauccgcugucucgcaacuccacacaugaaauguacuggaucagcaauggaaccggcaacauuguuucuuccgugaauauggugagccggcuccugcuuaacagauuuaccaugacacaccgccggcccacgaucgagaaggaugucgaccugggggccggaaccagacaugugaacgcggaaccugagacacccaauauggacguuauuggcgagcgcaucaaacggaucaaggaagaacacucuagcaccuggcacuaugaugacgaaaacccuuacaaaacaugggccuaucauggguccuacgaggugaaggcuaccggaucugccagcuccaugauuaauggcgucgugaaacuccugacaaagcccugggauguugugccgauggucacccaaauggcuaugacggacaccacaccuuucggccagcagagaguguuuaaggaaaaaguugauacccgcacaccccggccuaugcccgggaccagaaaggugauggagaucacggccgaguggcuguggcgcacacucggacggaacaaaaagccuagacugugcacccgcgaagaguucaccaagaaggucagaaccaaugcugccaugggcgcgguguuuacggaagagaaccaaugggacagcgcccgggcugccgucgaagaugaggaguucuggaaacuuguggaccgcgaaagagagcugcacaaacucgggaaguguggauccugcguuuauaauaugaugggcaaacgggaaaagaaacugggggaguuuggcaaggcuaaaggaucuagagccauuugguacauguggcuuggcgcccgguuccuggaguuugaagcgcucggguuccugaacgaggaucauugguuuagccgcgaaaauuccuacucuggaguggagggcgaagggcugcacaagcucggauauauccugagagacauuagcaagauccccggcggggcuauguacgccgaugacaccgccggcugggacacacggaucaccgaggaugaccuucauaacgaggagaagauuacacagcagauggauccggagcaccgccagcuggcuaaugccaucuucaagcucaccuaucaaaacaaagucgugaaggugcagagaccuacacccaaaggaaccguuauggacauuaucucccggaaggaucagcgcggcucuggacaggugggaacguacggccugaauacauuuaccaacauggaagcucaacuugucagacagauggagggggaaggagugcugagcaagaccgaccucgagaauccccaucugcuggagaaaaagauuacacaguggcucgaaaacaaaggcguugagcggcugaagcgcauggccaucuccggggaugacugcguggucaaaccuaucgaugacagauucgcgaacgcccuucuggcucucaaugauaugggcaaggugcggaaggacauuccgcaguggcaacccagcaaaggauggcaugauuggcagcaggucccuuucuguucucaccauuuucacgaacugaucaugaaggacggccgcaaacuugugguucccugcagaccucaggacgagcugauugggcgggcccgcaucucccaaggagcuggcuggagccucaaggaaaccgccugucuggggaaagcguaugcccagauguggucucugauguacuuccacagacgggaucucagacuggcuuccaacgccauuugcagcgcugugcccguccauugggugccuacaucucgcacgaccugguccauccacgcccaucaccaguggaugacaaccgaggacaugcuuacaguuuggaaucggguguggauugaggauaaccccuggauggaagacaagaccccggucacgaccugggaggaugugccuuaucugggaaagagagaagaccaaugguguggcagccucaucgggcugacaucccgcgcuaccugggcccagaauauccuuacagcgauucaacaggugcggagccugaucggcgaugaggaguuucucgacuacaugcccucuaugaaaagauuccgcaaggaagaggaaagcgagggagccauuugguga

SEQ ID NO: 20497 - RNA, 9873 nt, Artificial Sequence
  derived and/or modified CDS sequence (opt5) from DENV-3__GQ868626__SS-prME
accagccugugccucaugaugaugcugcccgccacccuugcuuuccaccugacguccagagacggcgagccucggaugaucguggggaagaacgaacgcggaaagucucuccuguuuaagaccgccacaggcauuaauauguguacccuuaucgcgauggaucugggggagaugugcgacgauacagugaccuacaaguguccgcucauugcugaaguugagcccgaagacaucgauugcugguguaaccugacaagcaccugggugacguauggaaccugcaaucaggccggcgagcauagacgggacaagcgcuccguggcccuggcuccucacgucgggaugggacucgauacaagaacccagacauggaugucugccgagggcgcuuggcggcaggucgaaaaaguugagaccugggcccugcgccaucccggcuucacgauucuugcgcuguuucucgcccacuacaucgggacaagccugauccagaagguggucauuuucauccuucugaugcucgugaccccuuccaugacaaugagauguguuggagugggcaaccgggacuuugucgaagggcugucuggagcuaccuggguggaugugguccuggagcauggcgggugcguuaccacaauggccaagaauaaacccacgcucgacauugagcugcagaagaccgaagcuacacagcuugccacccugcgcaaacucuguaucgagggaaagauuacaaacaucaccacggauagcagaugcccuacacagggcgaagcgauucugccggaggaacaggaccagaauuauguguguaaacacaccuacguggaucggggcugggggaacggaugcggccuuuucgggaagggaucccuggugaccugcgccaaguuucagugucucgagcccaucgagggcaaagugguucaguaugaaaaucugaaguacacagugaucauuaccguccacacaggggaccagcaucaggugggaaacgacacgcaaggcguuaccguggagaucacaccucaggcuagcaccgucgaagccgugcugcccgaguauggcacacucgggcuggaaugcucuccucgcaccggacuugauuucaaugagaugauucugcucacgaugaaaaacaaggcuuggaugguccacagacagugguuuuucgaccugccccuuccguggaccuccggcgccacaaucgagaccccuacauggaaucggaaagaacugcucgugaccuuuaagaacgcccaugcuaaaaagcaagagguugugguccuggggagccaggaaggagcgaugcacacggcccugacaggcgcuaccgagauucaaaauucugggggcacauccaucuucgccggacaccucaagugucgccugaaaauggauaaacuugaacugaaaggcaugagcuacgccaugugccucaacaccuuugugcugagaaaggagguuucugagacccagcaugggacaauccugauuaaaguggaauacaagggagaggacgcucccuguaagaucccuuucuccacggaagauggccaagggaaagcccacaacggacggcuuauuaccgcgaaucccgucgugacaaagaaagaggagcccgugaacaucgaagcugagccuccguucggcgaaagcaauauuguuaucgggaucggcgacaaggcccucaaaauuaacugguauaagaagggauccucuaucggcaaaauguuugaggccaccgcuagaggggcccgccggauggcuauucugggagauacagccugggacuucggcagcgucgggggagugcugaauagccucggcaagauggugcaucagaucuuugggagcgcguacaccgcccuguucucuggcgucuccuggauuaugaaaaucggaauuggcgugcuucugacguggaucgggcucaacagcaagaauacaucuaugagcuuuuccugcaucguuauuggaaucauuacccuguaucugggcgcugugguccaggccgauauggggugugugaucaacuggaaaggaaaggaacuuaagugcggcucugggauuuucguuaccaaugaggugcacacauggaccgagcaguacaaauuucaagcugacagccccaagagacucgccacagcgaucgccggcgcuugggaaaacggagucuguggcauccgcuccacgacccggauggagaaucugcuguggaaacagauugccaacgaacucaauuauauccugugggagaacaauauuaaacuuacagugguugugggggauaucauuggaguccuggaacagggcaaaagaacccucacaccucagcccauggagcugaaguacagcuggaaaaccugggggaaggcuaagaucgugacggccgagacccaaaacucuuccuucaucauugacggaccuaacacacccgaaugcccgagcgccucucgcgcuuggaaugugugggaggucgaagacuauggcuuuggcguuuucaccacaaacaucuggcugaaacuucgggagguguacacccaguccugugaucauagacucaugagcgcggccauuaaggacgaacgcgcugugcacgccgauaugggguacuggaucgagucccagaaaaauggaucuuggaagcuggagaaagccagcuuuauugaagucaagacaugcaccuggccuaagucccacacgcuguggucuaacggcgugcucgagagcgacaugaucauccccaaaucccuggcugggccuauuagccagcauaaucaccggcccggauaucauacacaaaccgccggcccuuggcaccuugggaagcuggaacucgauuucaacuacugcgagggaaccacaguugugaucaccgagaauuguggcacgagaggccccucucugcgcacaaccacagucuccgggaaacugauucacgaauggugcugucggagcugcacccuuccgccucucagauauaugggagaggacggcuguugguacgggauggaaauccggcccauuaacgagaaggaagagaauauggugaaaucucugguuuccgcgggaagcggcaagguggauaacuuuacaauggggguccugugccucgcuauccuguucgaggaagugaugcgcggaaaguucggcaaaaagcauaugauugccggcguucuuuuuaccuucgugcugcuccugucugggcagaucacguggagagacauggcccacacccugaucaugauuggaagcaaugcuuccgaucggaugggcaugggggucacauaucuugcccugaucgcgaccuuuaaaauucagcccuuccucgcucugggauuuuuccucagaaagcugacaagccgcgagaaccuucugcucggcguggggcuggccauggccaccacgcugcaacuuccugaagacaucgagcagauggcuaauggaauugcccugggccucaugacacugaaacucaucacccaguuugaaacauaccagcuguggaccgcucuugugucucugaccuguuccaacacaaucuucacgcucaccgucgccuggcggacagcgacccugauucuggccggcguuagccuucugccgcucugccaauccucuagcaugagaaagacagauuggcugcccaugaccguggcugccaugggggugccuccccucccucuguuuaucuucucccuuaaggacacgcccaaacgcagaucuuggccucugaaugagggagucauggcugugggccugguuagcauucucgccuccucucugcuucggaacgaugugcccauggccgggccgcuggucgcuggaggccuccugaucgcguguuaugugauuacagggaccagcgccgaccucaccguugagaaggcugccgacgugacaugggaagaggaagccgagcagaccggagucucccauaaccugaugaucacaguggaugacgauggcacgaugcgcaucaaagacgaugaaaccgagaauauucuuacaguccugcugaagaccgcucuccugaucgugagcggcauuuuuccuuacucuauccccgccacacuucugguuuggcacaccuggcagaaacagacgcaaagauccggggugcucugggacgucccuucucccccggagacccagaaggcggaacuggaggaaggaguguaccggauuaaacagcagggcaucuucgggaagacacaaguuggagugggcguccagaaggaggggguguuucauaccauguggcacgugacacgcggagcuguucucacccacaacggcaaaagacuggagccuaauugggccuccgucaagaaagaucuuauuuccuauggcgggggauggcggcugagcacacaguggcaaaagggcgaagagguccaggugaucgccgucgaacccgggaaaaacccuaagaauuuccagacgaugcccggaaucuuccagaccacaaccggcgagauuggggcuaucgcccuggacuuuaagcccggaaccucuggcuccccuauuaucaaccgcgaaggcaaagugguugggcucuacggaaauggcguggucacaaagaacgggggauaugugagcggcauugcgcaaacgaaugcugagccggaugggcccaccccugagcuggaagaggaaauguucaaaaagagaaaccuuacaaucauggaccugcaucccggcuccggaaaaacccggaaguaccucccugccaucguucgcgaggccauuaagagacggcugagaacacucauccuggcucccacccgcguggucgccgcugaaauggaggaggcccuuaaaggccugccuauucgguaucagacgacagcgaccaagagcgaacacaccgggagagagaucguggaucugaugugccaugccacauuuaccaugcgccuccugucuccgguucgggugcccaauuacaaccuuauuaucauggacgaagcucacuucacagauccugccagcaucgcugccagaggauauauuuccacccgcgucggcaugggggaggccgcugcgaucuuuaugacggccacacccccuggaaccgcugaagccuucccccagucuaaugccccgauucaggacgaggagcgggacaucccugaaagaagcuggaacuccggcaaugaguggauuacagauuuuguggggaaaaccgugugguucguccccucuaucaaggcuggcaacgacauugccaacugucugcgcaaaaauggaaagaagguuauccaacucagccggaaaacguuugauaccgaauaccagaagacaagacugaacgacugggauuucguggugaccacagacaucuccgagaugggcgcgaauuuuaaagcugaucgggucauugacccccgcagaugccugaagccugugauccucaccgaugggcccgagcggguuauucuugccggaccuaugccggugacagccgcuucugccgcgcagcgcagaggccgggucgggagaaacccccagaaagaaaaugaccaauacaucuucaccggacagccucugaacaaugaugaggaccaugcccacuggacggaagcuaagaugcugcucgacaacauuaauacacccgagggcaucaucccugcccuguucgaacccgagcgcgaaaagagcgcugccauugauggggaauaucggcuuaaaggcgaguccagaaagaccuuuguggaacugaugcgccggggagaccucccgguuuggcuggcuuacaaaguggccagcgagggcaucaaguauaccgauagaaaauggugcuucgacggggaacgcaacaaucagauucuggaggagaacauggaugucgaaaucuggacaaaggagggagaacggaaaaagcucagaccucgcuggcuugacgcgagaaccuacucugauccccuggcccugaaggaguuuaaagacuucgcugccggccggaaguccauugcucucgaucuggugacagaaaucgggcgcgucccuagccaccuugcccauagaacgcggaaugcccuggacaaccucgugaugcugcacaccucugagcauggaggccgcgcuuauagacacgcgguugaggaacugcccgagacaauggaaacccuccuucugcugggccucaugauccugcuuacagggggagccaugcuguuucucauuuccggcaaagggaucggaaagaccacgauuggccugaucugugugauugugagcuccgggaugcuguggauggcugauaucccucuccaguggauugccucugccaucguccuugaguucuuuaugaugguucugcugauccccgagccggaaaaacaacggaccccucaggacaaucagcucgcuuacguggugauuggaauccugacacuugccgcgauugucgccgcuaacgagaugggccugcucgaaaccacaaagagagaucugggcaugagcaaggagcccggggugguuucccccaccagcuaucuggacguggaccuccacccugccucugcuuggacgcuuuacgccgucgcgacaaccgugaucacaccgaugcugcgccauaccauugaaaauuccaccgccaacgucagccuggcugccaucgcuaaccaagccgugguucucaugggacuggauaaaggcuggcccaucucuaagauggaccuuggggugccucugcucgcucugggaugcuacagccaggucaauccccugacacucacggccgcggugcuucugcugguuacccacuaugccauuaucggcccugggcuccaggcuaaagccacacgggaggcucagaagagaaccgccgccggaauuaugaaaaaccccacaguggauggcaucaugaccauugaccuggauccugucaucuacgacuccaaguucgagaagcaacuuggccaggugaugcugcucgugcugugugcgguucagcugcuccuuaugcgcacgucuugggcucugugcgaagcccugacacucgcuaccgggccgaucaccacacugugggagggaagccccggcaaauuuuggaauaccacaauugccgucuccauggccaacaucuuccgggggucuuaucuugcuggagccggccuggcguuuagcauuaugaaguccguggggacgggaagacggggcaccggcagccagggggaaacacucggagagaaauggaagaaaaagcugaaucaacugucucgcaaggaguucgaucucuacaaaaaguccggcaucaccgagguggacagaacagaggccaaagaagggcuuaagcggggagagaccacgcaucacgcugucagccgcggcuccgccaaacugcagugguuuguugaaagaaacauggugauuccugaggggcgggugaucgaucugggauguggccgcggcggguggucuuauuacugcgcuggacucaagaaagucaccgaagugagaggcuauacaaaagggggacccggccaugaggagccuguucccaugagcaccuacggguggaauauugugaagcugauguccggaaaagacgucuucuaccuuccgccugaaaagugugauacacugcucugcgacaucggcgagucuagccccucccccaccguggaagagagccggacaauccgcguucugaaaaugguggagccuuggcugaagaacaaucaguucuguauuaaaguccucaaccccuauaugccuaccgugaucgaacaccuugagagacugcagcggaaguacggcgggaugcuggugagaaauccgcucucucgcaacuccacgcacgaaauguauuggauuagcaauggaacaggcaacaucgucucuuccguuaauauggugagccggcugcuucugaacagauuuaccaugacccaucgccggcccacaauugagaaggauguggaccucggggccggaacgagacacgucaacgcggaaccugagacccccaauauggacgugaucggcgagcgcaucaaacggauuaaggaagaacacucuagcacauggcacuacgaugacgaaaacccuuauaaaaccugggccuaccacggguccuaugagguuaaggcuacaggaucugccagcuccaugaucaauggcguggucaaacugcugaccaagcccugggaugugguuccgauggugacacaaauggcuaugaccgacacgaccccuuucggccagcagagagucuuuaaggaaaaaguggauacacgcacaccccggccuaugcccgggacaagaaagguuauggagauuaccgccgaguggcucuggcgcacgcugggacggaacaaaaagccuagacuuugcacacgcgaagaguucaccaaaaaggugagaacaaaugcugccaugggcgcggucuuuaccgaagagaaccaaugggacagcgcccgggcugccguggaagaugaggaguucuggaagcuggucgaccgcgaaagagagcuccauaaacuggggaaguguggauccugcguguacaauaugaugggcaaacgggaaaagaaacuuggggaguuuggcaaggcuaaaggaucuagagccaucugguacauguggcugggcgcccgguuccucgaguuugaagcgcugggguuccugaacgaggaucacugguuuagccgcgaaaauuccuauucuggaguugagggcgaagggcuccauaagcugggauacauucuuagagacaucagcaagauccccggcggggcuauguaugccgaugacacggccggcugggacacccggauuacagaggaugaccugcacaacgaggagaagaucacccagcagauggauccggagcaucgccagcucgcuaaugccauuuucaagcugacauaccaaaacaaaguggucaaggugcagagaccuacccccaaaggaacagugauggacaucauuucccggaaggaucagcgcggcucugggcagguuggaaccuauggccuuaauacguuuacaaacauggaagcucaacuggugagacagauggagggggaaggaguccucagcaaggccgaccuggagaauccccaucugcucgagaaaaagaucacccaguggcuggaaaacaaaggcguggagcggcuuaagcgcauggcgaucuccggggaugacugcguugugaaaccuauugaugacagauucgccaacgcucugcucgcccugaaugauaugggcaagguccggaaggacaucccgcaguggcaacccagcaaaggauggcacgauuggcaacaggugccuuucuguucucaucacuuucaugaacuuauuaugaaggacggccgcaaacuggucgugcccugcagaccucaggacgagcucaucgggcgggcucgcauuucccaaggagccggcuggagccugaaggaaaccgcgugucuggggaaagccuacgcucagauguggucucucauguauuuccacagacgggaucugagacuugccuccaacgcuaucugcagcgccguucccgugcacugggucccuacaucucgcaccacaugguccauucaugcucaccaucaguggaugacgaccgaggacaugcuggccguguggaaucggguuuggaucgaggauaaccccuggauggaagacaagacaccggugaccacaugggaggaugucccuuaccucggaaagagagaagaccaaugguguggcagccugaucgggcuuaccucccgcgcgacgugggcccagaauauucugaccgcuauccaacaggugcggagccucauuggcgaugaggaguuucuggacuacaugcccucuaugaaaagauuccgcaaggaagaggaaagcgagggagccaucugguga

SEQ ID NO: 20498 - RNA, 9873 nt, Artificial Sequence
  derived and/or modified CDS sequence (opt5) from DENV-3__GQ868627__SS-prME
accagccugugccucaugaugaugcugcccgccacacuugcuuuccaccugacgucccgggacggagagccucggaugaucguggggaagaacgaacgcggaaagucucuccuguuuaagaccgccaccggcauuaauauguguacccuuaucgcgauggaucugggggagaugugcgacgauacagucaccuacaaauguccgcucauugcugaaguugagcccgaagacaucgauugcugguguaaccugacaagcaccugggugacguauggaaccugcaaucaggccggcgagcauagacgggacaagcgcuccguggcccuggcuccucacgucgggaugggacucgauacaagaacccagacauggaugucugccgagggcgcuuggagacagguggaaaaaguugagaccugggcccugcgccaucccggcuucacgauucuugcgcuguuucucgcccacuacaucgggacaagccugauccagaagguggucauuuucauccuucugaugcucgugaccccuuccaugacaaugagauguguuggagugggcaaccgggacuuugucgaagggcugucuggagcuaccuggguggaugugguccuggagcauggcgggugcguuaccacaauggccaagaauaaacccacgcucgacauugagcugcagaagaccgaagcuacacagcuugccacccugcgcaaacucuguaucgagggaaagauuacaaacaucaccacggauagcagaugcccuacacagggcgaagcgauucugccggaggaacaggaccagaauuauguguguaaacacaccuacguggaucggggcugggggaacggaugcggccuuuucgggaagggaucccuggugacaugcgccaaguuucagugucucgagcccaucgagggcaaagugguucaguaugaaaaucugaaguacacagugaucauuaccguccacacaggggaccagcaucaggugggaaacgacacgcaaggcguuaccguggagaucacaccucaggcuagcaccgucgaagccgugcugcccgaguauggcacacucgggcuggaaugcucuccucgcaccggacuugauuucaaugagaugauucugcucacgaugaaaaacaaggcuuggaugguccacagacagugguuuuucgaccugccccuuccguggaccuccggcgccacaaccgagacaccuaccuggaaucggaaagaacugcucgugacguuuaagaacgcccaugcuaaaaagcaagagguugugguccuggggagccaggaaggagcgaugcacacagcccugaccggcgcuacagagauccaaaauucugggggcaccuccauuuucgccggacaccucaagugucgccugaaaauggauaaacuugaacugaaaggcaugagcuacgccaugugccucaacaccuuugugcugagaaaggagguuucugagacacagcaugggacgauccugaucaaaguggaauacaagggagaggacgcucccuguaagauuccuuucuccaccgaagauggccaagggaaagcccacaacggacggcuuaucacagcgaaucccgucgugaccaagaaagaggagcccgugaacauugaagcugagccuccguucggcgaaagcaauaucguuauugggaucggcgacaaggcccucaaaaucaacugguauaagaagggauccucuauuggcaaaauguuugaggccacagcuagaggggcccgccggauggcuauccugggagauaccgccugggacuucggcagcgucgggggagugcugaauagccucggcaagauggugcaucagauuuuugggagcgcguacacggcccuguucucuggcgucuccuggaucaugaaaauuggaaucggcgugcuucugacauggauugggcucaacagcaagaauaccucuaugagcuuuuccugcaucguuaucggaauuaucacccuguaucugggcgcugugguccaggccgauauggggugugugauuaacuggaaaggaaaggaacuuaagugcggcucugggaucuucguuacaaaugaggugcacaccuggacagagcaguacaaauuucaagcugacagccccaagagacucgccacggcgauugccggcgcuugggaaaacggagucuguggcauccgcuccaccacacggauggagaaucugcuguggaaacagaucgccaacgaacucaauuauauucugugggagaacaauaucaaacuuaccgugguugugggggauauuaucggaguccuggaacagggcaaaagaacacucaccccucagcccauggagcugaaguacagcuggaaaacgugggggaaggcuaagauugugaccgccgagacacaaaacucuuccuucaucaucgacggaccuaacacccccgaaugcccgagcgccucucgcgcuuggaaugugugggaggucgaagacuauggcuuuggcguuuucacaaccaacauuuggcugaaacuucgggagguguacacacaguccugugaucauagacucaugagcgcggccaucaaggacgaacgcgcugugcacgccgauaugggguacuggauugagucccagaaaaauggaucuuggaagcuggagaaagccagcuuuaucgaagucaagaccugcacguggccuaagucccacacacuguggucuaacggcgugcucgagagcgacaugauuauccccaaaucccuggcugggccuaucagccagcauaaucaccggcccggauaucauacccaaaccgccggcccuuggcaccuugggaagcuggaacucgauuucaacuacugcgagggaacaaccguugugauuacggagaauuguggcacaagaggccccucucugcgcaccacaaccgucuccgggaaacugauccacgaauggugcugucggagcugcacacuuccgccucucagauauaugggagaggacggcuguugguacgggauggaaauucggcccaucaacgagaaggaagagaauauggugaaaucucugguuuccgcgggaagcggcaagguggauaacuuuaccauggggguccugugccucgcuauucuguucgaggaagugaugcgcggaaaguucggcaaaaagcauaugaucgccggcguucuuuuuacguucgugcugcuccugucugggcagauuaccuggagagacauggcccacacacugaucaugaucggaagcaaugcuuccgaucggaugggcaugggggucaccuaucuugcccugauugcgacauuuaaaauccagcccuuccucgcucugggauuuuuccucagaaagcugaccagccgcgagaaccuucugcucggcguggggcuggccauggccacgacacugcaacuuccugaagacauugagcagauggcuaauggaaucgcccugggccucaugacccugaaacucauuacacaguuugaaaccuaccagcuguggaccgcucuugugucucugacauguuccaacacgaucuucacccucacagucgccuggcggaccgcgacacugauccuggccggcguuagccuucugccgcucugccaauccucuagcaugagaaagaccgauuggcugcccaugacgguggcugccaugggggugccuccccucccucuguuuauuuucucccuuaaggacacacccaaacgcagaucuuggccucugaaugagggagucauggcugugggccugguuagcauccucgccuccucucugcuucggaacgaugugcccauggccgggccgcuggucgcuggaggccuccugauugcguguuaugugaucaccgggaccagcgccgaccucacaguugagaaggcugccgacgugaccugggaagaggaagccgagcagacaggagucucccauaaccugaugauuacgguggaugacgauggcaccaugcgcaucaaagacgaugaaacagagaauauccuuaccguccugcugaagacagcucuccugauugugagcggcaucuuuccuuacucuauucccgccacccuucugguuuggcacacguggcagaaacagacccaaagauccggggugcucugggacgucccuucucccccggagacacagaaggcggaacuggaggaaggaguguaccggaucaaacagcagggcauuuucgggaagacccaaguuggagugggcguccagaaggaggggguguuucauacaauguggcacgugacccgcggagcuguucucacacacaacggcaaaagacuggagccuaauugggccuccgucaagaaagaucuuaucuccuauggcgggggauggcggcugagcacgcaguggcaaaagggcgaagagguccaggugauugccgucgaacccgggaaaaacccuaagaauuuccagaccaugcccggaaucuuccagacaaccaccggcgagaucggggcuauugcccuggacuuuaagcccggaacaucuggcuccccuaucauuaaccgcgaaggcaaagugguugggcucuacggaaauggcguggucacgaagaacgggggauaugugagcggcaucgcgcaaaccaaugcugagccggaugggcccacaccugagcuggaagaggaaauguucaaaaagagaaaccuuaccauuauggaccugcaucccggcuccggaaaaacacggaaguaccucccugccaucguucgcgaggccaucaagagacggcugagaacccucauucuggcucccacgcgcguggucgccgcugaaauggaggaggcccuuaaaggccugccuauccgguaucagacaaccgcgaccaagagcgaacacacagggagagagauuguggaucugaugugccaugccaccuuuacaaugcgccuccugucuccgguucgggugcccaauuacaaccuuaucauuauggacgaagcucacuucaccgauccugccagcaucgcugccagaggauauaucuccacgcgcgucggcaugggggaggccgcugcgauuuuuaugacagccacacccccuggaacagcugaagccuucccccagucuaaugccccgauccaggacgaggagcgggacauuccugaaagaagcuggaacuccggcaaugaguggaucaccgauuuuguggggaaaacggugugguucguccccucuauuaaggcuggcaacgacaucgccaacugucugcgcaaaaauggaaagaagguuauucaacucagccggaaaaccuuugauacagaauaccagaagaccagacugaacgacugggauuucguggugacaaccgacaucuccgagaugggcgcgaauuuuaaagcugaucgggucaucgacccccgcagaugccugaagccugugauucucacagaugggcccgagcggguuauccuugccggaccuaugccggugaccgccgcuucugccgcgcagcgcagaggccgggucgggagaaacccccagaaagaaaaugaccaauacauuuucacgggacagccucugaacaaugaugaggaccaugcccacuggacagaagcuaagaugcugcucgacaacaucaauacccccgagggcauuaucccugcccuguucgaacccgagcgcgaaaagagcgcugccaucgauggggaauaucggcuuaaaggcgaguccagaaagaccuuuguggaacugaugcgccggggagaccucccgguuuggcuggcuuacaaaguggccagcgagggcauuaaguauacagauagaaaauggugcuucgacggggaacgcaacaaucagauccuggaggagaacauggaugucgaaauuuggaccaaggagggagaacggaaaaagcucagaccucgcuggcuugacgcgagaacauacucugauccccuggcccugaaggaguuuaaagacuucgcugccggccggaaguccaucgcucucgaucuggugacggaaauugggcgcgucccuagccaccuugcccauagaacccggaaugcccuggacaaccucgugaugcugcacacaucugagcauggaggccgcgcuuauagacacgcgguugaggaacugcccgagaccauggaaacacuccuucugcugggccucaugauccugcuuaccgggggagccaugcuguuucucaucuccggcaaagggauuggaaagacgaccaucggccugauuugugugaucgugagcuccgggaugcuguggauggcugauauuccucuccaguggaucgccucugccauuguccuugaguucuuuaugaugguucugcugauccccgagccggaaaaacaacggacaccucaggacaaucagcucgcuuacguggugaucggcauucugacccuugccgcgaucgucgccgcuaacgagaugggccugcucgaaacaaccaagagagaucugggcaugagcaaggagcccggggugguuucccccacgagcuaucuggacguggaccuccacccugccucugcuuggacacuuuacgccgucgcgaccacagugauuaccccgaugcugcgccauaccaucgaaaauuccacagccaacgucagccuggcugccauugcuaaccaagccgugguucucaugggacuggauaaaggcuggcccaucucuaagauggaccuuggggugccucugcucgcucugggaugcuacagccaggucaauccccugacgcucaccgccgcggugcuucugcugguuacacacuaugccaucauuggcccugggcuccaggcuaaagccacccgggaggcucagaagagaacagccgccggaaucaugaaaaaccccaccguggauggcauuaugacgaucgaccuggauccugucauuuacgacuccaaguucgagaagcaacuuggccaggugaugcugcucgugcugugugcgguucagcugcuccuuaugcgcacaucuugggcucugugcgaagcccugacccucgcuaccgggccgaucacaacccugugggagggaagccccggcaaauuuuggaauacaacgaucgccgucuccauggccaacauuuuccgggggucuuaucuugcuggagccggccuggcguuuagcaucaugaaguccguggggaccggaagacggggcacaggcagccagggggaaacccucggagagaaauggaagaaaaagcugaaucaacugucucgcaaggaguucgaucucuacaaaaaguccggcauuacagagguggacagaaccgaggccaaagaagggcuuaagcggggagagacgacccaucacgcugucagccgcggcuccgccaaacugcagugguuuguugaaagaaacauggugaucccugaggggcgggugauugaucugggauguggccgcggcggguggucuuauuacugcgcuggacucaagaaagucacagaagugagaggcuauaccaaagggggacccggccaugaggagccuguucccaugagcacauacggguggaauaucgugaagcugauguccggaaaagacgucuucuaccuuccgccugaaaagugugauacccugcucugcgacauuggcgagucuagccccucccccacaguggaagagagccggaccauccgcguucugaaaaugguggagccuuggcugaagaacaaucaguucuguaucaaaguccucaaccccuauaugccuacggugauugaacaccuugagagacugcagcggaaguacggcgggaugcuggugagaaauccgcucucucgcaacuccacacacgaaauguauuggaucagcaauggaaccggcaacauugucucuuccguuaauauggugagccggcugcuucugaacagauuuaccaugacacaucgccggcccacgaucgagaaggauguggaccucggggccggaaccagacacgucaacgcggaaccugagacacccaauauggacgugauuggcgagcgcaucaaacggaucaaggaagaacacucuagcaccuggcacuacgaugacgaaaacccuuauaaaacaugggccuaccacggguccuaugagguuaaggcuaccggaucugccagcuccaugauuaauggcguggucaaacugcugacaaagcccugggaugugguuccgauggugacccaaauggcuaugacggacaccacaccuuucggccagcagagagucuuuaaggaaaaaguggauacccgcacaccccggccuaugcccgggaccagaaagguuauggagaucacggccgaguggcucuggcgcacacugggacggaacaaaaagccuagacuuugcacccgcgaagaguucaccaagaaggugagaaccaaugcugccaugggcgcggucuuuacggaagagaaccaaugggacagcgcccgggcugccguggaagaugaggaguucuggaagcuggucgaccgcgaaagagagcuccauaaacuggggaaguguggauccugcguguacaauaugaugggcaaacgggaaaagaaacuuggggaguuuggcaaggcuaaaggaucuagagccauuugguacauguggcugggcgcccgguuccucgaguuugaagcgcugggguuccugaacgaggaucacugguuuagccgcgaaaauuccuauucuggaguugagggcgaagggcuccauaagcugggauacauccuuagagacauuagcaagauccccggcggggcuauguaugccgaugacaccgccggcugggacacacggaucaccgaggaugaccugcacaacgaggagaagauuacacagcagauggauccggagcaucgccagcucgcuaaugccaucuucaagcugaccuaccaaaacaaaguggucaaggugcagagaccuacacccaaaggaaccgugauggacauuaucucccggaaggaucagcgcggcucugggcagguuggaacguauggccuuaauacauuuaccaacauggaagcucaacuggugagacagauggagggggaaggaguccucagcaaggccgaccuggagaauccccaucugcucgagaaaaagauuacccaguggcuggaaaacaaaggcguggagcggcuuaagcgcauggcgaucuccggggaugacugcguugugaaaccuaucgaugacagauucgccaacgcucugcucgcccugaaugauaugggcaagguccggaaggacauuccgcaguggcaacccagcaaaggauggcacgauuggcaacaggugccuuucuguucucaucacuuucaugaacuuaucaugaaggacggccgcaaacuggucgugcccugcagaccucaggacgagcucauugggcgggcucgcaucucccaaggagccggcuggagccugaaggaaacagcgugucuggggaaagccuacgcucagauguggucucucauguauuuccacagacgggaucugagacuugccuccaacgcuauuugcagcgccguucccgugcacugggucccuaccucucgcacaacgugguccauccaugcucaccaucaguggaugaccacagaggacaugcuggccguguggaaucggguuuggauugaggauaaccccuggauggaagacaagaccccggugacaaccugggaggaugucccuuaccucggaaagagagaagaccaaugguguggcagccugaucgggcuuacgucccgcgcgaccugggcccagaauauccugacagcuauucaacaggugcggagccucaucggcgaugaggaguuucuggacuacaugcccucuaugaaaagauuccgcaaggaagaggaaagcgagggagccauuugguga

SEQ ID NO: 20499 - RNA, 9873 nt, Artificial Sequence
  derived and/or modified CDS sequence (opt5) from DENV-3__FJ639721__SS-prME
accagccugugccucaugaugaugcugcccgccacacuugcuuuccaccugacgucccgggacggcgaaccucggaugaucguggggaagaacgaacgcggaaagucucuccuguuuaagaccgccaccggcauuaauauguguacccuuaucgcgauggaucugggggaaaugugcgacgauacagugaccuacaaguguccgcucauuguugaaguggagcccgaagacaucgauugcugguguaaccugacaagcaccugggugacguauggaaccugcaaucaggcuggcgagcacagacgggacaagcgcuccgucgcccuggccccucacguggggaugggacucgauacaagaacccagacauggaugucugcugagggcgccuggcggcagguugaaaagguggagaccugggcucugcgccaucccggcuucacgauucuugcccuguuucucgcgcacuacaucgggacaagccugauccagaaggucgugauuuucauccuucugaugcucguuaccccuuccaugacaaugagaugugugggagucggcaaccgggacuuuguggaagggcugucuggagccaccuggguggaugucguucuggagcauggcgggugcgugaccacaauggcuaagaauaaacccacgcucgacauugagcugcagaagaccgaagccacacagcuugcuacccugcgcaaacucuguaucgagggaaagauuacaaacaucaccacggauagcagaugcccuacacagggcgaagccauucugccggaggaacaggaccagaauuauguguguaaacacaccuacgucgaucggggcugggggaacggaugcggccuuuucgggaagggaucccuggugaccugcgcgaaguuucaaugucucgagcccaucgagggcaaaguugugcaguaugaaaaucugaaguacacagucaucauuaccgugcacacaggggaccagcaucagguuggaaacgacacgcaaggcgugaccgucgagaucacaccucaggccagcaccguggaagcuguccugcccgaguauggcacacucgggcuggaaugcucuccucgcaccggacuugauuucaaugagaugauucugcucacgaugaaaaacaaggccuggauggugcacagacagugguuuuucgaccugccccuuccguggaccuccggcgcuacaaccgagacaccuaccuggaaucggaaagaacugcucguuacguuuaagaacgcccaugccaaaaagcaagagguggucgugcuggggagccaggaaggagcuaugcacacagcgcugaccggcgccacagagauccaaaauucugggggcaccuccauuuucgcuggacaccucaagugucgccugaaaauggauaaacuugaacugaaaggcaugagcuacgccaugugccucaacaccuuuguucugaagaaagaggugucugagacacagcaugggacgauccugaucaaggucgaauacaagggagaggacgcccccuguaaaauuccuuucuccaccgaagauggccaagggaaggcucacaacggaagacuuaucacagccaaucccguggugaccaaaaaggaggagcccguuaacauugaagcggagccuccguucggcgaaagcaauaucgucauugggaucggcgacaaagcucucaagaucaacugguauaagaaaggauccucuauuggcaagauguuugaggccacagccagaggggcuagacgcauggccauccugggagauaccgcuugggacuucggcagcgucgggggagugcugaauagccucggcaaaaugguccaucagauuuuugggagcgccuacacggcgcuguucucuggcguguccuggaucaugaagauuggaaucggcguucuucugacauggauugggcucaacagcaaaaauaccucuaugagcuuuuccugcaucgugaucggaauuaucacccuguaucugggcgccgucgugcaggcugauaugggguguguuauuaacuggaagggaaaggaacuuaaaugcggcucugggaucuucgugacaaaugagguccacaccuggacagagcaguacaaguuucaagccgacagccccaaacggcucgcuacggccauugcgggcgccugggaaaacggaguguguggcaucagauccaccacacgcauggagaaucugcuguggaagcagaucgcuaacgaacucaauuauauucugugggagaacaauaucaaacuuaccguuguggucggggauauuaucggagugcuggaacagggcaagcggacacucaccccucagcccauggagcugaaauacagcuggaagacgugggggaaggccaaaauugugaccgcugagacacaaaacucuuccuucaucaucgacggaccuaacacccccgaaugcccgagcgccucuagagccuggaaugucugggagguugaagacuauggcuuuggcguguucacaaccaacauuuggcugaaacuucgcgagguguacacacaguccugugaucaucggcucaugagcgcugcgaucaaagacgaaagagccguccacgcugauaugggguacuggauugagucccagaagaauggaucuuggaaacuggagaaggccagcuuuaucgaagugaagaccugcacguggccuaaaucccacacacuguggucuaacggcguucucgagagcgacaugauuauccccaagucccuggccgggccuaucagccagcauaaucaccgccccggauaucauacccaaaccgcuggcccuuggcaccuugggaaacuggaacucgauuucaacuacugcgagggaacaaccguggucauuacggagaauuguggcacacggggccccucucugagaaccacaaccguguccgggaagcugauccacgaauggugcugucgcagcugcacacuuccgccucuccgguauaugggagaggacggcuguugguacgggauggaaauuagacccaucaacgagaaagaagagaauaugguuaagucucugguguccgccggaagcggcaaggucgauaacuuuaccaugggggugcugugccucgcgauucuguucgaggaaguuaugcggggaaaauucggcaagaaacauaugaucgcuggcgugcuuuuuacguucguccugcuccugucugggcagauuaccuggcgcgacauggcccacacacugaucaugaucggaagcaaugccuccgauagaaugggcaugggggugaccuaucuugcucugauugccacauuuaagauccagcccuuccucacccugggauuuuuccuccggaaacugacgagcagagagaaccuucugcucggcguggggcuggcgauggcuacaacccugcaacuuccugaagacauugagcagauggccaauggaaucgcccugggccucaugacacugaagcucauuacccaguuugaaaccuaccagcuguggacagcucuugucucucugacguguuccaacaccaucuucacacucaccguugccuggcgcacagcuacccugauccuggccggcgugagccuucugccgcucugccaauccucuagcaugcggaagacggauuggcugcccaugacaguggcggccaugggggucccuccccucccucuguuuauuuucucccuuaaagacgcucccaagagacgcucuuggccucugaaugagggagugauggccguuggccuggugagcauccucgcuuccucucugcuuagaaacgauguccccauggccgggccgcugguggccggaggccuccugauugcuuguuauguuaucaccgggaccagcgcggaccucacaguggagaaagccgcugacgucaccugggaagaggaagccgagcagacaggagugucccauaaccugaugauuacggucgaugacgauggcaccaugcggaucaaggacgaugaaacagagaauauccuuaccgugcugcugaaaacagcccuccugauuguuagcggcaucuuuccuuacucuauucccgcuacccuucugguguggcacacguggcagaagcagacccaacgcuccgggguccucugggacgugccuucucccccggagacacagaaagccgaacuggaggaaggaguuuacagaaucaagcagcagggcauuuucgggaagacccaagugggagucggcgugcagaaagaggggguguuucauacaauguggcacguuacccggggagcgguccucacacacaacggcaagcgccuggagccuaauugggcuuccgugaaaaaggaucuuaucuccuauggcgggggauggagacugagcacgcaguggcaaaaaggcgaagaggugcaggucauugccguggaacccgggaagaacccuaagaauuuccagaccaugcccggaaucuuccagacaaccaccggcgagaucggggccauugcucuggacuuuaaacccggaacaucuggcuccccuaucauuaaccgggaaggcaagguuguggggcucuacggaaauggcgucgugacgaaaaacgggggauauguuagcggcaucgcccaaaccaaugcggagccggaugggcccacaccugagcuggaagaggaaauguucaagaaacgcaaccuuaccauuauggaccugcaucccggcuccggaaagacaagaaaguaccucccugcuaucgugcgggaggccaucaaacgcagacugcggacccucauucuggcccccacgagagucguggcugccgaaauggaggaggcucuuaagggccugccuauccgcuaucagacaaccgccaccaaaagcgaacacacagggcgggagauuguugaucugaugugccaugcgaccuuuacaaugagacuccugucuccggugcgcguccccaauuacaaccuuaucauuauggacgaagcccacuucaccgauccugcuagcaucgccgcucggggauauaucuccacgagagugggcaugggggaggccgccgcuauuuuuaugacagcgacacccccuggaacagccgaggcuuucccccagucuaaugccccgauccaggacgaggagcgcgacauuccugaacggagcuggaacuccggcaaugaguggaucaccgauuuuguggggaagacggucugguucguucccucuauuaaagccggcaacgacaucgcuaacugucugagaaagaauggaaagaaagugauucaacucagccgcaagaccuuugauacagaauaccagaaaacccggcugaacgacugggauuucguggucacaaccgacaucuccgagaugggcgccaauuuuaaggcggauagagugaucgacccccggcgcugccugaaaccuguuauucucacagaugggcccgagagagugauccuugcuggaccuaugccggucaccgccgccucugcugcccagcggcgcggcagaguggggcggaacccccagaaggaaaaugaccaauacauuuucacgggacagccucugaacaaugaugaggaccaugcgcacuggacagaagccaagaugcugcucgacaacaucaauacccccgagggcauuaucccugcucuguucgaacccgagagagagaaaagcgccgcuaucgauggggaauaucgccuuaagggcgagucccggaaaaccuuuguugaacugaugagacgcggagaccucccgguguggcuggcccacaaggucgcuagcgagggcauuaaauacacagaucggaaguggugcuucgacggggaaagaaacaaucagauccuggaggagaacauggauguggaaauuuggaccaaagagggagaacgcaagaagcuccggccuagauggcuugacgcccgcacauauucugauccccuggcgcugaaagaguuuaaggacuucgccgcuggcagaaaauccaucgcccucgaucuggucacggaaauugggcgggugccuagccaucuugcucaccgcaccagaaaugcccuggacaaccucguuaugcugcauacaucugagcacggaggccgggccuaccgccacgcuguggaggaacugcccgagaccauggaaacacuccuucugcugggccucaugauccugcuuaccgggggagcgaugcuguuucucguguccggcaaggggaucggaaaaacgaccauuggccugaucugugucauuguuagcuccgggaugcuguggauggccgauaucccucuccaguggauugcuucugccaucgugcuugaguucuuuaugauggugcugcugauucccgagccggaaaagcaaagaacaccucaggacaaucagcucgccuaugucgugaucggaauccugacccuugcugccauuguugcggccaacgagaugggccugcucgaaacaaccaagcgggaucugggcaugagcaaagagcccgggguggucucccccacgagcuaccuggacguggaccuccauccugcuucugccuggacacuuuaugcugucgccaccacagugaucaccccgaugcugagacacaccauugaaaauuccacagcgaacguuagccuggccgcuaucgccaaccaagcugugguccucaugggacuggauaagggcuggcccauuucuaaaauggaccuuggggugccucugcucgcccugggaugcuacagccagguuaauccccugacgcucaccgcugccgugcuucugcuggucacacauuacgcgaucaucggcccugggcuccaggccaaggcuacccgcgaggcccagaaacggacagcugccggaauuaugaagaaccccaccguggauggcaucaugacgauugaccuggauccugugaucuaugacuccaaguucgagaaacaacuuggccagguuaugcugcucguccugugugccgugcagcugcuccuuaugagaacaucuugggcgcugugcgaagcucugacccucgccaccgggccgauuacaacccugugggagggaagccccggcaaguuuuggaauacaacgaucgcuguguccauggccaacaucuuccgcgggucuuaccuugccggagcuggccuggccuuuagcauuaugaaauccgucgggaccggacggagaggcacaggcagccagggggaaacccucggagagaaguggaaaaagaagcugaaucaacugucucggaaagaguucgaucucuauaagaaauccggcaucacagagguugaccgcaccgaggcgaaggaagggcuuaaaagaggagagacgacccaccaugccgugagccggggcuccgcuaagcugcagugguuuguggaacgcaacauggucauuccugaggggagagugaucgaucugggauguggccggggcggguggucuuacuauugcgccggacucaaaaagguuacagaagugcgcggcuacaccaaagggggacccggccacgaggagccuguccccaugagcacauauggguggaauauugugaaacugauguccggaaaggacguuuucuaccuuccgccugaaaaaugugauacccugcucugcgacaucggcgagucuagccccucccccacaguggaagagagcagaaccauucggguccugaagaugguggagccuuggcugaaaaacaaucaguucuguaucaaggugcucaaccccuacaugccuacggucaucgaacaccuugagcgccugcagagaaaguauggcgggaugcugguucggaauccgcucucuagaaacuccacacaugaaauguacuggauuagcaauggaaccggcaacaucgugucuuccgugaauauggucagccgccugcuucugaaccgguuuaccaugacacacagacgccccacgauugagaaagauguggaccucggggcuggaacccggcauguuaacgccgaaccugagacacccaauauggacgugaucggcgagagaauuaagcgcaucaaagaagaacacucuagcaccuggcacuaugaugacgaaaacccuuacaagacaugggcguaucauggguccuacgaggucaaagccaccggaucugcuagcuccaugaucaauggcgugguuaagcugcugacaaagcccugggauguggucccgauggugacccaaauggccaugacggacaccacaccuuucggccagcagcggguuuuuaaagaaaagguggauaccagaacaccccgcccuaugcccgggacccggaaagucauggagauuacggcugaguggcucuggagaacacugggacgcaacaagaaaccucggcuuugcaccagagaagaguucacaaagaaggugcgcaccaaugccgcuaugggcgccgucuuuacggaagagaaccaaugggacagcgcgagagccgcuguggaagaugaggaguucuggaaacugguugaccgggaacgcgagcuccacaagcuggggaaauguggauccugcguguauaauaugaugggcaagagagagaagaaacuuggggaguuuggcaaagccaagggaucucgggcuaucugguacauguggcugggcgccagauuccucgaguuugaagcccugggguuccugaacgaggaucauugguuuagccgggaaaauuccuacucuggagucgagggcgaagggcuccacaagcugggauauauucuucgcgacaucagcaaaauucccggcggggcgauguacgcugaugacaccgccggcugggacacaagaaucaccgaggaugaccugcauaacgaggaaaagaucacacagcagauggauccggagcaccggcagcucgccaaugcuauuuucaaacugaccuaucaaaacaagguggugaaaguucagcgcccuacacccaagggaaccgugauggacaucauuuccagaaaggaucagcggggcucugggcaggucggaacguacggccuuaauacauuuaccaacauggaagcccaacuggugcgccagauggagggggaaggaguucucagcaaaaccgaccuggagaauccccaucugcucgagaagaaaaucacacaguggcuggaaaacaagggcguggagagacuuaaacggauggcuauuuccggggaugacugcgucgugaagccuaucgaugaccgcuucgccaacgcgcugcucgcccugaaugauaugggcaaggucagaaaagacaucccgcaguggcaacccagcaagggauggcaugauuggcaacaggugccuuucuguucucaccauuuucacgaacuuauuaugaaagacggccggaagcugguugugcccugccgcccucaggacgagcucaucgggagagcucggauuucccaaggagccggcuggagccugaaagaaaccgcuugucuggggaaggccuaugcgcagauguggucucucauguacuuccaccgcagagaucugcggcuugccuccaacgcuaucugcagcgccguccccgugcauuggguuccuacaucuagaacgaccugguccauucacgcucaucaccaguggaugacaaccgaggacaugcugacaguguggaaucgcgucuggaucgaggauaaccccuggauggaagacaagaccccggugacgaccugggaggaugugccuuaucucggaaaacgggaagaccaaugguguggcagccugauugggcuuacauccagagccaccugggcucagaauauccugacagccauccagcagguucgcagccucauuggcgaugaggaguuucuggacuacaugcccucuaugaagcgguucagaaaagaagaggaaagcgagggagcgaucugguga

SEQ ID NO: 20500 - RNA, 9873 nt, Artificial Sequence
  derived and/or modified CDS sequence (opt5) from DENV-3__FJ639722__SS-prME
accagccugugccucaugaugaugcugcccgccacccuugcuuuccaccugacgucccgggacggcgaaccucggaugaucguggggaagaacgaacgcggaaagucucuccuguuuaagaccgccacaggcauuaauauguguacccuuaucgcgauggaucugggggagaugugcgacgauacagucaccuacaaguguccgcucauugcugaaguugagcccgaagacaucgauugcugguguaaccugacaagcaccugggugacguauggaaccugcaaucaggccggcgagcaccggcgggacaagcgcuccguggcccuggcuccucacgucgggaugggacucgauacaagaacccagacauggaugucugccgagggcgcuuggagacagguggaaaaaguugagaccugggcccugcgccaucccggcuucacgauucuugcgcuguuucucgcccacuacaucgggacaagccugauccagaagguggucauuuucauccuucugaugcucgugaccccuuccaugacaaugagauguguuggagugggcaaccgggacuuugucgaagggcugucuggagcuaccuggguggaugugguccuggagcauggcgggugcguuaccacaauggccaagaauaaacccacgcucgacauugagcugcagaagaccgaagcuacacagcuugccacccugcgcaaacucuguaucgagggaaagauuacaaacaucaccacggauagcagaugcccuacacagggcgaagcgauucugccggaggaacaggaccagaauuauguguguaaacacaccuacguggaucggggcugggggaacggaugcggccuuuucgggaagggaucccuggugacaugcgccaaguuucaaugucucgagcccaucgagggcaaagugguucaguaugaaaaucugaaguacacagugaucauuaccguccacacaggggaccagcaucaggugggaaacgacacgcaaggcguuaccguggagaucacaccucaggcuagcaccgucgaagccgugcugcccgaguauggcacacucgggcuggaaugcucuccucgcaccggacuugauuucaaugagaugauucugcucacgaugaaaaacaaggcuuggaugguccacagacagugguuuuucgaccugccccuuccguggaccuccggcgccacaaccgagacaccuaccuggaaucggaaagaacugcucgugacguuuaagaacgcccaugcuaaaaagcaagagguugugguccuggggagccaggaaggagcgaugcacacagcccugaccggcgcuacagagauccaaaauucugggggcaccuccauuuucgccggacaccucaagugucgccugaaaauggauaaacuugaacugaaaggcaugagcuacgccaugugccucaacaccuuugugcugaagaaagagguuucugagacacagcaugggacgauccugaucaagguggaauacaagggagaggacgcucccuguaaaauuccuuucuccaccgaagauggccaagggaaggcccacaacggaagacuuaucacagcgaaucccgucgugaccaaaaaggaggagcccgugaacauugaagcugagccuccguucggcgaaagcaauaucguuauugggaucggcgagaaagcccucaagaucaacugguauaagaaaggauccucuauuggcaagauguuugaagccacagcuagaggggccagacgcauggcuauccugggagacaccgccugggauuucggcagcgucgggggagugcugaauagccucggcaaaauggugcaucagauuuuugggagcgcguacacggcccuguucucuggcgucuccuggaucaugaagauuggaaucggcgugcuucugacauggauugggcucaacagcaaaaauaccucuaugagcuuuuccugcaucguuaucggaauuaucacccuguaucugggcgcugugguccaggccgacauggggugugugauuaacuggaagggaaaggagcuuaaaugcggcucugggaucuucguuacaaaugaggugcacaccuggacagaacaguacaaguuucaagcugauagccccaaacggcucgccacggcgauugccggcgcuugggagaacggagucuguggcaucagauccaccacacgcauggaaaaucugcuguggaagcagaucgccaacgagcucaauuauauucugugggaaaacaauaucaaacuuaccgugguugugggggacauuaucggaguccuggagcagggcaagcggacacucaccccucagcccauggagcugaaauacagcuggaagacgugggggaaggcuaaaauugugaccgccgaaacacaaaacucuuccuucaucaucgauggaccuaacacccccgagugcccgagcgccucuagagcuuggaaugugugggaagucgaggacuauggcuuuggcguuuucacaaccaacauuuggcugaaacuucgcgaaguguacacacaguccugugaccaucggcucaugagcgcggccaucaaagaugagagagcugugcacgccgacaugggguacuggauugagucccagaagaauggaucuuggaaacuggaaaaggccagcuuuaucgaggucaagaccugcacguggccuaaaucccacacacuguggucuaacggcgugcucgaaagcgauaugauuauccccaagucccuggcugggccuaucagccagcauaaucaccgccccggauaucauacccaaaccgccggcccuuggcaccuugggaaacuggagcucgacuucaacuacugcgagggaacaaccguugugauuacggaaaauuguggcacacggggccccucucugagaaccacaaccgucuccgggaagcugauccacgaguggugcugucgcagcugcacacuuccgccucuccgguauaugggagaagauggcuguugguacgggauggagauuagacccaucaacgaaaaagaggagaauauggugaagucucugguuuccgcgggaagcggcaagguggacaacuuuaccauggggguccugugccucgcuauucuguucgaagaggugaugcggggaaaauucggcaagaaacauaugaucgccggcguucuuuuuacguucgugcugcuccugucugggcagauuaccuggcgcgauauggcccacacacugaucaugaucggaagcaaugcuuccgacagaaugggcaugggggucaccuaucuugcccugauugcgacauuuaagauccagcccuuccucgcucugggauuuuuccuccggaaacugaccagcagagaaaaccuucugcucggcguggggcuggccauggccacgacacugcaacuuccugaggauauugaacagauggcuaauggaaucgcccugggccucaugacccugaagcucauuacacaguuugagaccuaccagcuguggaccgcucuugugucucugacauguuccaacacgaucuucacccucacagucgccuggcgcaccgcgacacugauccuggccggcguuagccuucugccgcucugccaauccucuagcaugcggaagaccgacuggcugcccaugacgguggcugccaugggggugccuccccucccucuguuuauuuucucccuuaaagaugcucccaagagacgcucuuggccucugaaugagggagucauggccgugggccugguuagcauccucgccuccucucugcuuagaaacgacgugcccauggcugggccgcuggucgcgggaggccuccugauugccuguuaugugaucacagggaccagcgcugaucucaccguugaaaaagccgccgacgugacaugggaggaagaggcugaacagaccggagucucccauaaccugaugauuacaguggacgaugacggcacgaugcggaucaaggaugacgagaccgagaauauccuuacaguccugcugaaaaccgcccuccugauugugagcggcaucuuuccuuacucuauucccgcgacacuucugguuuggcacaccuggcagaagcagacgcaacgcuccggggugcucugggaugucccuucucccccggaaacccagaaagcugagcuggaagagggaguguacagaaucaagcagcagggcauuuucgggaagacacaaguuggagugggcguccagaaagaggggguguuucauaccauguggcacgugacacggggagccguucucacccacaacggcaagcgccuggaaccuaauugggccuccgucaaaaaggaccuuaucuccuauggcgggggauggagacugagcacacaguggcaaaaaggcgaggaaguccaggugauugcugucgagcccgggaagaacccuaagaauuuccagacgaugcccggaaucuuccagaccacaaccggcgaaaucggggccauugcgcuggauuuuaaacccggaaccucuggcuccccuaucauuaaccgggagggcaaggugguugggcucuacggaaauggcguggucaccaagaacgggggauaugugagcggcaucgcucaaacgaaugccgagccggacgggcccaccccugaacuggaggaagagauguucaagaaacgcaaccuuacaauuauggaucugcaucccggcuccggaaagaccagaaaguaccucccugccaucguucgggaagcuaucaaacgcagacugcggacacucauucuggcccccaccagaguggucgcugccgagauggaggaagcgcuuaagggccugccuauccgcuaucagacgacagccaccaaaagcgagcacaccgggcgggaaauuguggaccugaugugccaugcuacauuuaccaugagacuccugucuccgguucgcgugcccaauuacaaccuuaucauuauggaugaggcccacuucacagacccugcuagcaucgccgcccggggauauaucuccaccagagucggcaugggggaagcugcggccauuuuuaugacggcuacacccccuggaaccgccgaggccuucccccagucuaaugcuccgauccaggaugaggaacgcgacauuccugagcggagcuggaacuccggcaaugaauggaucacagacuuuguggggaagaccgugugguucguccccucuauuaaagccggcaacgauaucgcgaacugucugagaaagaauggaaagaaaguuauucaacucagccgcaagacguuugacaccgaguaccagaaaacacggcugaacgauugggacuucguggugaccacagauaucuccgagaugggcgcuaauuuuaaggccgacagagucaucgauccccggcgcugccugaaaccugugauucucaccgacgggcccgaaagaguuauccuugccggaccuaugccggugacagcugccucugcggcccagcggcgcggcagagucgggcggaacccccagaaggagaaugaucaauacauuuucaccggacagccucugaacaaugacgaagaucaugcucacuggacggaggccaagaugcugcucgacaacaucaauacacccgaaggcauuaucccugcucuguucgagcccgagagagagaaaagcgccgcuaucgacggggaguaucgccuuaagggcgaaucccggaaaaccuuuguggagcugaugagacgcggagaucucccgguuuggcuggcccacaagguggcgagcgaaggcauuaaauacaccgaccggaaguggugcuucgauggggagagaaacaaucagauccuggaggaaaacauggacgucgagauuuggacaaaagaaggagagcgcaagaagcuccggccuagauggcuugaugcccgcaccuauucugacccccuggcucugaaagaauuuaaggauuucgccgcuggcagaaaauccaucgcccucgaccuggugacagagauugggcgggucccuagccaucuugcccaccgcacgagaaaugcucuggauaaccucgugaugcugcauaccucugagcacggaggccgggcguaccgccacgccguugaggaacugcccgaaacaauggagacccuccuucugcugggccucaugauccugcuuacagggggagcuaugcuguuucucguguccggcaaggggaucggaaaaaccacgauuggccugaucugugugauugucagcuccgggaugcuguggauggccgacaucccucuccaguggauugccucugcuaucguucuugaguucuuuaugauggugcugcugauucccgaaccggagaagcaaagaaccccucaggauaaucagcucgccuauguggucaucggaauccugacacuugcggccauuguggcugccaacgaaaugggccugcucgagaccacaaagcgggaccugggcaugagcaaagaacccgggguugugucccccaccagcuaccuggaugucgaccuccauccugcuucugccuggacgcuuuaugcgguggccacaaccgucaucacaccgaugcugagacacaccauugaaaauuccaccgcuaacgugagccuggccgcuaucgccaaccaagcuguugugcucaugggacuggacaagggcuggcccauuucuaaaauggaucuuggggucccucugcucgcccugggaugcuacagccaggugaauccccugacacucacggcggccguucuucugcuggugacccauuacgcuaucaucggcccugggcuccaggccaaggcuacacgcgaggcccagaaacggaccgccgcgggaauuaugaagaaccccacagucgacggcaucaugaccauugaucuggacccugugaucuaugauuccaaguucgaaaaacaacuuggccaggugaugcugcucguucugugugcuguccagcugcuccuuaugagaacgucuugggcccugugcgaggcucugacacucgccaccgggccgauuaccacacugugggaaggaagccccggcaaguuuuggaauaccacaaucgccguguccauggcuaacaucuuccgcgggucuuaccuugccggagcgggccuggccuuuagcauuaugaaauccguggggacgggacggagaggcaccggcagccagggggagacacucggagaaaaguggaaaaagaagcugaaucaacugucucggaaagaguucgaccucuauaagaaauccggcaucaccgaggucgaucgcacagaagcuaaggaggggcuuaaaagaggagaaaccacgcaccaugccguuagccggggcuccgcuaagcugcagugguuuguggagcgcaacauggugauuccugaagggagagucaucgaccugggauguggccggggcggguggucuuacuauugcgccggacucaaaaaggugaccgagguucgcggcuacacaaaaggcgggcccgggcacgaggaaccugugcccaugagcaccuauggguggaauauugucaaacugauguccggaaaggauguguucuaccuuccgccugagaaaugugacacacugcucugcgauaucggcgaaucuagccccucccccaccguugaggagagcagaacaauucgggugcugaagauggucgaaccuuggcugaaaaacaaucaguucuguaucaaggugcucaaccccuacaugccuaccgugaucgagcaccuugaacgccugcagagaaaguauggcgggaugcugguccggaauccgcucucuagaaacuccacgcaugagauguacuggauuagcaauggaacaggcaacaucguuucuuccgugaauauggugagccgccugcuucugaaccgguuuaccaugacccacagacgccccacaauugaaaaagacgucgaucucggggcgggaacgcggcaugugaacgccgagccugagacccccaauauggacguuaucggcgaaagaauuaagcgcaucaaagaggaacacucuagcacauggcacuaugacgaugagaacccuuacaagaccugggcuuaucauggguccuacgaagugaaagccacaggaucugcuagcuccaugaucaauggcgucgugaagcugcugaccaagcccugggacguugugccgauggucacacaaauggccaugaccgauacgaccccuuucggccagcagcggguguuuaaagagaagguugacacaagaacaccccgcccuaugcccgggacacggaaagugauggagauuaccgcugaauggcucuggagaacgcugggacgcaacaagaaaccucggcuuugcacaagagaggaguucaccaagaagguccgcacaaaugccgcgaugggcgccguguuuaccgaggaaaaccaaugggauagcgcuagagccgcugucgaggacgaggaguucuggaaacugguggaucgggagcgcgaacuccacaagcuggggaaauguggauccugcguuuauaauaugaugggcaagagagagaagaaacuuggggaguuuggcaaagccaagggaucucgggccaucugguacauguggcugggcgcgagauuccucgaauuugaggcucugggguuccugaacgaagaccauugguuuagccgggaaaauuccuacucuggaguggaaggcgaggggcuccacaagcugggauauauucuucgcgauaucagcaaaauucccggcggggccauguacgccgacgauacggcuggcugggacaccagaaucacagaggacgaucugcauaacgaagagaagaucacccagcagauggacccggaacaccggcagcucgccaaugcuauuuucaaacugacauaucaaaacaaggucgugaaagugcagcgcccuacccccaagggaacaguuauggauaucauuuccagaaaggaccagcggggcucuggacaggugggaaccuacggccuuaauacguuuacaaacauggaggcccaacugguccgccagauggaaggggagggagugcucagcaaaaccgaucuggagaauccccaucugcucgaaaagaaaaucacccaguggcuggagaacaagggcguugaaagacuuaaacggauggcgauuuccggggacgauugcguggucaagccuaucgacgaucgcuucgccaacgcucugcucgcccugaaugacaugggcaaggugagaaaagauaucccgcaguggcaacccagcaagggauggcaugacuggcagcaggucccuuucuguucucaccauuuucacgagcuuauuaugaaagauggccggaagcuggugguucccugccgcccucaggacgaacucaucgggagagcucggauuucccaaggagccggcuggagccugaaagagacagcgugucuggggaaggccuaugcucagauguggucucucauguacuuccaccgcagagaccugcggcuugccuccaacgcuaucugcagcgccgugcccguccauugggugccuaccucuagaacaacgugguccauucacgcucaucaccaguggaugaccacagaggauaugcugaccguuuggaaucgcguguggaucgaagacaaccccuggauggaggauaagacaccggucaccacgugggaagacgugccuuaucucggaaaacgggaggaucaaugguguggcagccugauugggcuuaccuccagagccacaugggcgcagaauauccugaccgccauccaacaggugcgcagccucauuggcgacgaggaauuucuggauuacaugcccucuaugaagcgguucagaaaagaggaagagagcgaaggagcuaucugguga

SEQ ID NO: 20501 - RNA, 9873 nt, Artificial Sequence
  derived and/or modified CDS sequence (opt5) from DENV-3__FJ639723__SS-prME
accagccugugccucaugaugaugcugcccgccacacuugcuuuccaccugacgucccgggacggcgagccucggaugaucguggggaagaacgaacgcggaaaaucucuccuguuuaagaccgccaccggcauuaauauguguacccuuaucgcgauggaucugggggagaugugcgacgauacagucaccuacaaauguccgcucauugcugaaguugagcccgaagacaucgauugcugguguaaccugacaagcgccugggugaccuauggaacgugcaaucaggccggcgagcauagacgggacaagcgcuccguggcucuggccccucacgucgggaugggacucgauaccagaacacagaccuggaugucugcugagggcgccuggagacagguggaaaaaguugagacaugggcgcugcgccaucccggcuucaccauucuugcccuguuucucgcucacuacaucgggacgagccugauccagaagguggucauuuucauccuucugaugcucgugacaccuuccaugaccaugagauguguuggagugggcaaccgggacuuugucgaagggcugucuggagccacauggguggaugugguccuggagcauggcgggugcguuaccaccauggcuaagaauaaacccacacucgacauugagcugcagaagacggaagccacccagcuugcgacacugcgcaaacucuguaucgagggaaagauuaccaacaucacaaccgauagcagaugcccuacgcagggcgaagccauucugccggaggaacaggaccagaauuauguguguaaacacacauacguggaucggggcugggggaacggaugcggccuuuucgggaagggaucccuggugacaugcgcuaaguuucagugucucgagcccaucgagggcaaagugguucaguaugaaaaucugaaguacaccgugaucauuacaguccacaccggggaccagcaucaggugggaaacgacacacaaggcguuacgguggagaucaccccucaggccagcacagucgaagcugugcugcccgaguauggcacccucgggcuggaaugcucuccucgcacaggacuugauuucaaugagaugauucugcucaccaugaaaaacaaggccuggaugguccacagacagugguuuuucgaccugccccuuccguggacguccggcgccaccacagagaccccuacauggaaucggaaagaacugcucgugaccuuuaagaacgcucaugcgaaaaagcaagagguugugguccuggggagccaggaaggagccaugcacacggcucugacaggcgccaccgagauccaaaauucugggggcacauccauuuucgccggacaccucaagugucgccugaaaauggauaaacuugaacugaaaggcaugagcuacgcuaugugccucaacaccuuugugcugagaaaggagguuucugagacccagcaugggacaauccugaucaaaguggaauacaagggagaggacgcccccuguaagauuccuuucuccacggaagauggccaagggaaagcgcacaacggacggcuuaucaccgcuaaucccgucgugacaaagaaagaggagcccgugaacauugaagccgagccuccguucggcgaaagcaauaucguuauugggaucggcgacaaggcccucaaaaucaacugguauaagaagggauccucuauuggcaaaauguuugaggcuaccgccagaggggcucgccggauggccauccugggagauacagcgugggacuucggcagcgucgggggagugcugaauagccucggcaagauggugcaucagauuuuugggagcgccuacaccgcucuguucucuggcgucuccuggaucaugaaaauuggaaucggcgugcuucugacguggauugggcucaacagcaagaauacaucuaugagcuuuuccugcaucguuaucggaauuaucacccuguaucugggcgccgugguccaggcugauauggggugugugauuaacuggaaaggaaaggaacuuaagugcggcucugggaucuucguuaccaaugaggugcacacauggaccgagcaguacaaauuucaagccgacagccccaagagacucgcgacagccauugcuggcgccugggaaaacggagucuguggcauccgcuccacgacccggauggagaaucugcuguggaaacagaucgcuaacgaacucaauuauauucugugggagaacaauaucaaacuuacagugguugugggggauauuaucggaguccuggaacagggcaaaagaacccucacaccucagcccauggagcugaaguacagcuggaaaaccugggggaaggccaagauugugacggccgagacccaaaacucuuccuucaucaucgacggaccuaacacacccgaaugcccgagcgcuucucgcgcguggaaugugugggaggucgaagacuauggcuuuggcguuuucaccacaaacauuuggcugaaacuucgggagguguacacccaguccugugaucauagacucaugagcgccgcuaucaaggacgaacgcgccgugcacgccgauaugggguacuggauugagucccagaaaaauggaucuuggaagcuggagaaagcuagcuuuaucgaagucaagacaugcaccuggccuaagucccacacgcuguggucuaacggcgugcucgagagcgacaugauuauccccaaaucccuggccgggccuaucagccagcauaaucaccggcccggauaucauacacaaaccgcgggcccuuggcaccuugggaagcuggaacucgauuucaacuacugcgagggaaccacaguugugauuaccgagaauuguggcacgagaggccccucucugcgcacaaccacagucuccgggaaacugauccacgaauggugcugucggagcugcacccuuccgccucucagauauaugggagaggacggcuguugguacgggauggaaauucggcccacaaacgagaaggaagagaauauggugaaaucucugguuuccgcuggaagcggcaagguggauaacuuuaccauggggguccugugccucgccauccuguucgaggaagugaugcgcggaaaguucggcaaaaagcauaugauugccggcguucuuuuuacguucgugcugcuccugucugggcagaucaccuggagagacauggcucacacacugauuaugaucggaagcaaugccuccgaucggaugggcaugggggucaccuaucuugcgcugaucgcuacauuuaaaauucagcccuuccucgcccugggauuuuuccucagaaagcugaccagccgcgagaaccuucugcucggcguggggcuggccauggcuacgacacugcaacuuccugaagacaucgagcagauggccaauggaauugcucugggccucaugacccugaaacucaucacacaguuugaaaccuaccagcuguggaccgcccuugugucucugacauguuccaacacgauuuucacccucacagucgcguggcggaccgccacacugauccuggcuggcguuagccuucugccgcucugccaauccucuagcaugagaaagaccgauuggcugcccaugacgguggccgcuaugggggugccuccccucccucuguuuaucuucucccuuaaggacacacccaaacgcagaucuuggccucugaaugagggagucauggccgugggccugguuagcauucucgccuccucucugcuucggaacgaugugcccauggcugggccgcuggucgcgggaggccuccugaucgccuguuaugugauuaccgggaccagcgcugaccucacaguugagaaggccgccgacgugaccugggaagaggaagcugagcagacaggagucucccauaaccugaugaucacgguggaugacgauggcaccaugcgcauuaaagacgaugaaacagagaauauccuuaccguccugcugaagacagcccuccugaucgugagcggcauuuuuccuuacucuauccccgcgacccuucugguuuggcacacguggcagaaacagacccaaagauccggggugcucugggacgucccuucucccccggagacacagaaggcugaacuggaggaaggaguguaccggauuaaacagcagggcaucuucgggaagacccaaguuggagugggcguccagaaggaggggguguuucauacaauguggcacgugacccgcggagccguucucacacacaacggcaaaagacuggagccuaauugggccuccgucaagaaagaucuuauuuccuauggcgggggauggcggcugagcacgcaguggcaaaagggcgaagagguccaggugaucgcugucgaacccgggaaaaacccuaagaauuuccagaccaugcccggaauuuuccagacaaccaccggcgagaucggggccaucgcgcuggacuuuaagcccggaacaucuggcuccccuauuaucaaccgcgaaggcaaagugguugggcucuacggaaauggcguggucacgaagaacgggggauaugugagcggcauugcucaaaccaaugccgagccggaugggcccacaccugagcuggaagaggaaauguucaaaaagagaaaccuuaccaucauggaccugcaucccggcuccggaaaaacacggaaguaccucccugccauuguucgcgaggcuaucaagagacggcugagaacccucauccuggcccccacgcgcguggucgcugccgaaauggaggaggcgcuuaaaggccugccuauucgguaucagacaaccgccaccaagagcgaacacacagggagagagaucguggaucugaugugccaugcuaccuuuacaaugcgccuccugucuccgguucgggugcccaauuacaaccuuauuaucauggacgaagcccacuucaccgauccugcuagcauugccgccagaggauauaucuccacgcgcgucggcaugggggaggcugcggccaucuuuaugacagcuacacccccuggaacagccgaagccuucccccagucuaaugcuccgauucaggacgaggagcgggacaucccugaaagaagcuggaacuccggcaaugaguggauuaccgauuuuguggggaaaacggugugguucguccccucuaucaaggccggcaacgacauugcgaacugucugcgcaaaaauggaaagaagguuauccaacucagccggaaaaccuuugauacagaauaccagaagaccagacugaacgacugggauuucguggugacaaccgacauuuccgagaugggcgcuaauuuuaaagccgaucgggucaucgacccccgcagaugccugaagccugugauccucacagaugggcccgagcggguuauucuugccggaccuaugccggugaccgcugccucugcggcccagcgcagaggccgggucgggagaaacccccagaaagaaaaugaccaauacaucuucacgggacagccucugaacaaugaugaggaccaugcucacuggacagaagccaagaugcugcucgacaacauuaauacccccgagggcaucauuccugcucuguucgaacccgagcgcgaaaagagcgccgcuaucgauggggaauaucggcuuaaaggcgaguccagaaagaccuuuguggaacugaugcgccggggagaccucccgguuuggcuggccuacaaaguggcgagcgagggcaucaaguauacagauagaaaauggugcuucgacggggaacgcaacaaucagauucuggaggagaacauggaugucgaaaucuggaccaaggagggagaacggaaaaagcucagaccucgcuggcuugacgccagaacauacucugauccccuggcucugaaggaguuuaaagacuucgccgcuggccggaaguccauugcccucgaucuggugacggaaaucgggcgcgucccuagccaccuugcccauagaacccggaaugcucuggacaaccucgugaugcugcacacaucugagcauggaggccgcgcguauagacacgccguugaggaacugcccgagaccauggaaacacuccuucugcugggccucaugauucugcuuaccgggggagcuaugcuguuucucaucuccggcaaagggaucggaaagacgaccauuggccugaucugugugauugugagcuccgggaugcuguggauggccgauaucccucuccaguggauugccucugcuaucguccuugaguucuuuaugaugguucugcugauucccgagccggaaaaacaacggacaccucaggacaaucagcucgccuacguggugaucggaauccugacccuugcggccauugucgcugccaacgagaugggccugcucgaaacaaccaagagagaucugggcaugagcaaggagcccggggugguuucccccacgagcuaucuggacguggaccuccacccugcuucugccuggacacuuuacgcggucgccaccacagugaucaccccgaugcugcgccauaccauugaaaauuccacagcuaacgucagccuggccgcuaucgccaaccaagcugugguucucaugggacuggauaaaggcuggcccauuucuaagauggaccuuggggugccucugcucgcccugggaugcuacagccaggucaauccccugacgcucaccgcggccgugcuucugcugguuacacacuaugcuaucaucggcccugggcuccaggccaaagcuacccgggaggcccagaagagaacagccgcgggaauuaugaaaaaccccaccguggauggcaucaugacgauugaccuggauccugucaucuacgacuccaaguucgagaagcaacuuggccaggugaugcugcucgugcugugugcuguucagcugcuccuuaugcgcacaucuugggcccugugcgaagcucugacccucgccaccgggccgauuacaacccugugggagggaagccccggcaaauuuuggaauacaacgaucgccgucuccauggcuaacaucuuccgggggucuuaucuugccggagcgggccuggccuuuagcauuaugaaguccguggggaccggaagacggggcacaggcagccagggggaaacccucggagagaaauggaagaaaaagcugaaucaacugucucgcaaggaguucgaucucuacaaaaaguccggcaucacagagguggacagaaccgaggcuaaagaagggcuuaagcggggagagacgacccaucacgccgucagccgcggcuccgcuaaacugcagugguuuguugaaagaaacauggugauuccugaggggcgggugaucgaucugggauguggccgcggcggguggucuuauuacugcgccggacucaagaaagucacagaagugagaggcuauaccaaagggggacccggccaugaggagccuguucccaugagcacauacggguggaauauugugaagcugauguccggaaaagacgucuucuaccuuccgccugaaaagugugauacccugcucugcgacaucggcgagucuagccccucccccacaguggaagagagccggaccauucgcguucugaaaaugguggagccuuggcugaagaacaaucaguucuguaucaaaguccucaaccccuauaugccuacggugaucgaacaccuugagagacugcagcggaaguacggcgggaugcuggugagaaauccgcucucucgcaacuccacacacgaaauguauuggauuagcaauggaaccggcaacaucgucucuuccguuaauauggugagccggcugcuucugaacagauuuaccaugacacaucgccggcccacgauugagaaggauguggaccucggggcgggaaccagacacgucaacgccgaaccugagacacccaauauggacgugaucggcgagcgcauuaaacggaucaaggaagaacacucuagcaccuggcacuacgaugacgaaaacccuuauaaaacaugggcuuaccacggguccuaugagguuaaggccaccggaucugcuagcuccaugaucaauggcguggucaaacugcugacaaagcccugggaugugguuccgauggugacccaaauggccaugacggacaccacaccuuucggccagcagagagucuuuaaggaaaaaguggauacccgcacaccccggccuaugcccgggaccagaaagguuauggagauuacggcugaguggcucuggcgcacacugggacggaacaaaaagccuagacuuugcacccgcgaagaguucaccaagaaggugagaaccaaugccgcgaugggcgccgucuuuacggaagagaaccaaugggacagcgcucgggccgcuguggaagaugaggaguucuggaagcuggucgaccgcgaaagagagcuccauaaacuggggaaguguggauccugcguguacaauaugaugggcaaacgggaaaagaaacuuggggaguuuggcaaggccaaaggaucuagagccaucugguacauguggcugggcgcgcgguuccucgaguuugaagcucugggguuccugaacgaggaucacugguuuagccgcgaaaauuccuauucuggaguugagggcgaagggcuccauaagcugggauacauucuuagagacaucagcaagauucccggcggggccauguaugccgaugacaccgcuggcugggacacacggaucaccgaggaugaccugcacaacgaggagaagaucacacagcagauggauccggagcaucgccagcucgccaaugcuauuuucaagcugaccuaccaaaacaaaguggucaaggugcagagaccuacacccaaaggaaccgugauggacaucauuucccggaaggaucagcgcggcucugggcagguuggaacguauggccuuaauacauuuaccaacauggaagcccaacuggugagacagauggagggggaaggaguccucagcaaggcggaccuggagaauccccaucugcucgagaaaaagaucacccaguggcuggaaaacaaaggcguggagcggcuuaagcgcauggccauuuccggggaugacugcguugugaaaccuaucgaugacagauucgcuaacgcccugcucgcucugaaugauaugggcaagguccggaaggacaucccgcaguggcaacccagcaaaggauggcacgauuggcaacaggugccuuucuguucucaucacuuucaugaacuuauuaugaaggacggccgcaaacuggucgugcccugcagaccucaggacgagcucaucgggcgggcccgcauuucccaaggagcgggcuggagccugaaggaaacagccugucuggggaaggcuuacgcccagauguggucucucauguauuuccacagacgggaucugagacuugcuuccaacgccaucugcagcgcuguucccgugcacugggucccuaccucucgcacaacgugguccauucaugcccaccaucaguggaugaccacagaggacaugcuggcgguguggaaucggguuuggaucgaggauaaccccuggauggaagacaagaccccggugacaaccugggaggaugucccuuaccucggaaagagagaagaccaaugguguggcagccugauugggcuuacgucccgcgccaccugggcucagaauauccugacagccauccaacaggugcggagccucauuggcgaugaggaguuucuggacuacaugcccucuaugaaaagauuccgcaaggaagaggaaagcgagggagccaucugguga

SEQ ID NO: 20502 - RNA, 9873 nt, Artificial Sequence
  derived and/or modified CDS sequence (opt5) from DENV-3__FJ639724__SS-prME
accucccugugccucaugaugaugcugcccgccacgcuugcuuuccaccugacgucccgggacggcgagccucggaugaucguggggaagaacgaacgcggaaagucucuccuguuuaagaccgccagcggcauuaauauguguacacuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaacgcguugagacaugggcccugagacaucccggcuucaccauucuugcgcuguuucucgcccacuacaucgggacgucccugacacagaaaguggucaucuucauucuucugaugcucgugaccccuucuaugacaaugcgguguguuggagugggcaaccgcgacuuugucgaagggcugagcggagcuaccuggguggaugugguccuggagcauggcgggugcguuaccacaauggccaaguccaagcccacgcucgacaucgagcugcagaaaaccgaagcuacacagcuugccacccugagaaagcucuguauugagggaaaaaucacaaauauuaccacggauagccggugcccuacacagggcgaagcgacccugccggaggaacaggaccagaacuauguguguaagcacaccuacguggaucgcggcugggggaauggaugcggccuuuucgggaaaggaucucuggucacaugcgccaaguuucaaugucucgagcccaucgagggcaaggugguucaguaugaaaaccugaaauacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccuagaacgggacuugauuucaacgagaugauucugcucaccaugaagaauaaggcuuggaugguccaccggcagugguuuuucgaccugccccuuccguggacaucuggcgccaccacagagaccccuacguggaaccgcaaggaacugcucgugacauuuaaaaaugcccaugcuaagaaacaagagguugugguccuggggucccaggaaggagcgaugcacaccgcccugacaggcgcuaccgagauccagaacagcgggggcaccucuauuuucgccggacaccucaaguguagacugaagauggauaaacuugaacugaagggcauguccuacgccaugugccucaauacauuugugcugaaaaaggagguuagcgagacgcagcaugggaccauccugauuaaaguggaauacaagggagaggacgcucccuguaagaucccuuucuccacagaagauggccaagggaaagcccacaacggacggcuuaucaccgcgaaccccgucgugacaaagaaagaggagcccgugaauauugaagcugagccuccguucggcgaaucuaacaucguuauugggaucggcgacaaggcccucaaaauuaauugguauaagaagggaagcuccaucggcaaaauguuugaggccaccgcuagaggggcccgccggauggcuauccugggagauacggccugggacuucggcagcgucgggggagugcugaacucucucggcaagauggugcaucagauuuuuggguccgcguacacagcccuguucagcggcgucucuuggaucaugaaaauuggaaucggcgugcuucugaccuggauugggcucaauagcaagaacaccuccaugucuuuuagcugcaucguuauuggaaucaucacacuguaucugggcgcugugguccaggccgauauggggugugugauuaauuggaaaggaaaggaacuuaagugcggcuccgggaucuucguuaccaacgaggugcacacauggacggagcaguacaaauuucaagcugacagccccaagagacucgccaccgcgauugccggcgcuugggaaaauggagucuguggcauccgcucuacaacccggauggagaaccugcuguggaaacagauugccaaugaacucaacuauauccugugggagaauaacaucaaacuuacagugguugugggggauauuaucggaguccuggaacagggcaaaagaacccucacgccucagcccauggagcugaaguacuccuggaaaaccugggggaaggcuaagauugugacagccgagacccaaaauagcucuuucaucauugacggaccuaacacacccgaaugcccguccgccagccgcgcuuggaacgugugggaggucgaagacuauggcuuuggcguuuucaccacaaauaucuggcugaaacuucgggagguguacacccaguccugugaucauagacucaugucugcggccaucaaggacgaacgcgcugugcacgccgauaugggguacuggauugagagccagaaaaacggauccuggaagcuggagaaagccucuuuuaucgaagucaagacgugcacauggccuaagagccacacccugugguccaauggcgugcucgagagcgacaugauuauccccaaaucucuggcugggccuauuucccagcauaaccaccggcccggauaucauacccaaacaaccggcccuuggcaccuugggaagcuggaacucgauuucaauuacugcgagggaacgacaguugugaucaccgagaacuguggcacaagaggccccagccugcgcaccacaaccgucucugggaaacugauccacgaauggugcugucgguccugcacgcuuccgccucucagauauaugggagaggacggcuguugguacgggauggaaauucggcccaucaaugagaaggaagagaacauggugaaaagccugguuucugccggaagcggcaagguggauaauuuuaccauggggguccugugccucgcgauucuguucgaggaagugaugcgcggaaaguucggcaaaaagcauaugaucgcuggcguucuuuuuacauucgugcugcuccuguccgggcagauuaccuggagagacauggcccacacacugaucaugauuggaagcaacgccucugaucggaugggcaugggggucaccuaucuugcucugaucgccacguuuaaaauccagcccuuccucgcgcugggauuuuuccucagaaagcugacaucccgcgagaaucuucugcucggcguggggcuggcuauggccaccacacugcaacuuccugaagacauugagcagauggccaacggaaucgcucugggccucaugacccugaaacucauuacccaguuugaaacauaccagcuguggacggcccuugugagccugaccuguuccaauacaaucuucacccucacagucgcuuggcggaccgccacgcugauucuggcgggcguuucucuucugccgcucugccaaagcuccucuaugagaaagacagauuggcugcccaugaccguggccgcuaugggggugccuccccucccucuguuuaucuucagccuuaaggacacccccaaacgcagauccuggccucugaacgagggagucauggccgugggccugguuucuauccucgcuagcucccugcuucggaaugaugugcccauggccgggccgcuggucgccggaggccuccugauugcuuguuaugugaucacagggaccagcgcggaccucacaguugagaaggccgcugacgugacgugggaagaggaagccgagcagaccggagucucucauaaccugaugauuacaguggaugacgauggcaccaugcgcaucaaagacgaugaaacagagaacauucuuaccguccugcugaagacggcccuccugaucguguccggcaucuuuccuuacagcauucccgcuacccuucugguuuggcacacauggcagaaacagacccaaagaucuggggugcucugggacgucccuucucccccggagacacagaaggccgaacuggaggaaggaguguaccggaucaaacagcagggcauuuucgggaagacccaaguuggagugggcguccagaaggaggggguguuucauacaauguggcacgugacgcgcggagcgguucucacccacaauggcaaaagacuggagccuaacugggcuagcgucaagaaagaucuuaucagcuauggcgggggauggcggcuguccgcccaguggcaaaagggcgaagagguccaggugauugccgucgaacccgggaaaaauccuaagaacuuccagacaaugcccggaaucuuccagaccaccacaggcgagauuggggcuaucgcccuggacuuuaagcccggaacgagcggcuccccuaucauuaaucgcgaaggcaaagugguugggcucuacggaaacggcguggucaccaagaaugggggauaugugagcggcaucgcgcaaacaaacgcugagccggaugggcccaccccugagcuggaagaggaaauguucaaaaagagaaaucuuacaauuauggaccugcaucccggcucuggaaaaacccggaaguaccucccugccaucguucgcgaggccauuaagagacggcugagaacgcucauccuggcucccacacgcguggucgccgcugaaauggaggaggcccuuaaaggccugccuauccgguaucagaccaccgcgacaaagagcgaacacaccgggagagagauuguggaucugaugugccaugccacauuuaccaugcgccuccuguccccgguucgggugcccaacuacaaucuugucaucauggacgaagcucacuucacggauccugccucuauugcugccagaggauauaucagcacacgcgugggcaugggggaggccgcugcgauuuuuaugaccgccacacccccuggaaccgcugaagccuucccccaguccaacgccccgauccaggacgaggagcgggacaucccugaaagaucuuggaauagcggcaacgaguggauuacggauuuuguggggaaaaccgucugguucguucccuccaucaaggcuggcaaugacauugccaacugucugcgcaaaaacggaaagaaggugauccaacucucucggaaaacauuugauaccgaauaccagaagacaagacugaaugacugggauuucguggucaccacagacauuagcgagaugggcgcgaacuuuaaagcugaucgggugaucgacccccgcagaugccugaagccuguuauucucaccgaugggcccgagcgggugauccuugccggaccuaugccggucacggccgcuuccgccgcgcagcgcagaggccggguggggagaaauccccagaaagaaaacgaccaauacaucuucacaggacagccucugaauaacgaugaggaccaugcccacuggaccgaagcuaagaugcugcucgacaauauuaacacccccgagggcaucauuccugcccuguucgaacccgagcgcgaaaagagcgcugccaucgauggggaauaucggcuuaaaggcgagucuagaaagacauuuguugaacugaugcgccggggagaccucccgguguggcuggcucacaaagucgccuccgagggcauuaaguacaccgauagaaaauggugcuucgacggggaacgcaauaaccagauccuggaggagaauauggauguggaaaucuggacaaaggagggagaacggaaaaagcucagaccucgcuggcuugacgcgagaacguauagcgauccccuggcccugaaggaguuuaaagacuucgcugccggccggaagucuauugcucucgaucuggucaccgaaaucgggcgcgugccuucccaucuugcccacagaacacggaacgcccuggacaaucucguuaugcugcauaccagcgagcacggaggccgcgcuuacagacacgcgguggaggaacugcccgagacaauggaaacccuccuucugcugggccucaugauucugcuuacagggggagccaugcuguuucucaucuccggcaaagggauuggaaagaccucuaucggccugaucugugugauugucagcuccgggaugcuguggauggcugauguuccucuccaguggaucgccagcgccauugugcuugaguucuuuaugauggugcugcugauccccgagccggaaaaacaacggacaccucaggacaaccagcucgcuuaugucgugauuggaauccugacccuugccgcgauuguugccgcuaaugagaugggccugcucgaaacaaccaagagagaucugggcaugucuaaggagcccgggguggucucccccacgagcuaccuggacguggaccuccauccugccucugcuuggacacuuuaugccgucgcgaccacagugaucaccccgaugcugcgccacaccaucgaaaacagcacagccaauguuucccuggcugccauugcuaaccaagccgugguccucaugggacuggauaaaggcuggcccaucucuaagauggaccuuggggugccucugcucgcucugggaugcuacagccagguuaacccccugacgcucaccgccgcggugcuucugcuggucacacauuacgccauuaucggcccugggcuccaggcuaaagccacccgggaggcucagaagagaacagccgccggaauuaugaaaaaucccaccguggauggcaucaugacgaucgaccuggauccugugauuuaugacuccaaguucgagaagcaacuuggccagguuaugcugcucguccugugugcggugcagcugcuccuuaugcgcacaucuugggcucugugcgaagcccugacccucgcuaccgggccgaucacaacccugugggagggaagccccggcaaauuuuggaacacaacgauugccguguccauggccaauaucuuccgggggagcuaccuugcuggagccggccuggcguuuucuauuaugaaguccgucgggaccggaagacggggcacaggcagccagggggaaacccucggagagaaauggaagaaaaagcugaaccaacugucccgcaaggaguucgaucucuauaaaaagucuggcaucacagagguugacagaaccgaggccaaagaagggcuuaagcggggagagacgacccaccaugcugugagccgcggcuccgccaaacugcagugguuuguggaaagaaauauggucaucccugaggggcgggugauugaucugggauguggccgcggcggguggucuuacuauugcgcuggacucaagaaaguuacagaagugagaggcuacaccaaagggggacccggccacgaggagccuguccccaugagcacauauggguggaacaucgugaagcugauguccggaaaagacguuuucuaccuuccgccugaaaagugugauacccugcucugcgacauuggcgagagcucucccucccccacaguggaagagagccggaccauccgcguccugaaaaugguggagccuuggcugagaaauaaccaguucuguauuaaggugcucaaucccuacaugccuacggucaucgaacaccuugagcggcugcagagaaaauauggcgggaugcugguucgcaacccgcucucuagaaauuccacacaugaaauguacuggauuagcaacggaaccggcaauaucgugucuagcgugaacauggucuccagacugcuucugaaucgcuuuaccaugacacaccggagacccacgaucgagaaggauguggaccucggggccggaacccgccauguuaacgcggaaccugagacacccaacauggacgugauuggcgagcggaucaagagaauuaaagaagaacacucuagcaccuggcacuaugaugacgaaaauccuuacaagacaugggccuaucauggguccuacgaggucaaagcuaccggaagcgccuccucuaugaucaacggcgugguuaagcugcugacaaaacccugggauguggucccgauggugacccaaauggcuaugacggacaccacaccuuucggccagcagcgcguuuuuaaggaaaagguggauacccggacacccagaccuaugcccgggacccgcaaagucauggagauuacggccgaguggcucuggcggacacugggaagaaauaagaaaccucgccuuugcaccagagaagaguucacaaagaaagugcggaccaacgcugccaugggcgcggucuuuacggaagagaaucaaugggacagcgcccgcgcugccguggaagaugaggaguucuggaagcugguugacagagaacgggagcuccacaagcuggggaaauguggauccugcguguauaacaugaugggcaagagagagaagaaacuuggggaguuuggcaaagcuaagggaucucgggccaucugguacauguggcugggcgcccgcuaccucgaguucgaagcgcugggguuucugaaugaggaucauugguucagcagagaaaacuccuauucuggagucgagggcgaagggcuccacaaacugggauacauccuucgggacauuagcaagauccccggcggggcuauguaugccgaugacaccgccggcugggacacacgcauuaccgaggaugaccugcauaaugaggaaaagaucacacagcagauggauccggagcacagacagcucgcuaacgccauuuuuaaacugaccuaccaaaauaagguggugaaaguucagcggccuacacccaagggaaccgugauggacaucaucucccgcaaagaucagagaggcagcgggcaggucggaacguauggccuuaacacauucaccaauauggaagcucaacuggugcggcagauggagggggaaggaguucucucuaaggccgaccuggagaacccccaucugcucgagaagaaaauuacccaguggcuggaaacaaagggcguggagcgccuuaaaagaauggcgaucuccggggaugacugcgucgugaagccuauugaugaccgguuugccaaugcucugcucgcccugaacgauaugggcaaaguccgcaaggacaucccgcaguggcaacccagcaagggauggcaugauuggcaacaggugccuuucuguucucaccauuuccacgaacuuauuaugaaagacggcagaaagcugguugugcccugccggccucaggacgagcucaucgggcgcgcuagaaucucccaaggagccggcuggagccugaaagaaaccgcgugucuggggaaggccuacgcucagauguggucucucauguauuuucaccggagagaucugcgccuugccuccaacgcuauuugcagcgccguccccgugcauuggaucccuacaucccggacgaccuggagcauucacgcucaucaccaguggaugacaaccgaggacaugcugacaguuuggaauagaguguggaucgaggauaaccccuggauggaagacaaaaccccggucacgaccugggaggaugugccuuaccucggaaagcgcgaagaccaaugguguggcucucugauugggcuuacaagccgggccaccugggcgcagaauauccugacagccauucaacaggugagaucccucaucggcgaugaggaguuccuggacuacaugcccucuaugaagcgcuuucggaaagaagaggaaagcgagggagcuaucugguga

SEQ ID NO: 20503 - RNA, 9873 nt, Artificial Sequence
  derived and/or modified CDS sequence (opt5) from DENV-3__FJ639725__SS-prME
accucccugugccucaugaugaugcugcccgccacccuugcuuuccaccugacgucccgggacggcgaaccucggaugaucguggggaagaacgaacgcggaaagucucuccuguuuaagaccgccagcggcauuaauauguguacccuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcuccgggaucuucguuaccaacgaggugcacacauggacggagcaguacaaguuucaagcugacagccccaaacggcucgccaccgcgauugccggcgcuugggaaaauggagucuguggcaucagaucuacaacccgcauggagaaccugcuguggaagcagauugccaaugaacucaacuauauccugugggagaauaacaucaaacuuacagugguugugggggauauuaucggaguccuggaacagggcaagcggacccucacgccucagcccauggagcugaaauacuccuggaagaccugggggaaggcuaaaauugugacagccgagacccaaaauagcucuuucaucauugacggaccuaacacacccgaaugcccguccgccagcagagcuuggaacgugugggaggucgaagacuauggcuuuggcguuuucaccacaaauaucuggcugaaacuucgcgagguguacacccaguccugugaucaucggcucaugucugcggccaucaaagacgaaagagcugugcacgccgauaugggguacuggauugagagccagaagaacggauccuggaaacuggagaaggccucuuuuaucgaagucaagacgugcacauggccuaaaagccacacccugugguccaauggcgugcucgagagcgacaugauuauccccaagucucuggcugggccuauuucccagcauaaccaccgccccggauaucauacccaaacagccggcccuuggcaccuugggaaacuggaacucgauuucaauuacugcgagggaaccacgguugugaucacagagaacuguggcacccggggccccagccugagaacaaccacagucucugggaagcugauccacgaauggugcugucgcuccugcacccuuccgccucuccgguauaugggagaggacggcuguugguacgggauggaaauuagacccaucaaugagaaagaagagaacaugguuaagagccuggugucugcgggaagcggcaagguggauaauuuuacgauggggguccugugccucgcuauucuguucgaggaagugaugcggggaaaauucggcaagaaacauaugaucgccggcguucuuuuuaccuucgugcugcuccuguccgggcagauuacauggcgcgacauggcccacacccugaucaugauuggaagcaacgcuucugauagaaugggcaugggggucacauaucuugcccugaucgcgaccuuuaagauccagcccuuccucgcucugggauuuuuccuccggaaacugacguccagagagaaucuucugcucggcguggggcuggccauggccacaacccugcaacuuccugaagacauugagcagauggcuaacggaaucgcccugggccucaugacacugaagcucauuacccaguuugaaaccuaccagcuguggacagcucuugugagccugacguguuccaauaccaucuucacacucaccgucgccuggcgcacagcgacccugauucuggccggcguuucucuucugccgcucugccaaagcuccucuaugcggaagacggauuggcugcccaugacaguggcugccaugggggugccuccccucccucuguuuaucuucagccuuaaagacacccccaagagacgcuccuggccucugaacgagggagucauggcugugggccugguuucuauccucgccagcucccugcuuagaaaugaugugcccauggccgggccgcuggucgcuggaggccuccugauugcguguuaugugaucaccgggacaagcgccgaccucaccguugagaaagcugccgacgugacaugggaagaggaagccgagcagacgggagucucucauaaccugaugauuaccguggaugacgauggcacaaugcggaucaaggacgaugaaaccgagaacauucuuacaguccugcugaaaaccgcucuccugaucguguccggcaucuuuccuuacagcauucccgccacgcuucugguuuggcacaccuggcagaagcagacacaacgcucuggggugcucugggacgucccuucucccccggagacccagaaagcggaacuggaggaaggaguguacagaaucaagcagcagggcauuuucgggaagacacaaguuggagugggcguccagaaagaggggguguuucauaccauguggcacgugacacggggagcuguucucacgcacaauggcaagcgccuggagccuaacugggccagcgucaaaaaggaucuuaucagcuauggcgggggauggagacuguccgcccaguggcaaaaaggcgaagagguccaggugauugcugucgaacccgggaagaauccuaagaacuuccagaccaugcccggaaucuuccagacaaccaccggcgagauuggggccaucgcgcuggacuuuaaacccggaacaagcggcuccccuaucauuaaucgggaaggcaaggugguugggcucuacggaaacggcguggucacgaaaaaugggggauaugugagcggcaucgcucaaaccaacgccgagccggaugggcccacaccugagcuggaagaggaaauguucaagaaacgcaaucuuaccauuauggaccugcaucccggcucuggaaagacaagaaaguaccucccugccaucguucgggaggcuauuaaacgcagacugcggacccucauccuggcccccacgagaguggucgcugccgaaauggaggaggcgcuuaagggccugccuauccgcuaucagacaaccgccaccaaaagcgaacacacagggcgggagauuguggaucugaugugccaugcuaccuuuacaaugagacuccuguccccgguucgcgugcccaacuacaaucuugucaucauggacgaagcccacuucaccgauccugcuucuauugccgcccggggauauaucagcacgagagugggcaugggggaggcugcggccauuuuuaugacagcuacacccccuggaacagccgaagccuucccccaguccaacgcuccgauccaggacgaggagcgcgacaucccugaacggucuuggaauagcggcaacgaguggauuaccgauuuuguggggaagacggucugguucguucccuccaucaaagccggcaaugacauugcgaacugucugagaaagaacggaaagaaagugauccaacucucucgcaagaccuuugauacagaauaccagaaaacccggcugaaugacugggauuucguggucacaaccgacauuagcgagaugggcgcuaacuuuaaggccgauagagugaucgacccccggcgcugccugaaaccuguuauucucacagaugggcccgagagagugauccuugccggaccuaugccggucaccgcugccuccgcggcccagcggcgcggcagaguggggcggaauccccagaaggaaaacgaccaauacaucuucacgggacagccucugaauaacgaugaggaccaugcucacuggacagaagccaagaugcugcucgacaauauuaacacccccgagggcaucauuccugcucuguucgaacccgagagagagaaaagcgccgcuaucgauggggaauaucgccuuaagggcgagucucggaaaaccuuuguugaacugaugagacgcggagaccucccgguguggcuggcccacaaggucgcguccgagggcauuaaauacacagaucggaaguggugcuucgacggggaaagaaauaaccagauccuggaggagaauauggauguggaaaucuggaccaaagagggagaacgcaagaagcuccggccuagauggcuugacgcccgcacauauagcgauccccuggcucugaaagaguuuaaggacuucgccgcuggcagaaaaucuauugcccucgaucuggucacggaaaucgggcgggugccuucccaucuugcccaccgcaccagaaacgcucuggacaaucucguuaugcugcauacaagcgagcacggaggccgggcguaccgccacgccguggaggaacugcccgagaccauggaaacacuccuucugcugggccucaugauucugcuuaccgggggagcuaugcuguuucucaucuccggcaaggggauuggaaaaacgucuaucggccugaucugugugauugccagcuccgggaugcuguggauggccgaugucccucuccaguggaucgcuagcgccauuguucuugaguucuuuaugauggugcugcugauccccgagccggaaaagcaaagaaccccucaggacaaccagcucgcguauguggucauuggaauccugacacuugccgcuauuguggccgcuaaugagaugggccugcucgaaaccacaaagcgggaucugggcaugucuaaagagcccgggguugugucccccaccagcuaccuggacgucgaccuccauccugccucugcguggacgcuuuaugccguggcuacaaccgucaucacaccgaugcugagacacaccaucgaaaacagcaccgccaaugugucccuggcugccauugcuaaccaagccguugugcucaugggacuggauaagggcuggcccaucucuaaaauggaccuuggggucccucugcucgcgcugggaugcuacagccaggugaacccccugacacucacggccgcuguucuucugcuggugacccauuacgccauuaucggcccugggcuccaggcuaaggccacacgcgaggcccagaaacggaccgcggcuggaauuaugaagaaucccacagucgauggcaucaugaccaucgaccuggauccugugauuuaugacuccaaguucgagaaacaacuuggccaggugaugcugcucguucugugugccguccagcugcuccuuaugagaacgucuugggcucugugcgaagcccugacacucgccaccgggccgaucaccacacugugggagggaagccccggcaaguuuuggaacaccacaauugcuguguccauggccaauaucuuccgcgggagcuaccuugcgggagccggccuggcuuuuucuauuaugaaauccguggggacgggacggagaggcaccggcagccagggggaaacacucggagagaaguggaaaaagaagcugaaccaacugucccggaaagaguucgaucucuauaagaaaucuggcaucaccgaggucgaccgcacagaggccaaggaagggcuuaaaagaggagagaccacgcaccaugcuguuagccggggcuccgccaagcugcagugguuuguggaacgcaauauggugaucccugaggggagagucauugaucugggauguggccggggcggguggucuuacuauugcgcgggacucaaaaaggugaccgaaguucgcggcuacacaaaaggcgggcccgggcacgaggagccugugcccaugagcaccuauggguggaacaucgucaaacugauguccggaaaggacguguucuaccuuccgccugaaaaaugugauacacugcucugcgacauuggcgagagcucucccucccccaccguugaagagagcagaacaauccgggugcugaagauggucgagccuuggcugcgcaauaaccaguucuguauuaaagugcucaaucccuacaugccuaccgugaucgaacaccuugagagacugcagcggaaguauggcgggaugcuggucagaaacccgcucucucgcaauuccacgcaugaaauguacuggauuagcaacggaacaggcaauaucguuucuagcgugaacauggugucccggcugcuucugaauagauuuaccaugacccaccgccggcccacaaucgagaaggaugucgaccucggggccggaacgagacaugugaacgcugaaccugagacccccaacauggacguuauuggcgagcgcaucaaacggauuaaggaagaacacucuagcacauggcacuaugaugacgaaaauccuuacaaaaccugggccuaucauggguccuacgaggugaaggcuacaggaagcgccuccucuaugaucaacggcgucgugaaacugcugaccaagcccugggauguugugccgauggucacacaaauggcuaugaccgacacgaccccuuucggccagcagagaguguuuaaggaaaaaguugauacacgcacaccccggccuaugcccgggacaagaaaggugauggagauuaccgccgaguggcucuggcgcacgcugggacggaauaaaaagccuagacuuugcacacgcgaagaguucaccaaaaaggucagaacaaacgcggccaugggcgcuguguuuaccgaagagaaucaaugggacagcgcccgggcugccgucgaagaugaggaguucuggaagcugguggaccgcgaaagagagcuccacaaacuggggaaguguggauccugcguuuauaacaugaugggcaaacgggaaaagaaacuuggggaguuuggcaaggccaaaggaucuagagcgaucugguacauguggcugggcgcucgguaccucgaguucgaagcccugggguuucugaaugaggaucauugguucagccgcgaaaacuccuauucuggaguggagggcgaagggcuccacaagcugggauacauccuuagagacauuagcaagauccccggcggggccauguaugcugaugacacggccggcugggacacccggauuacagaggaugaccugcauaaugaggagaagaucacccagcagauggauccggagcaccgccagcucgcuaacgccauuuuuaagcugacauaccaaaauaaagucgugaaggugcagagaccuacccccaaaggaacaguuauggacaucaucucccggaaggaucagcgcggcagcggacaggugggaaccuauggccuuaacacguucacaaauauggaagcgcaacuggucagacagauggagggggaaggagugcucucuaaggccgaccuggagaacccccaucugcucggcaaaaagauuacccaguggcuggagaccaaagggguugaacggcuuaagcgcauggcuaucuccggcgaugacugcguggucaaaccuauugaugacagauuugccaaugcucugcucgcccugaacgauaugggaaaggugcggaaggacaucccgcaguggcaacccagcaaaggcuggcaugauuggcagcaggucccuuucuguucucaccauuuccacgagcuuauuaugaaggacgggcgcaaacuggugguucccugcagaccucaggacgaacucaucggacgggcgcgcaucucccaaggcgccggguggagccugaaggagacagcuugucugggaaaagccuacgcucagauguggucucucauguauuuucacagacgggaucugagacuugccuccaacgcuauuugcagcgccgugcccguccauuggaucccuaccucccgcacaacguggagcauucacgcgcaucaccaguggaugaccacagaagacaugcugaccguguggaaucggguuuggaucgaggauaaccccuggauggaggacaagacaccggugaccacgugggaagaugucccuuaccucggcaagagagaggaccaauggugugggucucugauuggccuuaccagccgcgccacaugggcucagaauauccugaccgccauucaacaggugcggucccucaucggagaugaagaguuccuggacuacaugcccucuaugaaaagauuucgcaaggaggaagagagcgaaggcgccaucugguga

SEQ ID NO: 20504 - RNA, 9873 nt, Artificial Sequence
  derived and/or modified CDS sequence (opt5) from DENV-3__FJ639726__SS-prME
accucccugugccucaugaugaugcugcccgccacacuugcuuuccaccugacgucccgggacggcgagccucggaugaucguggggaagaacgaacgcggaaagucucuccuguuuaagaccgccagcggcauuaauauguguacccuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcacagacgggacaagcgcucuguggcccuggcuccucacgucgggaugggacucgauaccagaacacagaccuggaugagcgccgagggcgcuuggagacagguggaacgcguugagacaugggcccugagacaucccggcuucaccauucuugcgcuguuucucgcccacuacaucgggacgucccugacacagaaaguggucaucuucauucuucugaugcucgugaccccuucuaugacaaugcgguguguuggagugggcaaccgcgacuuugucgaagggcugagcggagcuaccuggguggaugugguccuggagcauggcgggugcguuaccacaauggccaaguccaagcccacgcucgacaucgagcugcagaaaaccgaagcuacacagcuugccacccugagaaagcucuguauugagggaaaaaucacaaauauuaccacggauagccggugcccuacacagggcgaagcgacccugccggaggaacaggaccagaacuauguguguaagcacaccuacguggaucgcggcugggggaauggaugcggccuuuucgggaaaggaucucuggucacaugcgccaaguuucaaugucucgagcccaucgagggcaaggugguucaguaugaaaaccugaaauacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccuagaacgggacuugauuucaacgagaugauucugcucaccaugaagaauaaggcuuggaugguccaccggcagugguuuuucgaccugccccuuccguggacaucuggcgccaccacagagaccccuacguggaaccgcaaggaacugcucgugacauuuaaaaaugcccaugcuaagaaacaagagguugugguccuggggucccaggaaggagcgaugcacaccgcccugacaggcgcuaccgagauccagaacagcgggggcaccucuauuuucgccggacaccucaaguguagacugaagauggauaaacuugaacugaagggcauguccuacgccaugugccucaauacauuugugcugaaaaaggagguuagcgagacgcagcaugggaccauccugauuaaaguggaauacaagggagaggacgcucccuguaagaucccuuucuccacagaagauggccaagggaaagcccacaacggacggcuuaucaccgcgaaccccgucgugacaaagaaagaggagcccgugaauauugaagcugagccuccguucggcgaaucuaacaucguuauugggaucggcgacaaggcccucaaaauuaauugguauaagaagggaagcuccaucggcaaaauguuugaggccaccgcuagaggggcccgccggauggcuauccugggagauacggccugggacuucggcagcgucgggggagugcugaacucucucggcaagauggugcaucagauuuuuggguccgcguacacagcccuguucagcggcgucucuuggaucaugaaaauuggaaucggcgugcuucugaccuggauugggcucaauagcaagaacaccuccaugucuuuuagcugcaucguuauuggaaucaucacacuguaucugggcgcugugguccaggccgauauggggugugugauuaauuggaaaggaaaggaacuuaagugcggcuccgggaucuucguuaccaacgaggugcacacauggacggagcaguacaaauuucaagcugacagccccaagagacucgccaccgcgauugccggcgcuugggaaaauggagucuguggcauccgcucuacaacccggauggagaaccugcuguggaaacagauugccaaugaacucaacuauauccugugggagaauaacaucaaacuuacagugguugugggggauauuaucggaguccuggaacagggcaaaagaacccucacgccucagcccauggagcugaaguacuccuggaaaaccugggggaaggcuaagauugugacagccgagacccaaaauagcucuuucaucauugacggaccuaacacacccgaaugcccguccgccagccgcgcuuggaacgugugggaggucgaagacuauggcuuuggcguuuucaccacaaauaucuggcugaaacuucgggagguguacacccaguccugugaucauagacucaugucugcggccaucaaggacgaacgcgcugugcacgccgauaugggguacuggauugagagccagaaaaacggauccuggaagcuggagaaagccucuuuuaucgaagucaagacgugcacauggccuaagagccacacccugugguccaauggcgugcucgagagcgacaugauuauccccaaaucucuggcugggccuauuucccagcauaaccaccggcccggauaucauacccaaacagccggcccuuggcaccuugggaagcuggaacucgauuucaauuacugcgagggaaccacgguugugaucacagagaacuguggcaccagaggccccagccugcgcacaaccacagucucugggaaacugauccacgaauggugcugucgguccugcacccuuccgccucucagauauaugggagaggacggcuguugguacgggauggaaauucggcccaucaaugagaaggaagagaacauggugaaaagccugguuucugcgggaagcggcaagguggauaauuuuacgauggggguccugugccucgcuauucuguucgaggaagugaugcgcggaaaguucggcaaaaagcauaugaucgccggcguucuuuuuaccuucgugcugcuccuguccgggcagauuacauggagagacauggcccacacccugaucaugauuggaagcaacgcuucugaucggaugggcaugggggucacauaucuugcccugaucgcgaccuuuaaaauccagcccuuccucgcucugggauuuuuccucagaaagcugacgucccgcgagaaucuucugcucggcguggggcuggccauggccacaacccugcaacuuccugaagacauugagcagauggcuaacggaaucgcccugggccucaugacacugaaacucauuacccaguuugaaaccuaccagcuguggacagcucuugugagccugacguguuccaauaccaucuucacacucaccgucgccuggcggacagcgacccugauucuggccggcguuucucuucugccgcucugccaaagcuccucuaugagaaagacggauuggcugcccaugacaguggcugccaugggggugccuccccucccucuguuuaucuucagccuuaaggacacccccaaacgcagauccuggccucugaacgagggagucauggcugugggccugguuucuauccucgccagcucccugcuucggaaugaugugcccauggccgggccgcuggucgcuggaggccuccugauugcguguuaugugaucaccgggacaagcgccgaccucaccguugagaaggcugccgacgugacaugggaagaggaagccgagcagacgggagucucucauaaccugaugauuaccguggaugacgauggcacaaugcgcaucaaagacgaugaaaccgagaacauucuuacaguccugcugaagaccgcucuccugaucguguccggcaucuuuccuuacagcauucccgccacgcuucugguuuggcacaccuggcagaaacagacacaaagaucuggggugcucugggacgucccuucucccccggagacccagaaggcggaacuggaggaaggaguguaccggaucaaacagcagggcauuuucgggaagacacaaguuggagugggcguccagaaggaggggguguuucauaccauguggcacgugacacgcggagcuguucucacgcacaauggcaaaagacuggagccuaacugggccagcgucaagaaagaucuuaucagcuauggcgggggauggcggcuguccgcccaguggcaaaagggcgaagagguccaggugauugcugucgaacccgggaaaaauccuaagaacuuccagaccaugcccggaaucuuccagacaaccaccggcgagauuggggccaucgcgcuggacuuuaagcccggaacaagcggcuccccuaucauuaaucgcgaaggcaaagugguugggcucuacggaaacggcguggucacgaagaaugggggauaugugagcggcaucgcucaaaccaacgccgagccggaugggcccacaccugagcuggaagaggaaauguucaaaaagagaaaucuuaccauuauggaccugcaucccggcucuggaaaaacacggaaguaccucccugccaucguucgcgaggcuauuaagagacggcugagaacccucauccuggcccccacgcgcguggucgcugccgaaauggaggaggcgcuuaaaggccugccuauccgguaucagacaaccgccaccaagagcgaacacacagggagagagauuguggaucugaugugccaugcuaccuuuacaaugcgccuccuguccccgguucgggugcccaacuacaaucuugucaucauggacgaagcccacuucaccgauccugcuucuauugccgccagaggauauaucagcacgcgcgugggcaugggggaggcugcggccauuuuuaugacagcuacacccccuggaacagccgaagccuucccccaguccaacgcuccgauccaggacgaggagcgggacaucccugaaagaucuuggaauagcggcaacgaguggauuaccgauuuuguggggaaaacggucugguucguucccuccaucaaggccggcaaugacauugcgaacugucugcgcaaaaacggaaagaaggugauccaacucucucggaaaaccuuugauacagaauaccagaagaccagacugaaugacugggauuucguggucacaaccgacauuagcgagaugggcgcuaacuuuaaagccgaucgggugaucgacccccgcagaugccugaagccuguuauucucacagaugggcccgagcgggugauccuugccggaccuaugccggucaccgcugccuccgcggcccagcgcagaggccggguggggagaaauccccagaaagaaaacgaccaauacaucuucacgggacagccucugaauaacgaugaggaccaugcucacuggacagaagccaagaugcugcucgacaauauuaacacccccgagggcaucauuccugcucuguucgaacccgagcgcgaaaagagcgccgcuaucgauggggaauaucggcuuaaaggcgagucuagaaagaccuuuguugaacugaugcgccggggagaccucccgguguggcuggcccacaaagucgcguccgagggcauuaaguacacagauagaaaauggugcuucgacggggaacgcaauaaccagauccuggaggagaauauggauguggaaaucuggaccaaggagggagaacggaaaaagcucagaccucgcuggcuugacgccagaacauauagcgauccccuggcucugaaggaguuuaaagacuucgccgcuggccggaagucuauugcccucgaucuggucacggaaaucgggcgcgugccuucccaucuugcccacagaacccggaacgcucuggacaaucucguuaugcugcauacaagcgagcacggaggccgcgcguacagacacgccguggaggaacugcccgagaccauggaaacacuccuucugcugggccucaugauucugcuuaccgggggagcuaugcuguuucucaucuccggcaaagggauuggaaagacgucuaucggccugaucugugugauugucagcuccgggaugcuguggauggccgauguuccucuccaguggaucgccagcgcuauugugcuugaguucuuuaugauggugcugcugauccccgagccggaaaaacaacggaccccucaggacaaccagcucgccuaugucgugauuggaauccugacacuugcggccauuguugcugccaaugagaugggccugcucgaaaccacaaagagagaucugggcaugucuaaggagcccgggguggucucccccaccagcuaccuggacguggaccuccauccugcuucugccuggacgcuuuaugcggucgccacaaccgugaucacaccgaugcugcgccacaccaucgaaaacagcaccgcuaauguuucccuggccgcuauugccaaccaagcugugguccucaugggacuggauaaaggcuggcccaucucuaagauggaccuuggggugccucugcucgcccugggaugcuacagccagguuaacccccugacacucacggcggccgugcuucugcuggucacccauuacgcuauuaucggcccugggcuccaggccaaagcuacacgggaggcccagaagagaaccgccgcgggaauuaugaaaaaucccacaguggauggcaucaugaccaucgaccuggauccugugauuuaugacuccaaguucgagaagcaacuuggccagguuaugcugcucguccugugugcugugcagcugcuccuuaugcgcacgucuugggcccugugcgaagcucugacacucgccaccgggccgaucaccacacugugggagggaagccccggcaaauuuuggaacaccacaauugccguguccauggcuaauaucuuccgggggagcuaccuugccggagcgggccuggccuuuucuauuaugaaguccgucgggacgggaagacggggcaccggcagccagggggaaacacucggagagaaauggaagaaaaagcugaaccaacugucccgcaaggaguucgaucucuauaaaaagucuggcaucaccgagguugacagaacagaggcuaaagaagggcuuaagcggggagagaccacgcaccaugccgugagccgcggcuccgcuaaacugcagugguuuguggaaagaaauauggucaucccugaggggcgggugauugaucugggauguggccgcggcggguggucuuacuauugcgccggacucaagaaaguuaccgaagugagaggcuacacaaaagggggacccggccacgaggagccuguccccaugagcaccuauggguggaacaucgugaagcugauguccggaaaagacguuuucuaccuuagcccggaaaagugugauacacugcucugcgacauuggcgagucuuccccuagccccaccguggaagagucucggacaauccgcguccugaaaaugguggagcccuggcugagaaauaaccaguucuguauuaaggugcucaauccuuacaugcccaccgucaucgaacaccuugagcggcugcagagaaaauauggcgggaugcugguucgcaacccucucucccggaauagcacgcaugaaauguacuggauuucuaacggaacaggcaauaucgugagcuccgugaacauggucucuagacugcuucugaaucgcuuuaccaugacccaccggagaccgacaaucgagaaggauguggaccucggggcgggaacgcgccauguuaacgccgaacccgagaccccuaacauggacgugauuggcgagcggaucaagagaauuaaagaagaacacagcuccacauggcacuaugaugacgaaaaucccuacaagaccugggcuuaucaugggagcuacgaggucaaagccacaggauccgcuucuagcaugaucaacggcgugguuaagcugcugaccaaaccuugggaugugguccccauggugacacaaauggccaugaccgacacgaccccguucggccagcagcgcguuuuuaaggaaaagguggauacacggaccccuagacccaugccugggacacgcaaagucauggagauuaccgcugaguggcucuggcggacgcugggaagaaauaagaaaccccgccuuugcacaagagaagaguucaccaagaaagugcggacaaacgccgcgaugggcgccgucuuuaccgaagagaaucaaugggacuccgcucgcgccgcuguggaagaugaggaguucuggaagcugguugacagagaacgggagcuccacaagcuggggaaauguggaucuugcguguauaacaugaugggcaagagagagaagaaacuuggggaguuuggcaaagccaagggaagccgggccaucugguacauguggcugggcgcgcgcuaccucgaguucgaagcucugggguuucugaaugaggaucauugguucuccagagaaaacucuuauagcggagucgagggcgaagggcuccacaaacugggauacauccuucgggacauuuccaagaucccuggcggggccauguaugccgaugacacggcuggcugggacacccgcauuacagaggaugaccugcauaaugaggaaaagaucacccagcagauggaucccgagcacagacagcucgccaacgcuauuuuuaaacugacauaccaaaauaagguggugaaaguucagcggccgaccccuaagggaacagugauggacaucaucagccgcaaagaucagagaggcucugggcaggucggaaccuauggccuuaacacguucacaaauauggaagcccaacuggugcggcagauggagggggaaggaguucucuccaaggcggaccuggagaacccccaucugcucgagaagaaaauuacccaguggcuggaaaccaagggcguggagcgccuuaaaagaauggccaucagcggggaugacugcgucgugaagcccauugaugaccgguuugcuaaugcccugcucgcucugaacgauaugggcaaaguccgcaaggacaucccucaguggcaaccgucuaagggauggcaugauuggcaacaggugcccuucuguucccaccauuuccacgaacuuauuaugaaagacggcagaaagcugguugugccuugccggccccaggacgagcucaucgggcgcgccagaaucagccaaggagcgggcuggucucugaaagaaacagccugucuggggaaggcuuacgcccagauguggucccucauguauuuucaccggagagaucugcgccuugcuagcaacgccauuugcuccgcugucccugugcauuggauccccaccagccggacaacguggucuauucacgcccaucaccaguggaugaccacagaggacaugcugaccguuuggaauagaguguggaucgaggauaacccuuggauggaagacaaaacacccgucaccacgugggaggaugugccguaccucggaaagcgcgaagaccaaugguguggcagccugauugggcuuaccucccgggcgacaugggcccagaauauccugaccgcuauucaacaggugagaucucucaucggcgaugaggaguuccuggacuacaugccuagcaugaagcgcuuucggaaagaagaggaauccgagggagccaucugguga

SEQ ID NO: 20505 - RNA, 9873 nt, Artificial Sequence
  derived and/or modified CDS sequence (opt5) from DENV-3__KF955333__SS-prME
acaucccugugccucaugaugaugcugcccgccacacuugcuuuccaccugacgucccgggacggcgaaccucggaugaucguggggaagaacgaacgcggaaaaucucuccuguuuaagaccgccagcggcauuaauauguguacacuuaucgcgauggaucugggggaaaugugcgacgauaccgucacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacaaaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugcuauuaauuggaagggaaaggaacuuaaaugcggcuccgggaucuucgugaccaacgagguucacacauggacggagcaguacaaguuucaagccgacagccccaaacggcucgcgaccgccauugcuggcgccugggaaaauggaguguguggcaucagaucuacaacccgcauggagaaccugcuguggaagcagauugcuaaugaacucaacuauauccugugggagaauaacaucaaacuuacagucgugguuggggauauuaucggagugcuggaacagggcaagcggacccucacgccucagcccauggagcugaaauacuccuggaagaccugggggaaggccaaaauugucacagccgagacccaaaauagcucuuucaucauugacggaccuaacacacccgaaugcccguccgcuagcagagcguggaacgugugggagguggaagacuauggcuuuggcgucuucaccacaaauaucuggcugaaacuucgcgagguuuacacccaguccugugaucaucggcucaugucugccgcuaucaaagacgaaagagccgcccacgcugauaugggguacuggauugagagccagaagaacggauccuggaaacuggagaaggccucuuuuaucgaagugaagacgugcacauggccuaaaagccacacccugugguccaauggcgugcucgagagcgacaugauuauccccaagucucuggcggggccuauuucccagcauaaccaccgccccggauaucauacccaaacagcuggcccuuggcaccuugggaaacuggaacucgauuucaauuacugcgagggaaccacggucgugaucacagagaacuguggcacccggggccccagccugagaacaaccacaguuucugggaagcugauccacgaauggugcugucgcuccugcacccuuccgccucuccgguauaugggagaggacggcuguugguacgggauggaaauuagacccaucaaugagaaagaagagaacauggucaagagccuggugucugccggaagcggcaagguggauaauuuuacgauggggguucugugccucgccauucuguucgaggaagugaugcggggaaaauucggcaagaaacauaugaucgcuggcguccuuuuuaccuucgugcugcuccuguccgggcagauuacauggcgcgacauggcccacacccugaucaugauuggaagcaacgcgucugauagaaugggcauggggguuacauaucuugcucugaucgccaccuuuaagauccagcccuuccucgcccugggauuuuuccuccggaaacugacguccagagagaaucuucugcucggcguggggcuggcuauggccacaacccugcaacuuccugaagacauugagcagauggcuaacggaaucgcccugggccucaugacacugaagcucauuacccaguuugaaaccuaccagcuguggacagcgcuugucagccugacguguuccaauaccaucuucacacucaccguggccuggcgcacagcuacccugauucuggccggcgugucucuucugccgcucugccaaagcuccucuaugcggaagacggauuggcugcccaugacagucgcugccauggggguuccuccccucccucuguuuaucuucagccuuaaagacacccccaagagacgcuccuggccucugaacgagggagugauggccgugggccuggucucuauccucgcuagcucccugcuuagaaaugaugugcccauggcggggccgcugguugccggaggccuccugauugcuuguuaugugaucaccgggacaagcgccgaccucaccgucgagaaaccugccgacgugcccugggaagaggaagcugagcagacaggaguuucucauaaccugaugauuacgguggaugacgauggcccuaugcggaucaaggacgaugaaaccgagaacauucuuacaguccugcugaaaaccgcccuccugaucguguccggcaucuuucccuacagcauuccggcgacacuucuggucuggcacaccuggcagaagcagacgcaacgcucuggggugcucugggacguuccuucucccccugagacccagaaagcugaacuggaggaaggaguguacagaaucaagcagcagggcauuuucgggaagacacaagucggagugggcguucagaaagaggggguguuucauaccauguggcacgucacacggggagccgugcucacccacaauggcaagcgccuggagcccaacugggccagcgugaaaaaggaucuuaucagcuauggcgggggauggagacugaaugcucaguggcaaaaaggcgaagagguucaggucauugccguggaacccgggaagaacccuaagaauuuccagacaaugccgggaaucuuccagacgaccacaggcgagauuggggcgaucgcucuggacuuuaaacccggaaccuccggcagcccuaucauuaaccgggaaggcaagguggucgggcucuacggaaauggcgugguuaccaaaaacgggggauauguguccggcaucgcccaaacaaaugccgagcccgaugggccuacgcccgagcuggaagaggaaauguucaagaaacgcaaccuuaccauuauggaccugcauccuggcagcggaaagacaagaaaguaccucccggcuaucguccgggaggccauuaaacgcagacugcggacccucauccuggcucccacaagagugguugccgcggaaauggaggaggcccuuaagggccugccuauccgcuaucagaccacggcuacaaaaucugaacacaccgggcgggagauuguggaucugaugugccaugccaccuuuacaaugagacuccugagccccguccgcgugccuaauuacaaccuuguuaucauggacgaagcucacuucaccgaucccgccuccauugccgcucggggauauaucucuacaagagugggcaugggggaggcggccgcuauuuuuaugaccgccacgccgccuggaacagccgaggcuuucccccagagcaaugcccccauccaggacgaggagcgcgacaucccugaacgguccuggaacucuggcaaugaguggauuaccgauuuugucgggaagacagugugguucgugcccagcaucaaagcgggcaacgacauugcuaacugucugagaaagaauggaaagaaagucauccaacucucccgcaagaccuuugauacggaauaccagaaaacccggcugaacgacugggauuucguugugacaaccgacauuucugagaugggcgccaauuuuaaggccgauagagugaucgacccucggcgcugccugaaaccggucauucucacagaugggcccgagagagugauccuugcuggaccuaugcccguuaccgccgcgagcgccgcucagcggcgcggcagaguggggcggaacccucagaaggaaaaugaccaauacaucuucacaggacagccccugaacaaugaugaggaccaugcccacuggaccgaagcuaagaugcugcucgacaacauuaauacgccggagggcaucauuccugcccuguucgaacccgagagagagaaauccgcugccaucgauggggaauaucgccuuaagggcgagagccggaaaacauuugucgaacugaugagacgcggagaccucccuguguggcuggcgcacaagguugccucugagggcauuaaauacaccgaucggaaguggugcuucgacggggaaagaaacaaucagauccuggaggagaacauggauguggaaaucuggaccaaagagggagaacgcaagaagcuccggcccagauggcuugacgcucgcacauauuccgauccucuggcccugaaagaguuuaaggacuucgcugccggcagaaaaagcauugcccucgaucuggucaccgaaaucgggcgggugcccucucaucuugcucaccgcacaagaaaugcgcuggacaaccucgucaugcugcauacguccgagcacggaggccgggccuaccgccacgcuguggaggaacugccggagaccauggaaacacuccuucugcugggccucaugauucugcuuaccgggggagccaugcuguuucucaucagcggcaaggggauuggaaaaacauccaucggccugaucuguguuauugugucuagcgggaugcuguggauggccgaugugccucuccaguggaucgcuuccgccauuguccuugaguucuuuaugaugguucugcugauccccgagcccgaaaagcaaagaaccccucaggacaaucagcucgcguauguggugauuggaauccugacgcuugccgcuauugucgccgcuaacgagaugggccugcucgaaaccacaaagcgggaucugggcaugagcaaagagccgggggugguuucucccaccuccuaccuggacguggaccuccauccugccagcgcguggacacuuuaugccgucgcuaccacggugaucacacccaugcugagacacaccaucgaaaauucuacagccaacgucagccuggcugccauugcuaaccaagccgugguucucaugggacuggauaagggcuggccuaucuccaaaauggaccuuggggugccccugcucgcgcugggaugcuacucucaggucaauccucugacccucaccgccgcugugcuucugcugguuacacauuacgccauuaucggcccggggcuccaggcuaaggccacgcgcgaggcccagaaacggaccgcggcuggaauuaugaagaaccccacaguggauggcaucaugaccaucgaccuggauccugucauuuaugacagcaaguucgagaaacaacuuggccaggugaugcugcucgugcugugugccguucagcugcuccuuaugagaacauccugggcucugugcgaagcccugacccucgccacggggcccaucacaacccugugggagggaucuccuggcaaguuuuggaauaccacaauugcugucagcauggccaacaucuuccgcggguccuaccuugcgggagccggccuggcuuuuagcauuaugaaaucuguggggaccggacggagaggcacaggcucccagggggaaacgcucggagagaaguggaaaaagaagcugaaucaacugagccggaaagaguucgaucucuauaagaaauccggcaucaccgagguggaccgcacagaggccaaggaagggcuuaaaagaggagagaccacacaccaugcugucucucggggcagcgccaagcugcagugguuuguugaacgcaacauggugauccccgaggggagagugauugaucugggauguggccggggcgggugguccuacuauugcgcgggacucaaaaaggucaccgaagugcgcggcuacacgaaagggggaccgggccacgaggagccuguucccaugucuaccuauggguggaauaucgugaaacugaugagcggaaaggacgucuucuaccuucccccugaaaaaugugauacacugcucugcgacauuggcgaguccagccccucuccuaccguggaagaguccagaacaauccggguucugaagaugguggagccguggcugcgcaacaaucaguucuguauuaaaguccucaaccccuacaugccuaccgugaucgaacaccuugagagacugcagcggaaguauggcgggaugcuggugagaaauccccucagccgcaacucuacacaugaaauguacuggauuuccaauggaaccggcaacaucgucagcucuguuaauauggugagccggcugcuucugaacagauuuacgaugacacaccgccggccuaccaucgagaaggauguggaccucggggccggaaccagacaugucaacgcugaacccgagacaccgaauauggacgugauuggcgagcgcaucaaacggauuaaggaagaacacuccucuacguggcacuaugaugacgaaaacccuuacaaaaccugggccuaucaugggagcuacgagguuaaggcuacaggauccgccagcuccaugaucaauggcguggucaaacugcugaccaagcccugggaugugguuccuauggugacacaaauggcuaugaccgacacaacccccuucggccagcagagagucuuuaaggaaaaaguggauacgcgcaccccucggcccaugccggggacaagaaagguuauggagauuaccgccgaguggcucuggcgcacacugggacggaacaaaaagccuagacuuugcacccgcgaagaguucacgaaaaaggugagaacaaaugcggccaugggcgcugucuuuaccgaagagaaccaaugggacucugcccgggcugccguggaagaugaggaguucuggaagcuggucgaccgcgaaagagagcuccacaaacuggggaaguguggaagcugcguguauaauaugaugggcaaacgggaaaagaaacuuggggaguuuggcaaggccaaaggauccagagcgaucugguacauguggcugggcgcucgguaccucgaguucgaagcccugggguuucugaacgaggaucauugguucucucgcgaaaauagcuauuccggaguugagggcgaagggcuccacaagcugggauacauccuuagagacauuucuaagauccccggcggggccauguaugcugaugacacagccggcugggacacccggauuacggaggaugaccugcauaacgaggagaagaucaccgcucagauggaucccgagcaccgccagcucgccaaugcgauuuuuaagcugacauaccagaacaaaguggucaaggugcaaagaccuaccccgaaaggaacagugauggacaucaucagccggaaggaucagcgcggcuccgggcagguuggaaccuauggccuuaauacauucaccaacauggaagcccagcuggugagacaaauggagggggaaggaguccucagcaaggcugaccuggagaauccccaucugcucgagaaaaagauuacgcaguggcuggaaacaaaaggcguggagcggcuuaagcgcauggccaucucuggggaugacugcguugugaaaccuauugaugacagauuugcuaacgcccugcucgcgcugaacgauaugggcaagguccggaaggacaucccccaguggcagccuuccaaaggauggcaugauuggcaacaggugcccuucuguagccaccauuuccacgaacuuauuaugaaggacggccgcaaacuggucgugccuugcagaccccaggacgagcucaucgggcgggcccgcaucucucagggagcuggcuggucccugaaggaaaccgccugucuggggaaggcuuacgcccaaauguggagccucauguauuuucacagacgggaucugagacuugcuucuaaugccauuugcuccgcgguuccggugcauuggaucccuaccagccgcacaaccugguccauucacgcccaucaccaguggaugacaacggaggacaugcugaccgucuggaaccggguguggaucgaggauaaucccuggauggaagacaagacaccuguuaccacaugggaggaugugcccuaccucggaaagagagaagaccagugguguggcagccugauugggcuuaccucucgcgcuacgugggcccaaaacauccugaccgccauucagcagguccggagccucaucggcgaugaggaguuccuggacuacaugccguccaugaaaagauuucgcaaggaagaggaaucugagggagcuaucugguga

SEQ ID NO: 20506 - RNA, 9873 nt, Artificial Sequence
  derived and/or modified CDS sequence (opt5) from DENV-3__GQ868628__SS-prME
acaucccugugccucaugaugaugcugcccgccacacuugcuuuccaccugacgucccgggacggcgaaccucggaugaucguggggaagaacgaacgcggaaaaucucuccuguuuaagacagccagcggcauuaauauguguacacuuaucgcgauggaucugggggaaaugugcgacgauacagugacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacagcuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcuccgggaucuucguuaccaacgaggugcacacauggacggagcaguacaaguuucaagcugacagccccaaacggcucgccaccgcgauugccggcgcuugggaaaauggagucuguggcaucagaucuacaacccgcauggagaaccugcuguggaagcagauugccaaugaacucaacuauauccugugggagaauaacaucaaacuuacagugguugugggggauauuaucggaguccuggaacagggcaagcggacccucacgccucagcccauggagcugaaauacuccuggaagaccugggggaaggcuaaaauugugacagccgagacccaaaauagcucuuucaucauugacggaccuaacacacccgaaugcccguccgccagcagagcuuggaacgugugggaggucgaagacuauggcuuuggcguuuucaccacaaauaucuggcugaaacuucgcgagguguacacccaguccugugaucaucggcucaugucugcggccaucaaagacgaaagagcugugcacgccgauaugggguacuggauugagagccagaagaacggauccuggaaacuggagaaggccucuuuuaucgaagucaagacgugcgcuuggccuaaaagccacacacugugguccaauggcgugcucgagagcgacaugauuauccccaagucucuggccgggccuauuucccagcauaaccaccgccccggauaucauacccaaaccgcgggcccuuggcaccuugggaaacuggaacucgauuucaauuacugcgagggaacaaccguugugaucacggagaacuguggcacacggggccccagccugagaaccacaaccgucucugggaagcugauccacgaauggugcugucgcuccugcacacuuccgccucuccgguauaugggagaggacggcuguugguacgggauggaaauuagacccaucaaugagaaagaagagaacaugguuaagagccuggugucugcuggaagcggcaagguggauaauuuuaccauggggguccugugccucgccauucuguucgaggaagugaugcggggaaaauucggcaagaaacauaugaucgccggcguucuuuuuacguucgugcugcuccuguccgggcagauuaccuggcgcgacauggcucacacacugaucaugauuggaagcaacgccucugauagaaugggcaugggggucaccuaucuugcgcugaucgcuacauuuaagauccagcccuuccucgcccugggauuuuuccuccggaaacugaccuccagagagaaucuucugcucggcguggggcuggccauggcuacgacacugcaacuuccugaagacauugagcagauggccaacggaaucgcucugggccucaugacccugaagcucauuacacaguuugaaaccuaccagcuguggaccgcccuugugagccugacauguuccaauacgaucuucacccucacagucgcguggcgcaccgccacacugauucuggcuggcguuucucuucugccgcucugccaaagcuccucuaugcggaagaccgauuggcugcccaugacgguggccgcuaugggggugccuccccucccucuguuuaucuucagccuuaaagacacacccaagagacgcuccuggccucugaacgagggagucauggccgugggccugguuucuauccucgccagcucccugcuuagaaaugaugugcccauggcugggccgcuggucgcgggaggccuccugauugccuguuaugugaucaccgggaccagcgcugaccucacaguugagaaagccgccgacgugaccugggaagaggaagcugagcagacaggagucucucauaaccugaugauuacgguggaugacgauggcaccaugcggaucaaggacgaugaaacagagaacauucuuaccguccugcugaaaacagcccuccugaucguguccggcaucuuuccuuacagcauucccgcgacccuucugguuuggcacacguggcagaagcagacccaacgcucuggggugcucugggacgucccuucucccccggagacacagaaagcugaacuggaggaaggaguguacagaaucaagcagcagggcauuuucgggaagacccaaguuggagugggcguccagaaagaggggguguuucauacaauguggcacgugacccggggagccguucucacacacaauggcaagcgccuggagccuaacugggccagcgucaaaaaggaucuuaucagcuauggcgggggauggagacuguccgcucaguggcaaaaaggcgaagagguccaggugauugccgucgaacccgggaagaauccuaagaacuuccagacgaugcccggaaucuuccagaccacaaccggcgagauuggggcgaucgcucuggacuuuaaacccggaaccagcggcuccccuaucauuaaucgggaaggcaaggugguugggcucuacggaaacggcguggucaccaagaaugggggauaugugagcggcaucgcccaaacgaacgccgagccggaugggcccaccccugagcuggaagaggaaauguucaagaaacgcaaucuuacaauuauggaccugcaucccggcucuggaaagaccagaaaguaccucccugcuaucguucgggaggccauuaaacgcagacugcggacacucauccuggcucccaccagaguggucgccgcggaaauggaggaggcccuuaagggccugccuauccgcuaucagacgacagcuaccaaaagcgaacacaccgggcgggagauuguggaucugaugugccaugccacauuuaccaugagacuccuguccccgguucgcgugcccaacuacaaucuugucaucauggacgaagcucacuucacagauccugccucuauugccgcucggggauauaucagcaccagagugggcaugggggaggcggccgcuauuuuuaugacggccacacccccuggaaccgccgaggcuuucccccaguccaacgccccgauccaggacgaggagcgcgacaucccugaacggucuuggaauagcggcaacgaguggauuacagauuuuguggggaagaccgucugguucguucccuccaucaaagcgggcaaugacauugcuaacugucugagaaagaacggaaagaaagugauccaacucucucgcaagacguuugauaccgaauaccagaaaacacggcugaaugacugggauuucguggucaccacagacauuagcgagaugggcgccaacuuuaaggccgauagagugaucgacccccggcgcugccugaaaccuguuauucucaccgaugggcccgagagagugauccuugcuggaccuaugccggucacagccgcguccgccgcucagcggcgcggcagaguggggcggaauccccagaaggaaaacgaccaauacaucuucaccggacagccucugaauaacgaugaggaccaugcccacuggacggaagcuaagaugcugcucgacaauauuaacacacccgagggcaucauuccugcccuguucgaacccgagagagagaaaagcgcugccaucgauggggaauaucgccuuaagggcgagucucggaaaaccuuuguugaacugaugagacgcggagaccucccgguguggcuggcgcacaaggucgccuccgagggcauuaaauacaccgaucggaaguggugcuucgacggggaaagaaauaaccagauccuggaggagaauauggauguggaaaucuggacaaaagagggagaacgcaagaagcuccggccuagauggcuugacgcucgcaccuauagcgauccccuggcccugaaagaguuuaaggacuucgcugccggcagaaaaucuauugcccucgaucuggucacagaaaucgggcgggugccuucccaucuugcucaccgcacgagaaacgcgcuggacaaucucguuaugcugcauaccagcgagcacggaggccgggccuaccgccacgcuguggaggaacugcccgagacaauggaaacccuccuucugcugggccucaugauucugcuuacagggggagccaugcuguuucucaucuccggcaaggggauuggaaaaaccucuaucggccugaucugugugauugucagcuccgggaugcuguggauggccgauguuccucuccaguggaucgcuagcgccauugugcuugaguucuuuaugauggugcugcugauccccgagccggaaaagcaaagaacgccucaggacaaccagcucgcguaugucgugauuggaauccugacccuugccgcuauuguugccgcuaaugagaugggccugcucgaaacaaccaagcgggaucugggcaugucuaaagagcccgggguggucucccccacaagcuaccuggacguggaccuccauccugccucugcguggacccuuuaugccgucgcuacgacagugaucaccccgaugcugagacacacaaucgaaaacagcaccgccaauguuucccuggcugccauugcuaaccaagccgugguccucaugggacuggauaagggcuggcccaucucuaaaauggaccuuggggugccucugcucgcgcugggaugcuacagccagguuaacccccugacccucacagccgcugugcuucugcuggucacgcauuacgccauuaucggcccugggcuccaggcuaaggccacccgcgaggcccagaaacggacagcggcuggaauuaugaagaaucccaccguggauggcaucaugacaaucgaccuggauccugugauuuaugacuccaaguucgagaaacaacuuggccagguuaugcugcucguccugugugccgugcagcugcuccuuaugagaaccucuugggcucugugcgaagcccugacgcucgccacagggccgaucaccacccugugggagggaagccccggcaaguuuuggaacacaaccauugcuguguccauggccaauaucuuccgcgggagcuaccuugcgggagccggccuggcuuuuucuauuaugaaauccgucgggacaggacggagaggcacgggcagccagggggaaacccucggagagaaguggaaaaagaagcugaaccaacugucccggaaagaguucgaucucuauaagaaaucuggcaucacagagguugaccgcaccgaggccaaggaagggcuuaaaagaggagagacaacccaccaugcugugagccggggcuccgccaagcugcagugguuuguggaacgcaauauggucaucccugaggggagagugauugaucugggauguggccggggcggguggucuuacuauugcgcgggacucaaaaagguuacggaagugcgcggcuacaccaaagggggacccggccacgaggagccuguccccaugagcacauauggguggaacaucgugaaacugauguccggaaaggacguuuucuaccuuccgccugaaaaaugugauacccugcucugcgacauuggcgagagcucucccucccccacaguggaagagagcagaaccauccggguccugaagaugguggagccuuggcugcgcaauaaccaguucuguauuaaagugcucaaucccuacaugccuacagucaucgaacaccuugagagacugcagcggaaguauggcgggaugcugguuagaaacccgcucucucgcaauuccacccaugaaauguacuggauuagcaacggaacgggcaauaucgugucuagcgugaacauggucucccggcugcuucugaauagauuuacaaugacccaccgccggcccaccaucgagaaggauguggaccucggggccggaacaagacauguuaacgcugaaccugagacgcccaacauggacgugauuggcgagcgcaucaaacggauuaaggaagaacacucuagcaccuggcacuaugaugacgaaaauccuuacaaaacaugggccuaucauggguccuacgaggucaaggcuaccggaagcgccuccucuaugaucaacggcgugguuaaacugcugacaaagcccugggauguggucccgauggugacccaaauggcuaugacagacaccacgccuuucggccagcagagaguuuuuaaggaaaaaguggauacccgcacaccccggccuaugcccgggaccagaaaggucauggagauuacagccgaguggcucuggcgcacccugggacggaauaaaaagccuagacuuugcacgcgcgaagaguucaccaagaaggugagaaccaacgcggccaugggcgcugucuuuacagaagagaaucaaugggacagcgcccgggcugccguggaagaugaggaguucuggaagcugguugaccgcgaaagagagcuccacaaacuggggaaguguggauccugcguguauaacaugaugggcaaacgggaaaagaaacuuggggaguuuggcaaggccaaaggaucuagagcgaucugguacauguggcugggcgcucgguaccucgaguucgaagcccugggguuucugaaugaggaucauugguucagccgcgaaaacuccuauucuggagucgagggcgaagggcuccacaagcugggauacauccuuagagacauuagcaagauccccggcggggccauguaugcugaugacaccgccggcugggacacgcggauuaccgaggaugaccugcauaaugaggagaaaaucacacagcagauggauccggagcaccgccagcucgcuaacgccauuuuuaagcugaccuaccaaaauaaaguggugaagguucagagaccuacacccaaaggaaccgugauggacaucaucucccggaaggaucagcgcggcagcgggcaggucggaacauauggccuuaacaccuucacgaauauggaagcgcaacuggugagacagauggagggggaaggaguucucucuaaggccgaccuggagaacccccaucugcucgagaaaaagauuacacaguggcuggaaaccaaaggcguggagcggcuuaagcgcauggcuaucuccggggaugacugcgucgugaaaccuauugaugacagauuugccaaugcucugcucgcccugaacgauaugggcaagguccggaaggacaucccgcaguggcaacccagcaaaggauggcaugauuggcaacaggugccuuucuguucucaccauuuccacgaacuuauuaugaaggacggccgcaaacugguugugcccugcagaccucaggacgagcucaucgggcgggcgcgcaucucccaaggagccggcuggagccugaaggaaaccgcuugucuggggaaagccuacgcucagauguggucucucauguauuuucacagacgggaucugagacuugccuccaacgcuauuugcagcgccguccccgugcauuggaucccuacaucccgcaccacauggagcauucacgcgcaucaccaguggaugacgaccgaggacaugcugacaguuuggaaucggguguggaucgaggauaaccccuggauggaagacaagaccccggucacaaccugggaggaugugccuuaccucggaaagagagaagaccaaugguguggcucucugauugggcuuacgagccgcgccaccugggcucagaauauccugacagccauucaacaggugcggucccucaucggcgaugaggaguuccuggacuacaugcccucuaugaaaagauuucgcaaggaagaggaaagcgagggagccaucugguga

SEQ ID NO: 20507 - RNA, 9873 nt, Artificial Sequence
  derived and/or modified CDS sequence (opt5) from DENV-3__FJ639727__SS-prME
accagccugugccucaugaugaugcugcccgccacccuugcuuuccaccugacgucccgggacggagaaccucggaugaucguggggaagaacgaacgcggaaagucucuccuguuuaagaccgccagcggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacagcuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaagucucacaacggaagacuuaucaccgccaaccccgucgugaccaagaaggaggagcccgugaauauugaagcggagccuccguucggcgaaagcaacaucguuauugggaucggcgacaaagcucucaagauuaauugguauaagaaaggauccagcaucggcaagauguuugaggccaccgccagaggggcuagacgcauggccauccugggagauacggcuugggacuucggcucugucgggggagugcugaacucccucggcaaaauggugcaucagauuuuugggagcgccuacacagcgcuguucucuggcgucagcuggaucaugaagauuggaaucggcgugcuucugaccuggauugggcucaauuccaaaaacaccucuaugagcuuuuccugcaucguuauuggaaucaucacacuguaucugggcgccgugguccaggcugauauggggugugugauuaauuggaagggaaaggaacuuaaaugcggcagcgggaucuucguuaccaacgaggugcacacauggacggagcaguacaaguuucaagccgacucucccaaacggcucgcuaccgccauugcgggcgccugggaaaauggagucuguggcaucagauccacaacccgcauggagaaccugcuguggaagcagauugcuaaugaacucaacuauauccugugggagaauaacaucaaacuuacagugguugugggggauauuaucggaguccuggaacagggcaagcggacccucacgccucagcccauggagcugaaauacagcuggaagaccugggggaaggccaaaauugugacagcugagacccaaaauucuuccuucaucauugacggaccuaacacacccgaaugcccgagcgccuccagagccuggaacgugugggaggucgaagacuauggcuuuggcguuuucaccacaaauaucuggcugaaacuucgcgagguguacacccagucuugugaucaucggcucaugagcgcugcgaucaaagacgaaagagccgugcacgcugauaugggguacuggauugagucccagaagaacggaucuuggaaacuggagaaggccagcuuuaucgaagucaagacgugcacauggccuaaaucccacacccuguggagcaauggcgugcucgagucugacaugauuauccccaagucccuggccgggccuauuagccagcauaaccaccgccccggauauuacacccaaacagcuggcccuuggcaucuugggaaacuggaacucgauuucaauuauugcgagggaaccacgguugugaucacagagaacuguggcacccggggccccucucugagaacaaccacagucuccgggaagcugauccacgaauggugcugucgcagcugcacccuuccgccucuccgguacaugggagaggacggcuguugguaugggauggaaauuagacccaucaaugagaaagaagagaacauggugaagucucugguuagcgccggauccggcaagguggauaauuuuacgauggggguccugugccucgcgauucuguucgaggaagugaugcggggaaaauucggcaagaaacacaugaucgcuggcgcccuuuuuaccuucguucugcuccugagcgggcagauuacauggcgcgacauggcccauacccugaucaugauuggaucuaacgcuuccgauagaaugggcaugggggugacauaccuugcccugaucgcgaccuuuaagauccagcccuuccucgcucugggauuuuuccuccggaaacugacgagcagagagaaucuucugcucggcgucgggcuggccauggccacaacccugcaacuuccugaagacauugagcagauggcuaacggaaucgcccugggccucaugacacugaagcucauuacccaguuugaaaccuaucagcuguggacagcucuugugucccugacguguucuaauaccaucuucacacucaccguggccuggcgcacagcgacccugauucuggccggcgucagccuucugccgcucugccaauccucuagcaugcggaagacggauuggcugcccaugacaguugcugccaugggggugccuccccucccucuguuuaucuucucccuuaaagacacccccaagagacgcucuuggccucugaacgagggagugauggcugucggccuggugagcauccucgccuccagccugcuuagaaaugauguucccauggccgggccgcugguggcuggaggccuccugauugcguguuacgucaucaccgggacaucugccgaccucaccguggagaaagcugccgacguuacaugggaagaggaagccgagcagacgggagugucccacaaccugaugauuaccgucgaugacgauggcacaaugcggaucaaggacgaugaaaccgagaacauucuuacagugcugcugaaaaccgcucuccugaucgucagcggcaucuuuccuuacucuauucccgccacgcuucugguguggcauaccuggcagaagcagacacaacgcuccgggguucucugggacgugccuucucccccggagacccagaaagcggaacuggaggaaggagucuauagaaucaagcagcagggcauuuucgggaagacacaagugggaguuggcgugcagaaagagggggucuuucacaccauguggcaugugacacggggagcugugcucacgcacaauggcaagcgccuggagccuaacugggccuccguuaaaaaggaucuuaucuccuacggcgggggauggagacugagcgcccaguggcaaaaaggcgaagagguccaggugauugcuguggaacccgggaagaauccuaagaacuuccagaccaugcccggaaucuuccagacaaccaccggcgagauuggggccaucgcgcuggacuuuaaacccggaacauccggcagcccuaucauuaaucgggaaggcaaggucguggggcucuauggaaacggcguugugacgaaaaaugggggauacgucucuggcaucgcucaaaccaacgccgagccggaugggcccacaccugagcuggaagaggaaauguucaagaaacgcaaucuuaccauuauggaccugcaccccggcagcggaaagacaagaaaguaucucccugccaucgugcgggaggcuauuaaacgcagacugcggacccucauccuggcccccacgagaguuguggcugccgaaauggaggaggcgcuuaagggccugccuauccgcuaccagacaaccgccaccaaauccgaacauacagggcgggagauugucgaucugaugugccacgcuaccuuuacaaugagacuccugucuccggugcgcguucccaacuauaaucuuguggucauggacgaagcccauuucaccgauccugcuagcaucgccgcccggggauacauuuccacgagagugggcaugggggaggcugcggccaucuuuaugacagcuacacccccuggaacagccgaagccuucccccagucuaacgcuccgauucaggacgaggagcgcgacaucccugaacggagcuggaauagcggcaacgaguggaucaccgauuuuguggggaagacggucugguucguucccucuauuaaagccggcaaugacaucgcgaacugucugagaaagaacggaaagaaagugauucaacucagccgcaagaccuuugauacagaauaccagaaaacccggcugaaugacugggauuucguggucacaaccgacaucuccgagaugggcgcuaacuuuagagccgaucgggugauugacccccgcagaugccugaagccuguuauccucacagaugggcccgagcgggugauucuugccggaccuaugccggucaccgcugccagcgcggcccagcgcagaggccggguggggagaaauccccagaaagaaaacgaccaauauaucuucacgggacagccucugaauaacgaugaggaccacgcucauuggacagaagccaagaugcugcucgacaauaucaacacccccgagggcauuaucccugcucuguucgaacccgagcgcgagaagucugccgcuauugauggggaauaccggcuuaaaggcgaguccagaaagaccuuuguugaacugaugcgccggggagaccucccgguguggcuggcccacaaagucgcgagcgagggcaucaaguauacagauagaaaauggugcuucgacggggaacgcaauaaccagauucuggaggagaauauggauguggaaaucuggaccaaggagggagaacggaaaaagcucagaccucgcuggcuugacgccagaacauacucugauccccuggcucugaaggaguuuaaagacuucgccgcuggccggaaguccaucgcccucgaucuggucacggaaauugggcgcgugccuagccaccuugcccauagaacccggaacgcucuggacaaucucguuaugcugcacacauccgagcauggaggccgcgcguauagacacgccguggaggaacugcccgagaccauggaaacacuccuucugcugggccucaugauccugcuuaccgggggagcuaugcuguuucucauuucuggcaaagggaucggaaagacgagcauuggccugaucugugugaucgucuccagcgggaugcuguggauggccgauguuccucuccaguggauugccucugcuaucgugcuugaguucuuuaugauggugcugcugauucccgagccggaaaaacaacggaccccucaggacaaccagcucgccuacgucgugaucggcauucugacacuugcggccaucguugcugccaaugagaugggccugcucgaaaccacaaagagagaucugggcauguccaaggagcccgggguggucagccccaccucuuaucuggacguggaccuccacccugcuagcgccuggacgcuuuacgcggucgccacaaccgugauuacaccgaugcugcgccauaccaucgaaaacuccaccgcuaauguuucucuggccgcuaucgccaaccaagcugugguccucaugggacuggauaaaggcuggcccauuagcaagauggaccuuggggugccucugcucgcccugggaugcuacucccagguuaacccccugacacucacggcggccgugcuucugcuggucacccacuaugcuaucauuggcccugggcuccaggccaaagcuacacgggaggcccagaagagaaccgccgcgggaaucaugaaaaaucccacaguggauggcauuaugaccaucgaccuggauccugugaucuacgacucuaaguucgagaagcaacuuggccagguuaugcugcucguccugugugcugugcagcugcuccuuaugcgcacgagcugggcccugugcgaagcucugacacucgccaccgggccgauuaccacacugugggagggaucccccggcaaauuuuggaacaccacaaucgccgugagcauggcuaauauuuuccgggggucuuaucuugccggagcgggccuggccuuuuccaucaugaaaagcgucgggacgggaagacggggcaccggcucccagggggaaacacucggagagaaauggaagaaaaagcugaaccaacugucucgcaaggaguucgaucucuacaaaaagagcggcauuaccgagguugacagaacagaggcuaaagaagggcuuaagcggggagagaccacgcaucacgccgugucccgcggcucugcuaaacugcagugguuuguggaaagaaauauggucaucccugaggggcgggugaucgaucugggauguggccgcggcggguggagcuauuacugcgccggacucaagaaaguuaccgaagugagaggcuauacaaaagggggacccggccaugaggagccuguccccauguccaccuacggguggaacauugugaagcugaugagcggaaaagacguuuucuaccuuccgccugaaaagugugauacacugcucugcgacaucggcgagucuucccccagccccaccguggaagagucucggacaauucgcguccugaaaaugguggagccuuggcugagaaauaaccaguucuguaucaaggugcucaaucccuauaugccuaccgucauugaacaccuugagcggcugcagagaaaauacggcgggaugcugguucgcaacccgcucucccggaauagcacgcacgaaauguauuggaucucuaacggaacaggcaauauugugagcuccgugaacauggucucuagacugcuucugaaucgcuuuaccaugacccaucggagacccacaaucgagaaggauguggaccucggggcgggaacgcgccacguuaacgccgaaccugagacccccaacauggacgugaucggcgagcggauuaagagaaucaaagaagaacacagcuccacauggcacuacgaugacgaaaauccuuauaagaccugggcuuaccacgggagcuaugaggucaaagccacaggauccgcuucuagcaugauuaacggcgugguuaagcugcugaccaaacccugggauguggucccgauggugacacaaauggccaugaccgacacgaccccuuucggccagcagcgcguuuuuaaggaaaagguggauacacggacccccagaccuaugcccgggacacgcaaagucauggagaucaccgcugaguggcucuggcggacgcugggaagaaauaagaaaccucgccuuugcacaagagaagaguucaccaagaaagugcggacaaacgccgcgaugggcgccgucuuuaccgaagagaaucaaugggacuccgcucgcgccgcuguggaagaugaggaguucuggaagcugguugacagagaacgggagcuccauaagcuggggaaauguggaucuugcguguacaacaugaugggcaagagagagaagaaacuuggggaguuuggcaaagccaagggaagccgggccauuugguacauguggcugggcgcgcgcuaucucgaguucgaagcucugggguuucugaaugaggaucacugguucuccagagaaaacucuuacagcggagucgagggcgaagggcuccauaaacugggauauauccuucgggacaucuccaagauucccggcggggccauguacgccgaugacacggcuggcugggacacccgcaucacagaggaugaccugcacaaugaggaaaagauuacccagcagauggauccggagcauagacagcucgccaacgcuaucuuuaaacugacauaucaaaauaagguggugaaaguucagcggccuacccccaagggaacagugauggacauuaucagccgcaaagaucagagaggcucugggcaggucggaaccuacggccuuaacacguucacaaauauggaagcccaacuggugcggcagauggagggggaaggaguucucuccaaggcggaccuggagaacccccaucugcucgagaagaaaaucacccaguggcuggaaaccaagggcguggagcgccuuaaaagaauggccauuagcggggaugacugcgucgugaagccuaucgaugaccgguuugcuaaugcccugcucgcucugaacgauaugggcaaaguccgcaaggacauuccgcaguggcaacccucuaagggauggcacgauuggcaacaggugccuuucuguucccaucacuuccaugaacuuaucaugaaagacggcagaaagcugguugugcccugccggccucaggacgagcucauugggcgcgccagaaucagccaaggagcgggcuggucucugaaagaaacagccugucuggggaaggcuuaugcccagauguggucccucauguacuuucaccggagagaucugcgccuugcuagcaacgccaucugcuccgcuguccccgugcacuggauuccuaccagccggacaacguggucuauccaugcccaccaucaguggaugaccacagaggacaugcugaccguuuggaauagaguguggauugaggauaaccccuggauggaagacaaaacaccggucaccacgugggaggaugugccuuaccucggaaagcgcgaagaccaaugguguggcagccugaucgggcuuaccucccgggcgacaugggcccagaauauucugaccgcuauccaacaggugagaucucucauuggcgaugaggaguuccuggacuauaugcccagcaugaagcgcuuucggaaagaagaggaauccgagggagccaucugguga

SEQ ID NO: 20508 - RNA, 9873 nt, Artificial Sequence
  derived and/or modified CDS sequence (opt5) from DENV-3__GQ868629__SS-prME
acaucccugugccucaugaugaugcugcccgccacacuugcuuuccaccugacgucccgggacggagaaccucggaugaucguggggaagaacgaacgcggaaaaucucuccuguuuaagacagccagcggcauuaauauguguacacuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacagcuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaucaccgagacaccuaccuggaaccggaaagaacugcucgugacguuuaagaaugcccaugcuaaaaagcaagagguugugguccuggggucccaggaaggagcgaugcacacagcccugaccggcgcuacagagauucagaacagcgggggcaccucuaucuucgccggacaccucaagugucgccugaaaauggauaaacuugaacugaaaggcauguccuacgccaugugccucaauaccuuugugcugaagaaagagguuagcgagacacagcaugggacgauucugaucaagguggaauacaagggagaggacgcucccuguaaaaucccuuucuccaccgaagauggccaagggaaggcccacaacggaagacuuauuacagcgaaccccgucgugaccaaaaaggaggagcccgugaauaucgaagcugagccuccguucggcgaaucuaacauuguuaucgggauuggcgacaaagcccucaagaucaauugguauaagaaaggaagcuccaucggcaagauguuugaggccacagcuagaggggccagacgcauggcuauucugggagauaccgccugggacuucggcagcgucgggggagugcugaacucucucggcaaaauggugcaucagaucuuuggguccgcguacacggcccuguucagcggcgucucuuggauuaugaagaucggaauuggcgugcuucugacauggaucgggcucaauagcaaaaacaccuccaugucuuuuagcugcauuguuaucggaaucauuacccuguaucugggcgcugugguccaggccgauauggggugugugaucaauuggaagggaaaggaacuuaaaugcggcuccgggauuuucguuacaaacgaggugcacaccuggacagagcaguacaaguuucaagcugacagccccaaacggcucgccacggcgaucgccggcgcuugggaaaauggagucuguggcauuagaucuaccacacgcauggagaaccugcuguggaagcagaucgccaaugaacucaacuauauccugugggagaauaacauuaaacuuaccgugguugugggggauaucauuggaguccuggaacagggcaagcggacacucaccccucagcccauggagcugaaauacuccuggaagacgugggggaaggcuaaaaucgugaccgccgagacacaaaauagcucuuucauuaucgacggaccuaacacccccgaaugcccguccgccagcagagcuuggaacgugugggaggucgaagacuauggcuuuggcguuuucacaaccaauaucuggcugaaacuucgcgagguguacacacaguccugugaucaucggcucaugucugcggccauuaaagacgaaagagcugugcacgccgauaugggguacuggaucgagagccagaagaacggauccuggaaacuggagaaggccucuuuuauugaagucaagaccugcacguggccuaaaagccacacacugugguccaauggcgugcucgagagcgacaugaucauucccaagucucuggcugggccuaucucccagcauaaccaccgccccggauaucauacccaaaccgccggcccuuggcaccuugggaaacuggaacucgauuucaauuacugcgagggaacaaccguugugaucacggagaacuguggcacacggggccccagccugagaaccacaaccgucucugggaagcugauucacgaauggugcugucgcuccugcacacuuccgccucuccgguauaugggagaggacggcuguugguacgggauggaaaucagacccauuaaugagaaagaagagaacauggugaaaagccugguuucugcgggaagcggcaagguggauaauuuuaccauggggguccugugccucgcuauccuguucgaggaagugaugcggggaaaauucggcaagaaacauaugauugccggcguucuuuuuacguucgugcugcuccuguccgggcagaucaccuggcgcgacauggcccacacacugauuaugaucggaagcaacgcuucugauagaaugggcaugggggucaccuaucuugcccugaucgcgacauuuaagauucagcccuuccucgcucugggauuuuuccuccggaaacugaccuccagagagaaucuucugcucggcguggggcuggccauggccacgacacugcaacuuccugaagacaucgagcagauggcuaacggaauugcccugggccucaugacccugaagcucaucacacaguuugaaaccuaccagcuguggaccgcucuugugagccugacauguuccaauacgauuuucacccucacagucgccuggcgcaccgcgacacugauccuggccggcguuucucuucugccgcucugccaaagcuccucuaugcggaagaccgauuggcugcccaugacgguggcugccaugggggugccuccccucccucuguuuaucuucagccuuaaagacacacccaagagacgcuccuggccucugaacgagggagucauggcugugggccugguuucuauucucgccagcucccugcuuagaaaugaugugcccauggccgggccgcuggucgcuggaggccuccugaucgcguguuaugugauuaccgggaccagcgccgaccucacaguugagaaagcugccgacgugaccugggaagaggaagccgagcagacaggagucucucauaaccugaugaucacgguggaugacgauggcaccaugcggauuaaggacgaugaaacagagaacauccuuaccguccugcugaaaacagcucuccugaucguguccggcauuuuuccuuacagcauccccgccacccuucugguuuggcacacguggcagaagcagacccaacgcucuggggugcucugggacgucccuucucccccggagacacagaaagcggaacuggaggaaggaguguacagaauuaagcagcagggcaucuucgggaagacccaaguuggagugggcguccagaaagaggggguguuucauacaauguggcacgugacccggggagcuguucucacacacaauggcaagcgccuggagccuaacugggccagcgucaaaaaggaucuuauuagcuauggcgggggauggagacuguccgcccaguggcaaaaaggcgaagagguccaggugaucgcugucgaacccgggaagaauccuaagaacuuccagacgaugcccggaauuuuccagaccacaaccggcgagaucggggccaucgcgcuggacuuuaaacccggaaccagcggcuccccuauuaucaaucgggaaggcaaggugguugggcucuacggaaacggcguggucaccaagaaugggggauaugugagcggcauugcucaaacgaacgccgagccggaugggcccaccccugagcuggaagaggaaauguucaagaaacgcaaucuuacaaucauggaccugcaucccggcucuggaaagaccagaaaguaccucccugccauuguucgggaggcuaucaaacgcagacugcggacacucauccuggcccccaccagaguggucgcugccgaaauggaggaggcgcuuaagggccugccuauucgcuaucagacgacagccaccaaaagcgaacacaccgggcgggagaucguggaucugaugugccaugcuacauuuaccaugagacuccuguccccgguucgcgugcccaacuacaaucuugucauuauggacgaagcccacuucacagauccugcuucuaucgccgcccggggauauauuagcaccagagugggcaugggggaggcugcggccaucuuuaugacggcuacacccccuggaaccgccgaagccuucccccaguccaacgcuccgauccaggacgaggagcgcgacauuccugaacggucuuggaauagcggcaacgaguggaucacagauuuuguggggaagaccgucugguucguucccuccauuaaagccggcaaugacaucgcgaacugucugagaaagaacggaaagaaagugauucaacucucucgcaagacguuugauaccgaauaccagaaaacacggcugaaugacugggauuucguggucaccacagacaucagcgagaugggcgcuaacuuuaaggccgauagagugauugacccccggcgcugccugaaaccuguuauccucaccgaugggcccgagagagugauccuugccggaccuaugccggucacagcugccuccgcggcccagcggcgcggcagaguggggcggaauccccagaaggaaaacgaccaauacauuuucaccggacagccucugaauaacgaugaggaccaugcucacuggacggaagccaagaugcugcucgacaauaucaacacacccgagggcauuaucccugcucuguucgaacccgagagagagaaaagcgccgcuauugauggggaauaucgccuuaagggcgagucucggaaaaccuuuguugaacugaugagacgcggagaccucccgguguggcuggcccacaaggucgcguccgagggcaucaaauacaccgaucggaaguggugcuucgacggggaaagaaauaaccagauccuggaggagaauauggauguggaaauuuggacaaaagagggagaacgcaagaagcuccggccuagauggcuugacgcccgcaccuauagcgauccccuggcucugaaagaguuuaaggacuucgccgcuggcagaaaaucuaucgcccucgaucuggucacagaaauugggcgggugccuucccaucuugcccaccgcacgagaaacgcucuggacaaucucguuaugcugcauaccagcgagcacggaggccgggcguaccgccacgccguggaggaacugcccgagacaauggaaacccuccuucugcugggccucaugauccugcuuacagggggagcuaugcuguuucucauuuccggcaaggggaucggaaaaaccucuaucggccugauuugugugaucgucagcuccgggaugcuguggauggccgauguuccucuccaguggauugccagcgcuaucgugcuugaguucuuuaugauggugcugcugauucccgagccggaaaagcaaagaacgccucaggacaaccagcucgccuaugucgugaucggcauucugacccuugcggccaucguugcugccaaugagaugggccugcucgaaacaaccaagcgggaucugggcaugucuaaagagcccgggguggucucccccacaagcuaccuggacguggaccuccauccugcuucugccuggacccuuuaugcggucgccacgacagugaucaccccgaugcugagacacacaauugaaaacagcaccgcuaauguuucccuggccgcuaucgccaaccaagcugugguccucaugggacuggauaagggcuggcccauuucuaaaauggaccuuggggugccucugcucgcccugggaugcuacagccagguuaacccccugacccucacagcggccgugcuucugcuggucacgcauuacgcuaucauuggcccugggcuccaggccaaggcuacccgcgaggcccagaaacggacagccgcgggaaucaugaagaaucccaccguggauggcaucaugacaauugaccuggauccugugaucuaugacuccaaguucgagaaacaacuuggccagguuaugcugcucguccugugugcugugcagcugcuccuuaugagaaccucuugggcccugugcgaagcucugacgcucgccacagggccgauuaccacccugugggagggaagccccggcaaguuuuggaacacaaccaucgccguguccauggcuaauauuuuccgcgggagcuaccuugccggagcgggccuggccuuuucuaucaugaaauccgucgggacaggacggagaggcacgggcagccagggggaaacccucggagagaaguggaaaaagaagcugaaccaacugucccggaaagaguucgaucucuauaagaaaucuggcaucacagagguugaccgcaccgaggcuaaggaagggcuuaaaagaggagagacaacccaccaugccgugagccggggcuccgcuaagcugcagugguuuguggaacgcaauauggucauuccugaggggagagugaucgaucugggauguggccggggcggguggucuuacuauugcgccggacucaaaaagguuacggaagugcgcggcuacaccaaagggggacccggccacgaggagccuguccccaugagcacauauggguggaacauugugaaacugauguccggaaaggacguuuucuaccuuccgccugaaaaaugugauacccugcucugcgacaucggcgagagcucucccucccccacaguggaagagagcagaaccauucggguccugaagaugguggagccuuggcugcgcaauaaccaguucuguaucaaagugcucaaucccuacaugccuacagucauugaacaccuugagagacugcagcggaaguauggcgggaugcugguuagaaacccgcucucucgcaauuccacccaugaaauguacuggaucagcaacggaacgggcaauaucgugucuagcgugaacauggucucccggcugcuucugaauagauuuacaaugacccaccgccggcccaccauugagaaggauguggaccucggggcgggaacaagacauguuaacgccgaaccugagacgcccaacauggacgugaucggcgagcgcauuaaacggaucaaggaagaacacucuagcaccuggcacuaugaugacgaaaauccuuacaaaacaugggcuuaucauggguccuacgaggucaaggccaccggaagcgcuuccucuaugauuaacggcgugguuaaacugcugacaaagcccugggauguggucccgauggugacccaaauggccaugacagacaccacgccuuucggccagcagagaguuuuuaaggaaaaaguggauacccgcacaccccggccuaugcccgggaccagaaaggucauggagaucacagcugaguggcucuggcgcacccugggacggaauaaaaagccuagacuuugcacgcgcgaagaguucaccaagaaggugagaaccaacgccgcgaugggcgccgucuuuacagaagagaaucaaugggacagcgcucgggccgcuguggaagaugaggaguucuggaagcugguugaccgcgaaagagagcuccacaaacuggggaaguguggauccugcguguauaacaugaugggcaaacgggaaaagaaacuuggggaguuuggcaaggccaaaggaucuagagccaucugguacauguggcugggcgcgcgguaccucgaguucgaagcucugggguuucugaaugaggaucauugguucagccgcgaaaacuccuauucuggagucgagggcgaagggcuccacaagcugggauacauucuuagagacaucagcaagauucccggcggggccauguaugccgaugacaccgcuggcugggacacgcggaucaccgaggaugaccugcauaaugaggagaagauuacacagcagauggauccggagcaccgccagcucgccaacgcuaucuuuaagcugaccuaccaaaauaaaguggugaagguucagagaccuacacccaaaggaaccgugauggacaucauuucccggaaggaucagcgcggcagcgggcaggucggaacauauggccuuaacaccuucacgaauauggaagcccaacuggugagacagauggagggggaaggaguucucucuaaggcggaccuggagaacccccaucugcucgagaaaaagaucacacaguggcuggaaaccaaaggcguggagcggcuuaagcgcauggccauuuccggggaugacugcgucgugaaaccuaucgaugacagauuugcuaaugcccugcucgcucugaacgauaugggcaagguccggaaggacauuccgcaguggcaacccagcaaaggauggcaugauuggcaacaggugccuuucuguucucaccauuuccacgaacuuaucaugaaggacggccgcaaacugguugugcccugcagaccucaggacgagcucaucgggcgggcccgcauuucccaaggagcgggcuggagccugaaggaaaccgccugucuggggaaggcuuacgcccagauguggucucucauguauuuucacagacgggaucugagacuugcuuccaacgccaucugcagcgcuguccccgugcauuggauuccuacaucccgcaccacauggagcauccacgcccaucaccaguggaugacgaccgaggacaugcugacaguuuggaaucggguguggauugaggauaaccccuggauggaagacaagaccccggucacaaccugggaggaugugccuuaccucggaaagagagaagaccaaugguguggcucucugaucgggcuuacgagccgcgcgaccugggcccagaauauucugacagcuauccaacaggugcggucccucaucggcgaugaggaguuccuggacuacaugcccucuaugaaaagauuucgcaaggaagaggaaagcgagggagccauuugguga

SEQ ID NO: 20509 - RNA, 9873 nt, Artificial Sequence
  derived and/or modified CDS sequence (opt5) from DENV-3__FJ639728__SS-prME
accagccugugccucaugaugaugcugcccgccacccuugcuuuccaccugacgucccgggacggcgagccucggaugaucguggggaagaaugaacgcggaaagucucuccuguuuaagaccgccagcggcaucaauauguguacccuuaucgcgauggaucugggggagaugugcgacgauaccgugacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaagcccacgcucgacaucgagcugcagaagaccgaagcuacacagcuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcuccgggaucuucguuaccaacgaggugcacacauggacggagcaguacaaguuucaagcugacagccccaaacggcucgccaccgcgauugccggcgcuugggaaaauggagucuguggcaucagaucuacaacccgcauggagaaccugcuguggaagcagauugccaaugaacucaacuauauccugugggagaauaacaucaaacuuacagugguugugggggauauuaucggaguccuggaacagggcaagcggacccucacgccucagcccauggagcugaaauacuccuggaagaccugggggaaggcuaaaauugugacagccgagacccaaaauagcucuuucaucauugacggaccuaacacacccgaaugcccguccgcccugagagcuuggaacgugugggaggucgaagacuauggcuuuggcguuuucaccacaaauaucuggcuuaagcuccgcgagguguacacccagagcugugaucaucggcugauguccgcggccaucaaagacgaaagagcugugcacgccgauaugggguacuggauugagucucagaagaacggaagcuggaaacuggagaaggccuccuuuaucgaagucaagacgugcacauggccuaaaucucacacccucuggagcaauggcgugcuggaguccgacaugauuauccccaagagccuugcugggccuauuucucagcauaaccaccgccccggauaucauacccaaacagccggcccuuggcaccuggggaaacucgaacuggauuucaauuacugcgagggaaccacgguugugaucacagagaacuguggcacccggggccccucccugagaacaaccacagucagcgggaaacuuauccacgaauggugcugucgcucuugcacccucccgccucugcgguauaugggagaggacggcuguugguacgggauggaaauuagacccaucaaugagaaagaagagaacauggugaagucccugguuagcgcgggaucuggcaagguggauaauuuuacgauggggguccucugccuggcuauucuuuucgaggaagugaugcggggaaaauucggcaagaaacauaugaucgccggcguucuguuuaccuucgugcuccugcugagcgggcagauuacauggcgcgacauggcccacacccuuaucaugauuggauccaacgcuagcgauagaaugggcaugggggucacauaucuggcccucaucgcgaccuuuaagauccagcccuuccuggcucucggauuuuuccugcggaaacuuacgucuagagagaaucugcuccugggcguggggcuggccauggccacaacccuucaacugccugaagacauugagcagauggcuaacggaaucgcccucggccugaugacacucaagcugauuacccaguuugaaaccuaccagcuuuggacagcucuggugucccucacguguagcaauaccaucuucacacugaccgucgccuggcgcacagcgacccugauucuugccggcguuucccugcucccgcugugccaaucuagcuccaugcggaagacggauuggcuccccaugacaguggcugccaugggggugccuccccugccucuuuuuaucuucucucugaaagacacccccaagagacgcagcuggccucugaacgagggagucauggcugugggccucguuuccauccuggccucuagccuucugagaaaugaugugcccauggccgggccgcucgucgcuggaggccugcucauugcguguuaugugaucaccgggacauccgccgaccugaccguugagaaagcugccgacgugacaugggaagaggaagccgagcagacgggagucagccauaaccuuaugauuaccguggaugacgauggcacaaugcggaucaaggacgaugaaaccgagaacauucugacaguccugcucaaaaccgcucugcuuaucgugucuggcaucuuuccuuacuccauucccgccacgcugcucguuuggcacaccuggcagaagcagacacaacgcagcggggugcugugggacgucccuucucccccggagacccagaaagcggaacucgaggaaggaguguacagaaucaagcagcagggcauuuucgggaagacacaaguuggagugggcguccagaaagaggggguguuucauaccauguggcacgugacacggggagcuguucugacgcacaauggcaagcgccuugagccuaacugggccuccgucaaaaaggaucugaucagcuauggcgggggauggagacugucugcccaguggcaaaaaggcgaagagguccaggugauugcugucgaacccgggaagaauccuaagaacuuccagaccaugcccggaaucuuccagacaaccaccggcgagauuggggccaucgcgcucgacuuuaaacccggaacauccggcagcccuaucauuaaucgggaaggcaaggugguugggcuguacggaaacggcguggucacgaaaaaugggggauauguguccggcaucgcucaaaccaacgccgagccggaugggcccacaccugagcuugaagaggaaauguucaagaaacgcaaucugaccauuauggaccuccaucccggcagcggaaagacaagaaaguaccugccugccaucguucgggaggcuauuaaacgcagacuccggacccugauccuugcccccacgagaguggucgcugccgaaauggaggaggcgcugaagggccugccuauccgcuaucagacaaccgccaccaaaucugaacacacagggcgggagauuguggaucucaugugccaugcuaccuuuacaaugagacugcuuagcccgguucgcgugcccaacuacaaucuggucaucauggacgaagcccacuucaccgauccugcuuccauugccgcccggggauauaucucuacgagagugggcaugggggaggcugcggccauuuuuaugacagcuacacccccuggaacagccgaagccuucccccagagcaacgcuccgauccaggacgaggagcgcgacaucccugaacgguccuggaacucuggcaacgaguggauuaccgauuuuguggggaagacggucugguucguucccagcaucaaagccggcaaugacauugcgaacugucucagaaagaacggaaagaaagugauccaacugucccgcaagaccuuugauacagaauaccagaaaacccggcugaaugacugggauuucguggucacaaccgacauuucugagaugggcgcuaacuuuaaggccgauagagugaucgacccccggcgcugccucaaaccuguuauucuuacagaugggcccgagagagugauccuggccggaccuaugccggucaccgcugccagcgcggcccagcggcgcggcagaguggggcggaauccccagaaggaaaacgaccaauacaucuucacgggacagccucugaauaacgaugaggaccaugcucacuggacagaagccaagaugcuccuggacaauauuaacacccccgagggcaucauuccugcucuuuucgaacccgagagagagaaauccgccgcuaucgauggggaauaucgccugaagggcgagagccggaaaaccuuuguugaacucaugagacgcggagaccugccgguguggcuggcccacaaggucgcgucugagggcauuaaauacacagaucggaaguggugcuucgacggggaaagaaauaaccagauccucgaggagaauauggauguggaaaucuggaccaaagagggagaacgcaagaaacuucggccuagauggcuggacgcccgcacauauuccgauccccuggcucucaaagaguuuaaggacuucgccgcuggcagaaaaagcauugcccuggaucuugucacggaaaucgggcgggugccuucucaucuggcccaccgcaccagaaacgcucucgacaaucugguuaugcugcauacauccgagcacggaggccgggcguaccgccacgccguggaggaacuccccgagaccauggaaacacuucugcugcucggccugaugauucuucugaccgggggagcuaugcucuuucugaucagcggcaaggggauuggaaaaacguccaucggccugaucugugugauugucucuagcgggaugcucuggauggccgauguuccucuucaguggaucgccuccgcuauugugcuggaguucuuuaugauggugcugcucauccccgagccggaaaagcaaagaaccccucaggacaaccagcuggccuaugucgugauuggaauccuuacacuggcggccauuguugcugccaaugagaugggccuccuggaaaccacaaagcgggaucugggcaugagcaaagagcccgggguggucucucccaccuccuaccucgacguggaccuucauccugcuagcgccuggacgcuguaugcggucgccacaaccgugaucacaccgaugcugagacacaccaucgaaaacucuaccgcuaauguuagccucgccgcuauugccaaccaagcugugguccugaugggacuugauaagggcuggcccaucuccaaaauggaccugggggugccucuccuggcccugggaugcuacucucagguuaacccccucacacuuacggcggccgugcugcugcucgucacccauuacgcuauuaucggcccugggcugcaggccaaggcuacacgcgaggcccagaaacggaccgccgcgggaauuaugaagaaucccacaguggauggcaucaugaccaucgaccuugauccugugauuuaugacagcaaguucgagaaacaacugggccagguuaugcuccugguccugugugcugugcagcuccuucugaugagaacguccugggcccugugcgaagcucucacacuggccaccgggccgaucaccacacuuugggagggaucucccggcaaguuuuggaacaccacaauugccgugagcauggcuaauaucuuccgcggguccuaccuggccggagcgggccucgccuuuagcauuaugaaaucugucgggacgggacggagaggcaccggcucccagggggaaacacugggagagaaguggaaaaagaagcugaaccaacucagccggaaagaguucgaucuuuauaagaaauccggcaucaccgagguugaccgcacagaggcuaaggaagggcugaaaagaggagagaccacgcaccaugccgugucucggggcagcgcuaagcugcagugguuuguggaacgcaauauggucaucccugaggggagagugauugaucucggauguggccggggcgggugguccuacuauugcgccggacugaaaaagguuaccgaagugcgcggcuacacaaaagggggacccggccacgaggagccuguccccaugucuaccuauggguggaacaucgugaaacuuaugagcggaaaggacguuuucuaccugccgccugaaaaaugugauacacuccugugcgacauuggcgaguccagccccucucccaccguggaagaguccagaacaauccggguccugaagaugguggagccuuggcuccgcaauaaccaguucuguauuaaagugcuuaaucccuacaugccuaccgucaucgaacaccuggagagacugcagcggaaguauggcgggaugcucguuagaaacccgcugagccgcaauucuacgcaugaaauguacuggauuuccaacggaacaggcaauaucgugagcucugugaacauggucagccggcuucugcucaauagauuuaccaugacccaccgccggcccacaaucgagaaggauguggaccugggggcgggaacgagacauguuaacgccgaaccugagacccccaacauggacgugauuggcgagcgcaucaaacggauuaaggaagaacacuccucuacauggcacuaugaugacgaaaauccuuacaaaaccugggcuuaucaugggagcuacgaggucaaggccacaggauccgcuagcuccaugaucaacggcgugguuaaacugcucaccaagcccugggauguggucccgauggugacacaaauggccaugaccgacacgaccccuuucggccagcagagaguuuuuaaggaaaaaguggauacacgcacaccccggccuaugcccgggacaagaaaggucauggagauuaccgcugaguggcuguggcgcacgcuuggacggaauaaaaagccuagacugugcacacgcgaagaguucaccaaaaaggugagaacaaacgccgcgaugggcgccgucuuuaccgaagagaaucaaugggacucugcucgggccgcuguggaagaugaggaguucuggaagcucguugaccgcgaaagagagcugcacaaacuugggaaguguggaagcugcguguauaacaugaugggcaaacgggaaaagaaacugggggaguuuggcaaggccaaaggauccagagccaucugguacauguggcucggcgcgcgguaccuggaguucgaagcucugggguuucucaaugaggaucauugguucucucgcgaaaacagcuauuccggagucgagggcgaagggcugcacaaacuuggauacauccugagagacauuucuaagauccccggcggggccauguaugccgaugacacggcuggcugggacacccggauuacagaggaugaccuccauaaugaggagaaaauuacccagcagauggauccggaacaccgccagcuggccaacgcuauuuuuaaacuuacauaccaaaauaaaguggugaagguucagagaccuacccccaaaggaacagugauggacaucaucagccggaaggaucagcgcggcuccgggcaggucggaaccuauggccugaacacguucacaaauauggaagcccaacucgugagacagauggagggggaaggaguucugagcaaggcggaccuggagaacccccaccuccuggagaaaaagauuacccaguggcuugaaaccaaaggcguggagcggcugaagcgcauggccaucucuggggaugacugcgucgugaaaccuauugaugacagauuugcuaaugcccuccuggcucuuaacgauaugggcaagguccggaaggacaucccgcaguggcaacccuccaaaggauggcaugauuggcaacaggugccuuucuguagccaccauuuccacgaacugauuaugaaggacggccgcaaacucguugugcccugcagaccucaggacgagcugaucgggcgggcccgcaucucucaaggagcgggcuggucccugaaggaaacagccugucucgggaaggcuuacgcccagauguggagccugauguauuuucacagacgggaucuuagacuggcuucuaacgccauuugcuccgcuguccccgugcauuggaucccuaccagccgcacaacgugguccauucacgcccaucaccaguggaugaccacagaggacaugcucaccguuuggaaucggguguggaucgaggauaaccccuggauggaagacaagacaccggucaccacgugggaggaugugccuuaccugggaaagagagaagaccaaugguguggcagccuuauugggcugaccucucgcgcgacaugggcccagaauauccucaccgcuauucaacaggugcggagccugaucggcgaugaggaguuccuggacuacaugcccuccaugaaaagauuucgcaaggaagaggaaucugagggagccaucugguga

SEQ ID NO: 20510 - RNA, 9873 nt, Artificial Sequence
  derived and/or modified CDS sequence (opt5) from DENV-3__FJ639729__SS-prME
acaucccugugccucaugaugaugcugcccgccacacuugcuuuccaccugacgucccgggacggagaaccucggaugaucguggggaagaacgaacgcggaaaaucucuccuguuuaagacagccagcggcauuaauauguguacacuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacagcuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaucaccgagacaccuaccuggaaccggaaagaacugcucgugacguuuaagaaugcccaugcuaaaaagcaagagguugugguccuggggucccaggaaggagcgaugcacacagcccugaccggcgcuacagagauucagaacagcgggggcaccucuaucuucgccggacaccucaagugucgccugaaaauggauaaacuugaacugaaaggcauguccuacgccaugugccucaauaccuuugugcugaagaaagagguuagcgagacacagcaugggacgauucugaucaagguggaauacaagggagaggacgcucccuguaaaaucccuuucuccaccgaagauggccaagggaaggcccacaacggaagacuuauuacagcgaaccccgucgugaccaaaaaggaggagcccgugaauaucgaagcugagccuccguucggcgaaucuaacauuguuaucgggauuggcgacaaagcccucaagaucaauugguauaagaaaggaagcuccaucggcaagauguuugaggccacagcuagaggggccagacgcauggcuauucugggagauaccgccugggacuucggcagcgucgggggagugcugaacucucucggcaaaauggugcaucagaucuuuggguccgcguacacggcccuguucagcggcgucucuuggauuaugaagaucggaauuggcgugcuucugacauggaucgggcucaauagcaaaaacaccuccaugucuuuuagcugcauuguuaucggaaucauuacccuguaucugggcgcugugguccaggccgauauggggugugugaucaauuggaagggaaaggaacuuaaaugcggcuccgggauuuucguuacaaacgaggugcacaccuggacagagcaguacaaguuucaagcugacagccccaaacggcucgccacggcgaucgccggcgcuugggaaaauggagucuguggcauuagaucuaccacacgcauggagaaccugcuguggaagcagaucgccaaugaacucaacuauauccugugggagaauaacauuaaacuuaccgugguugugggggauaucauuggaguccuggaacagggcaagcggacacucaccccucagcccauggagcugaaauacuccuggaagacgugggggaaggcuaaaaucgugaccgccgagacacaaaauagcucuuucauuaucgacggaccuaacacccccgaaugcccguccgccagcagagcuuggaacgugugggaggucgaagacuauggcuuuggcguuuucacaaccaauaucuggcugaaacuucgcgagguguacacacaguccugugaucaucggcucaugucugcggccauuaaagacgaaagagcugugcacgccgauaugggguacuggaucgagagccagaagaacggauccuggaaacuggagaaggccucuuuuauugaagucaagaccugcacguggccuaaaagccacacacugugguccaauggcgugcucgagagcgacaugaucauucccaagucucuggcugggccuaucucccagcauaaccaccgccccggauaucauacccaaaccgccggcccuuggcaccuugggaaacuggaacucgauuucaauuacugcgagggaacaaccguugugaucacggagaacuguggcacacggggccccagccugagaaccacaaccgucucugggaagcugauucacgaauggugcugucgcuccugcacacuuccgccucuccgguauaugggagaggacggcuguugguacgggauggaaaucagacccauuaaugagaaagaagagaacauggugaaaagccugguuucugcgggaagcggcaagguggauaauuuuaccauggggguccugugccucgcuauccuguucgaggaagugaugcggggaaaauucggcaagaaacauaugauugccggcguucuuuuuacguucgugcugcuccuguccgggcagaucaccuggcgcgacauggcccacacacugauuaugaucggaagcaacgcuucugauagaaugggcaugggggucaccuaucuugcccugaucgcgacauuuaagauucagcccuuccucgcucugggauuuuuccuccggaaacugaccuccagagagaaucuucugcucggcguggggcuggccauggccacgacacugcaacuuccugaagacaucgagcagauggcuaacggaauugcccugggccucaugacccugaagcucaucacacaguuugaaaccuaccagcuguggaccgcucuugugagccugacauguuccaauacgauuuucacccucacagucgccuggcgcaccgcgacacugauccuggccggcguuucucuucugccgcucugccaaagcuccucuaugcggaagaccgauuggcugcccaugacgguggcugccaugggggugccuccccucccucuguuuaucuucagccuuaaagacacacccaagagacgcuccuggccucugaacgagggagucauggcugugggccugguuucuauucucgccagcucccugcuuagaaaugaugugcccauggccgggccgcuggucgcuggaggccuccugaucgcguguuaugugauuaccgggaccagcgccgaccucacaguugagaaagcugccgacgugaccugggaagaggaagccgagcagacaggagucucucauaaccugaugaucacgguggaugacgauggcaccaugcggauuaaggacgaugaaacagagaacauccuuaccguccugcugaaaacagcucuccugaucguguccggcauuuuuccuuacagcauccccgccacccuucugguuuggcacacguggcagaagcagacccaacgcucuggggugcucugggacgucccuucucccccggagacacagaaagcggaacuggaggaaggaguguacagaauuaagcagcagggcaucuucgggaagacccaaguuggagugggcguccagaaagaggggguguuucauacaauguggcacgugacccggggagcuguucucacacacaauggcaagcgccuggagccuaacugggccagcgucaaaaaggaucuuauuagcuauggcgggggauggagacuguccgcccaguggcaaaaaggcgaagagguccaggugaucgcugucgaacccgggaagaauccuaagaacuuccagacgaugcccggaauuuuccagaccacaaccggcgagaucggggccaucgcgcuggacuuuaaacccggaaccagcggcuccccuauuaucaaucgggaaggcaaggugguugggcucuacggaaacggcguggucaccaagaaugggggauaugugagcggcauugcucaaacgaacgccgagccggaugggcccaccccugagcuggaagaggaaauguucaagaaacgcaaucuuacaaucauggaccugcaucccggcucuggaaagaccagaaaguaccucccugccauuguucgggaggcuaucaaacgcagacugcggacacucauccuggcccccaccagaguggucgcugccgaaauggaggaggcgcuuaagggccugccuauucgcuaucagacgacagccaccaaaagcgaacacaccgggcgggagaucguggaucugaugugccaugcuacauuuaccaugagacuccuguccccgguucgcgugcccaacuacaaucuugucauuauggacgaagcccacuucacagauccugcuucuaucgccgcccggggauauauuagcaccagagugggcaugggggaggcugcggccaucuuuaugacggcuacacccccuggaaccgccgaagccuucccccaguccaacgcuccgauccaggacgaggagcgcgacauuccugaacggucuuggaauagcggcaacgaguggaucacagauuuuguggggaagaccgucugguucguucccuccauuaaagccggcaaugacaucgcgaacugucugagaaagaacggaaagaaagugauucaacucucucgcaagacguuugauaccgaauaccagaaaacacggcugaaugacugggauuucguggucaccacagacaucagcgagaugggcgcuaacuuuaaggccgauagagugauugacccccggcgcugccugaaaccuguuauccucaccgaugggcccgagagagugauccuugccggaccuaugccggucacagcugccuccgcggcccagcggcgcggcagaguggggcggaauccccagaaggaaaacgaccaauacauuuucaccggacagccucugaauaacgaugaggaccaugcucacuggacggaagccaagaugcugcucgacaauaucaacacacccgagggcauuaucccugcucuguucgaacccgagagagagaaaagcgccgcuauugauggggaauaucgccuuaagggcgagucucggaaaaccuuuguugaacugaugagacgcggagaccucccgguguggcuggcccacaaggucgcguccgagggcaucaaauacaccgaucggaaguggugcuucgacggggaaagaaauaaccagauccuggaggagaauauggauguggaaauuuggacaaaagagggagaacgcaagaagcuccggccuagauggcuugacgcccgcaccuauagcgauccccuggcucugaaagaguuuaaggacuucgccgcuggcagaaaaucuaucgcccucgaucuggucacagaaauugggcgggugccuucccaucuugcccaccgcacgagaaacgcucuggacaaucucguuaugcugcauaccagcgagcacggaggccgggcguaccgccacgccguggaggaacugcccgagacaauggaaacccuccuucugcugggccucaugauccugcuuacagggggagcuaugcuguuucucauuuccggcaaggggaucggaaaaaccucuaucggccugauuugugugaucgucagcuccgggaugcuguggauggccgauguuccucuccaguggauugccagcgcuaucgugcuugaguucuuuaugauggugcugcugauucccgagccggaaaagcaaagaacgccucaggacaaccagcucgccuaugucgugaucggcauucugacccuugcggccaucguugcugccaaugagaugggccugcucgaaacaaccaagcgggaucugggcaugucuaaagagcccgggguggucucccccacaagcuaccuggacguggaccuccauccugcuucugccuggacccuuuaugcggucgccacgacagugaucaccccgaugcugagacacacaauugaaaacagcaccgcuaauguuucccuggccgcuaucgccaaccaagcugugguccucaugggacuggauaagggcuggcccauuucuaaaauggaccuuggggugccucugcucgcccugggaugcuacagccagguuaacccccugacccucacagcggccgugcuucugcuggucacgcauuacgcuaucauuggcccugggcuccaggccaaggcuacccgcgaggcccagaaacggacagccgcgggaaucaugaagaaucccaccguggauggcaucaugacaauugaccuggauccugugaucuaugacuccaaguucgagaaacaacuuggccagguuaugcugcucguccugugugcugugcagcugcuccuuaugagaaccucuugggcccugugcgaagcucugacgcucgccacagggccgauuaccacccugugggagggaagccccggcaaguuuuggaacacaaccaucgccguguccauggcuaauauuuuccgcgggagcuaccuugccggagcgggccuggccuuuucuaucaugaaauccgucgggacaggacggagaggcacgggcagccagggggaaacccucggagagaaguggaaaaagaagcugaaccaacugucccggaaagaguucgaucucuauaagaaaucuggcaucacagagguugaccgcaccgaggcuaaggaagggcuuaaaagaggagagacaacccaccaugccgugagccggggcuccgcuaagcugcagugguuuguggaacgcaauauggucauuccugaggggagagugaucgaucugggauguggccggggcggguggucuuacuauugcgccggacucaaaaagguuacggaagugcgcggcuacaccaaagggggacccggccacgaggagccuguccccaugagcacauauggguggaacauugugaaacugauguccggaaaggacguuuucuaccuuccgccugaaaaaugugauacccugcucugcgacaucggcgagagcucucccucccccacaguggaagagagcagaaccauucggguccugaagaugguggagccuuggcugcgcaauaaccaguucuguaucaaagugcucaaucccuacaugccuacagucauugaacaccuugagagacugcagcggaaguauggcgggaugcugguuagaaacccgcucucucgcaauuccacccaugaaauguacuggaucagcaacggaacgggcaauaucgugucuagcgugaacauggucucccggcugcuucugaauagauuuacaaugacccaccgccggcccaccauugagaaggauguggaccucggggcgggaacaagacauguuaacgccgaaccugagacgcccaacauggacgugaucggcgagcgcauuaaacggaucaaggaagaacacucuagcaccuggcacuaugaugacgaaaauccuuacaaaacaugggcuuaucauggguccuacgaggucaaggccaccggaagcgcuuccucuaugauuaacggcgugguuaaacugcugacaaagcccugggauguggucccgauggugacccaaauggccaugacagacaccacgccuuucggccagcagagaguuuuuaaggaaaaaguggauacccgcacaccccggccuaugcccgggaccagaaaggucauggagaucacagcugaguggcucuggcgcacccugggacggaauaaaaagccuagacuuugcacgcgcgaagaguucaccaagaaggugagaaccaacgccgcgaugggcgccgucuuuacagaagagaaucaaugggacagcgcucgggccgcuguggaagaugaggaguucuggaagcugguugaccgcgaaagagagcuccacaaacuggggaaguguggauccugcguguauaacaugaugggcaaacgggaaaagaaacuuggggaguuuggcaaggccaaaggaucuagagccaucugguacauguggcugggcgcgcgguaccucgaguucgaagcucugggguuucugaaugaggaucauugguucagccgcgaaaacuccuauucuggagucgagggcgaagggcuccacaagcugggauacauucuuagagacaucagcaagauucccggcggggccauguaugccgaugacaccgcuggcugggacacgcggaucaccgaggaugaccugcauaaugaggagaagauuacacagcagauggauccggagcaccgccagcucgccaacgcuaucuuuaagcugaccuaccaaaauaaaguggugaagguucagagaccuacacccaaaggaaccgugauggacaucauuucccggaaggaucagcgcggcagcgggcaggucggaacauauggccuuaacaccuucacgaauauggaagcccaacuggugagacagauggagggggaaggaguucucucuaaggcggaccuggagaacccccaucugcucgagaaaaagaucacacaguggcuggaaaccaaaggcguggagcggcuuaagcgcauggccauuuccggggaugacugcgucgugaaaccuaucgaugacagauuugcuaaugcccugcucgcucugaacgauaugggcaagguccggaaggacauuccgcaguggcaacccagcaaaggauggcaugauuggcaacaggugccuuucuguucucaccauuuccacgaacuuaucaugaaggacggccgcaaacugguugugcccugcagaccucaggacgagcucaucgggcgggcccgcauuucccaaggagcgggcuggagccugaaggaaaccgccugucuggggaaggcuuacgcccagauguggaaccucauguauuuucacagacgggaucugagacuugcuucuaaugccaucugcuccgcuguccccgugcauuggauuccuacaagccgcaccacaugguccauccacgcccaucaccaguggaugacgaccgaggacaugcugacaguuuggaaccggguguggauugaggauaaucccuggauggaagacaagaccccggucacaaccugggaggaugugccuuaccucggaaagagagaagaccaaugguguggcagccugaucgggcuuacgucucgcgcgaccugggcccagaacauucugacagcuauccaacaggugcggagccucaucggcgaugaggaguuccuggacuacaugcccuccaugaaaagauuucgcaaggaagaggaaucugagggagccauuugguga

SEQ ID NO: 20511 - RNA, 9873 nt, Artificial Sequence
  derived and/or modified CDS sequence (opt5) from DENV-3__FJ639730__SS-prME
accagccugugccucaugaugaugcugcccgccacccuugcuuuccaccugacgucccgggacggcgaaccucggaugaucguggggaagaacgaacgcggaaagucucuccuguuuaagaccgccuccggcauuaauauguguacccuuaucgcgauggaucugggggaaaugugcgacgauaccgucacauacaaguguccgcucauugcugaaguugaacccgaagacaucgauugcugguguaaccugaccuccacaugggugaccuauggaacgugcaaucaggccggcgaacaccggcgggacaagcgcucuguggcccuggcuccucacgucgggaugggacucgauaccagaacacagaccuggaugagcgccgaaggcgcuuggagacagguggaaaagguugaaacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugcuauuaauuggaagggaaaggaacuuaaaugcggcuccgggaucuucgugaccaacgagguucacacauggacggagcaguacaaguuucaagccgacagccccaaacggcucgcgaccgccauugcuggcgccugggaaaauggaguguguggcaucagaucuacaacccgcauggagaaccugcuguggaagcagauugcuaaugaacucaacuauauccugugggagaauaacaucaaacuuacagucgugguuggggauauuaucggagugcuggaacagggcaagcggacccucacgccucagcccauggagcugaaauacuccuggaagaccugggggaaggccaaaauugucacagccgagacccaaaauagcucuuucaucauugacggaccuaacacacccgaaugcccguccgcuagcagagcguggaacgugugggagguggaagacuauggcuuuggcgucuucaccacaaauaucuggcugaaacuucgcgagguuuacacccaguccugugaucaucggcucaugucugccgcuaucaaagacgaaaaggccgugcacgccgauaugggguacuggauugagagccagaaaaacggauccuggaagcuggagaaggcuucuuuuaucgaagugaaaacgugcacauggccuaagagccacacccugugguccaauggcguccucgagagcgacaugauuauccccaaaucucuggccgggccuauuucccagcauaaccacagacccggauaucauacccaaacagcgggcccuuggcaccuugggaagcuggaacucgauuucaauuacugcgagggaaccacggugguuaucacagagaacuguggcacccgcggccccagccugcggacaaccacagugucugggaaacugauccacgaauggugcuguagauccugcacccuuccgccucuccgcuauaugggagaggacggcuguugguacgggauggaaauucggcccaucaaugagaaggaagagaacauggucaagagccuggugucugcuggaagcggcaaaguugauaauuuuacgaugggggugcugugccucgccauucuguucgaggaagucaugagaggaaaguucggcaaaaagcauaugaucgccggcgugcuuuuuaccuucguucugcuccuguccgggcagauuacauggcgggacauggcucacacccugaucaugauuggaagcaacgccucugaucgcaugggcaugggggugacauaucuugcgcugaucgcuaccuuuaaaauccagcccuuccucgcccugggauuuuuccucagaaagcugacgucccgggagaaucuucugcucggcgucgggcuggccauggcuacaacccugcaacuuccugaagacauugagcagauggccaacggaaucgcucugggccucaugacacugaagcucauuacccaguuugaaaccuaccagcuguggacagcccuugugagccugacguguuccaauaccaucuucacacucaccguggcguggagaacagccacccugauucuggcuggcgucucucuucugccgcucugccaaagcuccucuaugcgcaaaacggauuggcugcccaugacaguugccgcuaugggggugccuccccucccucuguuuaucuucagccuuaaggacacccccaaacggagauccuggccucugaacgagggagugauggccgucggccuggugucuauccucgccagcucccugcuucgcaaugauguucccauggcugggccgcugguggcgggaggccuccugauugccuguuaugucaucaccgggacaagcgcugaccucaccguggagaaggccgccgacguuacaugggaagaggaagcugagcagacgggagugucucauaaccugaugauuaccgucgaugacgauggcacaaugagaaucaaagacgaugaaaccgagaacauucuuacagugcugcugaagaccgcccuccugaucgucuccggcaucuuuccuuacagcauucccgcgacgcuucugguguggcacaccuggcagaaacagacacaacggucugggguucucugggacgugccuucucccccggagacccagaaggcugaacuggaggaaggagucuaccgcaucaagcagcagggcauuuucgggaaaacacaagugggaguuggcgugcagaaggagggggucuuucauaccauguggcacgugacaagaggagccgugcucacgcacaauggcaaacggcuggagccuaacugggccagcguuaagaaagaucuuaucagcuauggcgggggauggcgccugaaugcucaguggcaaaagggcgaagagguccaggugauugccguggaacccgggaagaacccuaaaaauuuccagaccaugcccggaaucuuccagacaaccaccggcgagauuggggcgaucgcucuggacuuuaagcccggaacauccggcagcccuaucauuaacaaagaaggcaaggucguggggcucuacggaaauggcguugugacgaaaaacgggggauaugucuccggcaucgcccaaaccaaugccgagccggaugggcccacaccugagcuggaagaggaaauguucaagaagagaaaccuuaccauuauggaccugcaucccggcagcggaaaaacacggaaguaccucccugcuaucgugcgcgaggccauuaaaagacggcugcgcacccucauccuggcucccacgagaguuguggccgcggaaauggaggaggcccuuaagggccugccuauccgguaucagacaaccgcuaccaaaucugaacacacagggagagagauugucgaucugaugugccaugccaccuuuacaaugcgccuccugagcccggugcggguucccaauuacaaccuugugaucauggacgaagcucacuucaccgauccugccuccauugccgcuagaggauauaucucuacgcgcgucggcaugggggaggcggccgcuauuuuuaugacagccacacccccuggaacagccgaggcuuucccccagagcaaugccccgauccaggacgaggagcgggacaucccugaaagauccuggaacucuggcaaugaguggauuaccgauuuuguggggaagacggugugguucguccccagcaucaaggcgggcaacgacauugcuaacugucugcgcaaaaauggaaagaaaguuauccaacucucccggaagaccuuugauacagaauaccagaaaaccagacugaacgacugggauuucguggugacaaccgacauuucugagaugggcgccaauuuuaaggccgaucgcgucaucgacccccggagaugccugaagccugugauucucacagaugggcccgagcggguuauccuugcuggaccuaugccggugaccgccgcgagcgccgcucagcgcagaggccgggucgggcgcaacccccagaaagaaaaugaccaauacaucuucacgggacagccucugaacaaugaugaggaccaugcccacuggacagaagcuaagaugcugcucgacaacauuaauacccccgagggcaucauuccugcccuguucgaacccgagagagagaaauccgcugccaucgauggggaauaucggcuuaagggcgagagcagaaaaaccuuuguggaacugaugcgccggggagaccucccgguuuggcuggcgcacaagguggccucugagggcauuaaauacacagauagaaaguggugcuucgacggggaacgcaacaaucagauccuggaggagaacauggaugucgaaaucuggaccaaggagggagaacggaaaaagcucagaccucgcuggcuugacgcucggacauauuccgauccccuggcccugaaagaguuuaaggacuucgcugccggcagaaaaagcauugcccucgaucuggugacggaaaucgggcgcgucccuucucaucuugcucacagaacccggaaugcgcuggacaaccucgugaugcugcauacauccgagcacggaggccgcgccuacagacacgcuguugaggaacugcccgagaccauggaaacacuccuucugcugggccucaugauucugcuuaccgggggagccaugcuguuucucaucagcggcaaggggauuggaaagacguccaucggccugaucugugugauugugucuagcgggaugcuguggauggccgaugucccucuccaguggaucgcuuccgccauuguucuugaguucuuuaugauggugcugcugauccccgagccggaaaaacaacggaccccucaggacaaucagcucgcguauguggucauuggaauccugacacuugccgcuauuguggccgcuaacgagaugggccugcucgaaaccacaaagcgcgaucugggcaugagcaaagagcccgggguugugucucccaccuccuaccuggacgucgaccuccauccugccagcgcguggacgcuuuaugccguggcuacaaccgucaucacaccgaugcugagacacaccaucgaaaauucuaccgccaacgugagccuggcugccauugcuaaccaagccguugugcucaugggacuggauaagggcuggcccaucuccaaaauggaccuuggggucccucugcucgcgcugggaugcuacucucaggugaauccccugacacucacggccgcuguucuucugcuggugacccauuacgccauuaucggcccugggcuccaggcuaaggccacacgggaggcccagaagagaaccgcggcuggaauuaugaaaaaccccacagucgauggcaucaugaccaucgaccuggauccugugauuuaugacagcaaguucgagaaacaacuuggccaggugaugcugcucguucugugugccguccagcugcuccuuaugcgcacguccugggcucugugcgaagcccugacacucgccaccgggccgaucaccacacugugggagggaucucccggcaaguuuuggaauaccacaauugcugugagcauggccaacaucuuccggggguccuaccuugcgggagccggccuggcuuuuagcauuaugaaaucuguggggacgggaagacgcggcaccggcucccagggggaaacacucggagagaaguggaagaaaaagcugaaucaacugagccggaaagaguucgagcucuauaagaaauccggcaucaccgaggucgauagaacagaagccaaggaggggcuuaaacggggagaaaccacgcaccaugcuguuucucgcggcagcgccaagcugcagugguuuguggagagaaacauggugaucccugaagggcgggucauugaccugggauguggccgcggcgggugguccuacuauugcgcgggacucaagaaagugaccgagguuagaggcuacacaaaaggcgggcccgggcacgaggaaccugugcccaugucuaccuauggguggaauaucgucaaacugaugagcggaaaggauguguucuaccuuccgccugagaaaugugacacacugcucugcgauauuggcgaauccagccccucucccaccguugaggagucccggacaauccgcgugcugaagauggucgaaccuuggcugagaaacaaucaguucuguauuaaggugcucaaccccuacaugccuaccgugaucgagcaccuugaaaaacugcagcggaaguauggcgggaugcugguccgcaauccgcucagcagaaacucuacgcaugagauguacuggauuuccaauggaacaggcaacaucguuagcucugugaauauggugagccggcugcuucugaacagauuuaccaugacccaccgccggcccacaaucgaaaaagacgucgaucucggggccggaacgagacaugugaacgcugagccugagacccccaauauggacguuauuggcgaacgcaucaagcggauuaaagaggaacacuccucuacauggcacuaugacgaugagaacccuuacaagaccugggccuaucaugggagcuacgaagugaaggcuacaggauccgccagcuccaugaucaauggcgucgugaaacugcugaccaagcccugggacguugugccgauggucacacaaauggcuaugaccgauacgaccccuuucggccagcagagaguguuuaaagagaagguugacacacgcacaccccggccuaugcccgggacaagaaaagugauggagauuaccgccgaauggcucuggcgcacgcugggacggaacaagaagccuagacuuugcacacgcgaggaguucaccaaaaagguccggacaaaugcggccaugggcgcuguguuuaccgaggaaaaccaaugggauucugccagagcugccgucgaggacgaggaguucuggaaacugguggaucgcgagagagaacuccacaagcuggggaaauguggaagcugcguuuauaauaugaugggcaagcgggagaagaaacuuggggaguuuggcaaagccaaaggaucccgcgcgaucugguacauguggcugggcgcuagauaccucgaguucgaggcccugggguuucugaacgaagaccauugguucucucgggagaauagcuauuccggaguggaaggcgaggggcuccacaagcugggauacauccuuagagauauuucuaaaauccccggcggggccauguaugcugacgauacggccggcugggacacccggauuacagaggacgaucugcauaacgaagagaagaucacccagcagauggacccggaacaccgccagcucgcuaaugccauuuuuaaacugacauaccaaaacaaggucgugaaggugcagagaccuacccccaaaggaacaguuauggauaucaucagccggaaggaccagcgcggcuccggacaggugggaaccuauggccuuaauacguucacaaacauggaggcgcaacuggucagacagauggaaggggagggagugcucagcaaagccgaucuggagaauccccaucugcucgaaaagaaaauuacccaguggcuggagaccaagggcguugaacggcuuaagcgcauggcuaucucuggggacgauugcguggucaaaccuauugacgauagauuugccaacgcucugcucgcccugaacgacaugggcaaggugcggaaagauaucccgcaguggcaacccuccaagggauggcaugacuggcagcaggucccuuucuguagccaccauuuccacgagcuuauuaugaaagauggccgcaagcuggugguucccugcagaccucaggacgaacucaucgggcgggcgcgcaucucucaaggagccggcuggucccugaaggagacagcuugucuggggaaagccuacgcucagauguggagccucauguauuuucacagacgggaccugcgccuugccucuaaugcuauuugcuccgccgugcccguccauuggaucccuaccagcagaacaacgugguccauucacgcgcaucaccaguggaugaccacagaggauaugcugaccguguggaaccggguuuggaucgaagacaaucccuggauggaggauaagacaccggugaccacgugggaagacgucccuuaccucggaaaaagagaggaucaaugguguggcagccugauugggcuuaccucucgcgccacaugggcucagaacauccugaccgccauucaacaggugcggagccucaucggcgacgaggaguuccuggauuacaugcccuccaugaagagauuucgcaaagaggaagagucugaaggagccaucugguga

SEQ ID NO: 20512 - RNA, 9873 nt, Artificial Sequence
  derived and/or modified CDS sequence (opt5) from DENV-3__KF955464__SS-prME
accagccugugccucaugaugaugcugcccgccacacuugcuuuccaccugacgucccgggacggcgaaccucggaugaucguggggaagaacgaacgcggaaagucucuccuguuuaagaccgccagcggcauuaauauguguacacuuaucgcgauggaucugggggaaaugugcgacgauaccgucacauacaaguguccgcucauugcugaaguugaacccgaagacaucgauugcugguguaaccugaccuccacaugggugaccuauggaacgugcaaucaggccggcgagcacagacgggacaagcgcucuguggcccuggcuccucacgucgggaugggacucgauaccagaacacagaccuggaugagcgccgagggcgcuuggcggcaggucgaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacagcuugccauucugcgcaaacucuguaucgagggaaagauuaccaauaucacaaccgauagcagaugcccuacgcagggcgaagcgacacugccggaggaacaggaccagaacuauguguguaaacacaccuacguggaucggggcugggggaauggaugcggccuuuucgggaagggaucucuggugaccugcgccaaguuucaaugucucgagcccauugagggcaaagugguucaguaugaaaaccugaaguacacagugaucaucaccguccacacaggggaccagcaucaggugggaaaugacacgcaaggcguuaccguggagauuacaccucaggcuuccaccgucgaagccgugcugcccgaguauggcacacucgggcuggaaugcagcccucgcaccggacuugauuucaacgagaugauccugcucacgaugaaaaauaaggcuuggaugguccacagacagugguuuuucgaccugccccuuccguggaccucuggcgccacaaccgagacaccuaccuggaaccggaaagaacugcucgugacguuuaagaaugcccaugcuaaaaagcaagagguugugguccuggggucccaggaaggagcgaugcacacagcccugaccggcgcuacagagauucagaacagcgggggcaccaauaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccaucaacauugaagcugagccuccguucggcgaauccaauaucgugauugggaucggcgacaaagcccucaagaucaacugguauaagaaaggaucuagcauuggcaagauguuugaggccacagcuagaggggccagacgcauggcuauccugggagauaccgccugggacuucggcuccguugggggaguccugaauagccucggcaaaauggugcaucagauuuuugggucugcguacacggcccuguucuccggcgugagcuggaucaugaagauuggaaucggcguccuucugacauggauugggcucaacucuaaaaauaccagcauguccuuuucuugcaucgugaucggaauuaucacccuguaucugggcgcuguugugcaggccgauauggggugugucauuaacuggaagggaaaggaacuuaaaugcggcaaugggaucuucgugacaaacgagguucacaccuggacagagcaguacaaguuucaagcugacagccccaaacggcucgccacggcgauugccggcgcuugggaaaauggaguguguggcaucagauccaccacacgcauggagaaccugcuguggaagcagaucgccaaugaacucaacuauauucugugggagaauaacaucaaacuuaccgucgugguuggggauauuaucggagugcuggaacagggcaagcggacacucaccccucagcccauggagcugaaauacagcuggaagacgugggggaaggcuaaaauugucaccgccgagacacaaaacucuuccuucaucaucgacggaccuaauacccccgaaugcccgagcgccucuagagcuuggaacgugugggagguggaagacuauggcuuuggcgucuucacaaccaauauuuggcugaaacuucgcgagguuuacacacaguccugugaucaucggcucaugagcgcggccaucaaagacgaaagagcugugcacgccgauaugggguacuggauugagucccagaagaacggaucuuggaaacuggagaaggccagcuuuaucgaagugaagaccugcacguggccuaaaucccacacacuguggucuaauggcguccucgagagcgacaugauuauccccaagucccuggcugggccuaucagccagcauaaccaccgccccggauaucauacccaaaccgccggcccuuggcaccuugggaaacuggaacucgauuucaauuacugcgagggaacaaccgugguuauugcggagaacuguggcacgcggggccccucucugagaacaaccacaguguccgggaagcugauccacgaauggugcugucgcagcugcacccuuccgccucuccgguauaugggagaggacggcuguugguacgggauggaaauuagacccaucaaugagaaagaagagaacauggucaagucucugguguccgcuggaagcggcaagguugauaauuuuacaaugggggugcugugccucgccauucuguucgaggaagucaugcggggaaaauucggcaagaaacauaugaucgccggcgugcuuuuuaccuucguucugcuccugucugggcagauuacguggcgcgacauggcucacacccugaucaugaucggaagcaacgccuccgauagaaugggcaugggggugacauaucuugcgcugauugcuaccuuuaagauccagcccuuccucgcccugggauuuuuccuccggaaacugacaagcagagagaaucuucugcucggcgucgggcuggccauggcuaccacgcugcaacuuccugaagacauugagcagauggccaacggaaucgcucugggccucaugacacugaagcucauuacccaguuugaaacauaccagcuguggaccgcccuugugucucugaccuguuccaauacaaucuucacgcucaccguggcguggcgcacagccacccugauccuggcuggcgucagccuucugccgcucugccaauccucuagcaugcggaagacagauuggcugcccaugaccguugccgcuaugggggugccuccccucccucuguuuauuuucucccuuaaagacacgcccaagagaaaaucuuggccucugaacgagggagugauggccgucggccuggugagcauccucgccuccucucugcuucgcaacgauguucccauggcugggccgcugguggcgggaggccuccugauugccuguuaugucaucacagggaccagcgcugaccucaccguggagaaggccgccgacguuacaugggaagaggaagcugagcagaccggagugucccauaaucugaugauuacagucgaugacgauggcacgaugagaaucaaagacgaugaaaccgagaacauccuuacagugcugcugaagaccgcccuccugauugucagcggcaucuuuccuuacucuauucccgcgacacuucugguguggcacaccuggcagaaacagacgcaacgguccgggguucucugggacgugccuucucccccggagacccagaaggcugaacuggaggaaggagucuaccgcaucaagcagcagggcauuuucgggaaaacacaagugggaguuggcgugcagaaggagggggucuuucauaccauguggcacgugacaagaggagccgugcucacccacaauggcaaacggcuggagccuaacugggccuccguuaagaaagaucuuaucuccuauggcgggggauggcgccugagcgcucaguggcaaaagggcgaagagguccaggugauugccguggaacccgggaagaauccuaaaaacuuccagacaaugcccggaaucuuccagacgaccacaggcgagaucggggcgauugcucuggacuuuaagcccggaaccucuggcuccccuaucauuaauagagaaggcaaagucguggggcucuacggaaacggcguugugaccaagaaugggggauaugucagcggcaucgcccaaacaaacgccgagccggaugggcccacgccugagcuggaagaggaaauguucaaaaagcggaaucuuaccauuauggaccugcaucccggcuccggaaagacacgcaaauaccucccugcuaucgugagagaggccaucaagcggcgccugagaacccucauucuggcucccacacggguuguggccgcggaaauggaggaggcccuuaaaggccugccuaucagauaucagaccacggcuacaaagagcgaacacaccgggcgcgagauugucgaucugaugugccaugccaccuuuacaaugcggcuccugucuccggugagaguucccaacuacaaucuuaucauuauggacgaagcucacuucaccgauccugccagcaucgccgcucgcggauauaucuccacacgggugggcaugggggaggcggccgcuauuuuuaugaccgccacgcccccuggaacagccgaggcuuucccccagucuaacgccccgauccaggacgaggagagagacauuccugaacgcagcuggaauagcggcaacgaguggaucaccgauuuugucgggaaaacagugugguucgugcccucuauuaaggcgggcaacgacaucgcuaauugucugcggaagaacggcaaaaaggucauucaacucagcagaaaaaccuuugauacggaauaccagaagacccgccugaaugacugggauuucguugugacaaccgacaucuccgagaugggagccaacuuuaaagccgaucgggugaucgaccccagacggugccugaagccugucauucucacagaugggcccgagcgcgugauccuugcuggaccuaugccgguuaccgccgcgucugccgcucagagacggggccgcguggggagaaauccccagaaggaaaacgaccaauacauuuucacaggacagccucugaauaacgaugaggaccaugcccacuggaccgaagcuaaaaugcugcucgacaauaucaacacgcccgagggcauuaucccugcccuguucgaacccgagcgggaaaagagcgcugccaucgauggggaauauagacuuaaaggcgagucccgcaagacauuugucgaacugaugcggagaggagaccucccgguguggcuggcgcacaaaguugccagcgagggcauuaaguacaccgaucgcaaauggugcuucgacggggaacggaauaaccagauccuggaggagaauauggauguggaaauuuggaccaaggagggagaaagaaagaaacuccgcccucgguggcuugacgcuagaacauauucugauccccuggcccugaaggaguuuaaagacuucgcugccggccgcaaguccaucgcccucgaucuggucaccgaaauugggagagugccuagccaucuugcucaccggacacgcaacgcgcuggacaaucucgucaugcugcauacgucugagcacggaggcagagccuaccggcacgcuguggaggaacugcccgagaccauggaaacacuccuucugcugggccucaugauccugcuuaccgggggagccaugcuguuucucaucuccggcaaagggauuggaaagacaagcaucggccugauuuguguuaucguguccucugggaugcuguggauggccgaugugccucuccaguggauugcuagcgccaucguccuugaguucuuuaugaugguucugcugauucccgagccggaaaagcaacgcaccccucaggacaaccagcucgcguauguggugaucggaauccugacgcuugccgcuauugucgccgcuaaugagaugggccugcucgaaaccacaaaaagagaucugggcauguccaaggagcccggggugguuagccccaccucuuaccuggacguggaccuccauccugccuccgcguggacacuuuaugccgucgcuaccacggugaucacaccgaugcugcggcacaccauugaaaacagcacagccaacgucucucuggcugccaucgcuaaucaagccgugguucucaugggacuggauaaaggcuggcccauuagcaagauggaccuuggggugccucugcucgcgcugggaugcuacucccaggucaacccccugacccucaccgccgcugugcuucugcugguuacacauuacgccaucaucggcccugggcuccaggcuaaagccacgagagaggcccagaagcgcaccgcggcuggaauuaugaagaaucccacaguggauggcaucaugaccauugaccuggauccugucaucuaugacucuaaauucgagaagcaacuuggccaggugaugcugcucgugcugugugccguucagcugcuccuuaugcggacaagcugggcucugugcgaagcccugacccucgccacggggccgauuacaacccugugggagggaucccccggcaaauuuuggaacaccacaaucgcugucucuauggccaauaucuucagagggagcuaccuugcgggagccggccuggcuuuuuccauuaugaaaagcguggggaccggacgccggggcacaggcucucagggggaaacgcucggagagaaauggaagaagaaacugaaccaacuguccagaaaggaguucgaucucuauaaaaagagcggcaucaccgagguggaccggacagaggccaaagaagggcuuaagcgcggagagaccacacaccaugcugucuccagaggcucugccaaacugcagugguuuguugaacggaauauggugauuccugaggggcgcgugaucgaucugggauguggcagaggcggguggagcuacuauugcgcgggacucaagaaggucaccgaagugcggggcuacacgaaagggggacccggccacgaggagccuguucccauguccaccuauggguggaacauugugaagcugaugucuggaaaagacgucuucuaccuuccgccugaaaagugugauacacugcucugcgacaucggcgagagcucccccagccccaccguggaagagucucgcacaauuagaguucugcggaugguggagccuuggcugcgcaauaaccaguucuguaucaaaguccucaaucccuacaugccuaacgugaucgaacaccuugagagacugcagcggaaguauggcgggaugcuggugagaaauccgcucucccgcaacagcacccaugaaauguacuggauuucuaauggaacaggcaacaucgucuccagcguuaacauggugucucggcugcuucugaauagauuuaccaugacgcaccgccggcccacaauugagaaggauguggaccucggggccggaaccagacaugucaacgcugaaccugagacccccaauauggacgugaucggcgagcgcauuaaacggaucaaggaagaacacagcuccacauggcacuaugaugacgaaaacccuuacaaaacgugggccuaucaugggucuuacgagguuaaggcuaccggaagcgccuccagcaugaucaauggcguggucaaacugcugacaaagcccugggaugugguuccgauggugacccaaauggcuaugacagacaccacaccuuucggccagcagagagucuuuaaggaaaaaguggauacccgcacgccccggccuaugcccgggaccagaaagguuauggagauuacagccgaguggcucuggcgcacccugggacggaacaaaaagccuagacuuugcacacgcgaagaguucaccaaaaaggugagaacgaaugcggccaugggcgcugucuuuacagaagagaaccaaugggacuccgcccgggcugccguggaagaugaggaguucuggaagcuggucgacaaagaacgcgagcuccacaagcuggggaaauguggaucuugcguguauaauaugaugggcaagagagagaagaaacuuggggaguuuggcaaagccaagggaagccgggcgaucugguacauguggcugggcgcuagauaccucgaguucgaagcccugggguuucugaacgaggaucauugguucucccgggaaaauucuuauagcggaguugagggcgaagggcuccacaagcugggauacauucuucgcgacaucuccaaaauucccggcggggccauguaugcugaugacaccgccggcugggacacaagaaucaccgaggaugaccugcauaacgaggaaaagaucacgcagcagauggauccggagcaccggcagcucgcuaaugccauuuuuaaacugaccuaccaaaacaagguggucaaagugcagcgcccuacacccaagggaaccgugauggacaucauuucuagaaaggaucagcggggcagcgggcagguuggaacauauggccuuaauaccuucacaaacauggaagcgcaacuggugcgccagauggagggggaaggaguccucuccgaggccgaccuggagaacccccaucugcucgagaagaagaucacccaguggcuggagacgaaaggcguggaaagacuuaagcggauggcuauuagcggggaugacugcguugugaaaccuaucgaugaccgcuuugccaaugcucugcucgcccugaacgauaugggcaaggucagaaaggacaucccgcaguggcaacccucuaaaggauggcaugauuggcaacaggugccuuucuguucccaccauuuccacgagcuuauuaugaaggacggccggaaacuggucgugcccugccgcccucaggacgaacucaucgggagagcgcggauuagccaaggagccggcuggucucugaaggagacagcuugucuggggaaagccuacgcucagauguggucccucauguauuuucaccgcagagaucugcggcuugccagcaaugcuaucugcucugccguucccgcgcauuggauuccuaccuccagaaccacauggagcauccacgcccaucaccaguggaugaccacagaggacaugcugacgguguggaaccgcgucuggauugaagauaaucccuggauggaggacaagaccccggugacaaccugggaagauguuccuuaccucggaaagcgggaggaccaaugguguggcucccugaucgggcuuacaagcagagcuaccugggcccagaacauccugacggccauucaacaggugcgcucucucaucggcgaugaggaguuccuggacuacaugcccagcaugaaacgguuuagaaaggaggaagaguccgaaggagcuauuugguga

SEQ ID NO: 20513 - RNA, 9873 nt, Artificial Sequence
  derived and/or modified CDS sequence (opt5) from DENV-3__FJ639731__SS-prME
accucccugugccucaugaugaugcugcccgccacccuugcuuuccaccugacgucccgggacggagaaccucggaugaucguggggaagaacgaacgcggaaagucucuccuguuuaagaccgccagcggcauuaauauguguacccuuaucgcgauggaucugggggaaaugugcgacgauaccgugacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccgugcugaucaaggucgaauacaagggagaggacgcucccuguaaaauuccuuucuccacagaagauggccaagggaaggcccacaacggaagacuuaucaccgcgaaccccguggugaccaagaaggaggagcccguuaauaucgaagcugagccuccguucggcgaaucuaacauugucaucgggauuggcgacaaagcccucaagaucaauugguauaagaaaggaagcuccauuggcaagauguuugaggccaccgcuagaggggccagacgcauggcuauccugggagauacggccugggacuucggcagcgucggaggggugcugaacucucucggcaaaaugguccaucagaucuuuggguccgcguacacagcccuguucagcggcgugucuuggauuaugaagaucggaauuggcguucuucugaccuggaucgggcucaauagcaaaaacaccuccaugucuuuuagcugcauugugaucggaauuaucacacuguaucugggcgcugucgugcaggccgauauggggugugcuaucaauuggaagggaaaggaacuuaaaugcggcuccgggauuuucguuaccaacgaggugcacacauggacggagcaguacaaguuucaagccgacagccccaaacggcucgcgaccgccaucgcuggcgccugggaaaauggagucuguggcauuagaucuacaacccgcauggagaaccugcuguggaagcagaucgcuaaugaacucaacuauauucugugggagaauaacaucaaacuuacagugguugugggggauaucauuggaguccuggaacagggcaagcggacccucacgccucagcccauggagcugaaauacuccuggaagaccugggggaaggccaaaaucgugacagccgagacccaaaauagcucuuucauuaucgacggaccuaacacacccgaaugcccguccgcuagcagagcguggaacgugugggaggucgaagacuauggcuuuggcguuuucaccacaaauauuuggcugaaacuucgcgagguguacacccaguccugugaucaucggcucaugucugccgcuaucaaagacgaaagagccgugcacgccgauaugggguacuggaucgagagccagaagaacggauccuggaaacuggagaaggcuucuuuuauugaagucaagacgugcacauggccuaaaagccacacccugugguccaauggcgugcucgagagcgacaugaucauucccaagucucuggccgggccuaucucccagcauaaccaccgccccggauaucauacccaaacagcgggcccuuggcaccuugggaaacuggaacucgauuucaauuacugcgagggaaccacgguugugauuacagagaacuguggcacccggggccccagccugagaacaaccacagucucugggaagcugauccacgaauggugcugucgcuccugcacccuuccgccucuccgguauaugggagaggacggcuguugguacgggauggaaaucagacccauuaaugagaaagaagagaacaugguuaagagccuggugucugcuggaagcggcaagauggauaauuuuacgaugggggugcugugccucgccauccuguucgaggaagucaugcggggaaaauucggcaagaaacauaugauugccggcgugcuuuuuaccuucguucugcuccuguccgggcagaucacauggcgcgacauggcucacacccugauuaugaucggaagcaacgccucugauagaaugggcaugggggugacauaucuugcgcugauugcuaccuuuaagauccagcccuuccucgcccugggauuuuuccuccggaaacugacguccagagagaaucuucugcucggcgucgggcuggccauggcuacaacccugcaacuuccugaagacaucgagcagauggccaacggaauugcucugggccucaugacacugaagcucaucacccaguuugaaaccuaccagcuguggacagcccuugugagccugacguguuccaauaccauuuucacacucaccguggcguggcgcacagccacccugauccuggcuggcgucucucuucugccgcucugccaaagcuccucuaugcggaagacggauuggcugcccaugacaguugccgcuaugggggugccuccccucccucuguuuauuuucagccuuaaagacacccccaagagacgcuccuggccucugaacgagggagugauggccgucggccuggugucuauccucgccagcucccugcuuagaaaugauguucccauggcugggccgcugguggcgggaggccuccugaucgccuguuaugucauuaccgggacaagcgcugaccucaccguggagaaagccgccgacguuacaugggaagaggaagcugagcagacgggagugucucauaaccugaugaucaccgucgaugacgauggcacaaugcggauuaaggacgaugaaaccgagaacauccuuacagugcugcugaaaaccgcccuccugauugucuccggcaucuuuccuuacagcauccccgcgacgcuucugguguggcacaccuggcagaagcagacacaacgcucugggguucucugggacgugccuucucccccggagacccagaaagcugaacuggaggaaggagucuacagaauuaagcagcagggcaucuucgggaagacacaagugggaguuggcgugcagaaagagggggucuuucauaccauguggcacgugacacggggagccgugcucacgcacaauggcaagcgccuggagccuaacugggccagcguuaaaaaggaucuuauuagcuauggcgggggauggagacugaaugcucaguggcaaaaaggcgaagagguccaggugaucgccguggaacccgggaagaacccuaagaauuuccagaccaugcccggaauuuuccagacaaccaccggcgagaucggggcgauugcucuggacuuuaaacccggaacauccggcagcccuaucaucaacaaggaaggcaaagucguggggcucuacggaaauggcguugugacgaagaacgggggauaugucuccggcauugcccaaaccaaugccgagccggaugggcccacaccugagcuggaagaggaaauguucaaaaagcggaaccuuaccaucauggaccugcaucccggcagcggaaagacacgcaaauaccucccugcuauugugagagaggccaucaagcggcgccugagaacccucauucuggcucccacgcggguuguggccgcggaaauggaggaggcccuuaaaggccugccuaucagauaucagacaaccgcuaccaagucugaacacacagggcgcgagaucgucgaucugaugugccaugccaccuuuacaaugcggcuccugagcccggugagaguucccaauuacaaccuugugauuauggacgaagcucacuucaccgauccugccuccaucgccgcucgcggauauauuucuacgcgggucggcaugggggaggcggccgcuaucuuuaugacagccacacccccuggaacagccgaggcuuucccccagagcaaugccccgauucaggacgaggagagagacaucccugaacgcuccuggaacucuggcaaugaguggaucaccgauuuuguggggaaaacggugugguucguccccagcauuaaggcgggcaacgacaucgcuaacugucugcggaagaaugggaaaaagguuauucaacucuccagaaaaaccuuugauacagaauaccagaagacccgccugaacgacugggauuucguggugacaaccgacaucucugagaugggcgccaauuuuaaagccgaucgggucauugaccccagacggugccugaagccugugauccucacagaugggcccgagcgcguuauucuugcuggaccuaugccggugaccgccgcgagcgccgcucagagacggggccgcgucgggagaaacccccagaaggaaaaugaccaauacaucuucacgggacagccucugaacaaugaugaggaccaugcccacuggacagaagcuaaaaugcugcucgacaacaucaauacccccgagggcauuaucccugcccuguucgaacccgagcgggagaaguccgcugccauugauggggaauauagacuuaaaggcgagagccgcaagaccuuuguggaacugaugcggagaggagaccucccgguuuggcuggcgcacaaaguggccucugagggcaucaaguacacagaucgcaaauggugcuucgacggggaacggaacaaucagauucuggaggagaacauggaugucgaaaucuggaccaaggagggagaaagaaagaaacuccgcccucgguggcuugacgcuagaacauauuccgauccccuggcccugaaggaguuuaaagacuucgcugccggccgcaagagcaucgcccucgaucuggugacggaaauugggagagucccuucucaucuugcucaccggacccgcaaugcgcuggacaaccucgugaugcugcauacauccgagcacggaggcagagccuaccggcacgcuguugaggaacugcccgagaccauggaaacacuccuucugcugggccucaugauccugcuuaccgggggagccaugcuguuucucauuagcggcaaagggaucggaaagacguccauuggccugaucugugugaucgugucuagcgggaugcuguggauggccgaugucccucuccaguggauugcuuccgccaucguucuugaguucuuuaugauggugcugcugauucccgagccggaaaagcaacgcaccccucaggacaaucagcucgcguauguggucaucggcauucugacacuugccgcuaucguggccgcuaacgagaugggccugcucgaaaccacaaaaagagaucugggcaugagcaaggagcccgggguugugucucccaccuccuaccuggacgucgaccuccauccugccagcgcguggacgcuuuaugccguggcuacaaccgucauuacaccgaugcugcggcacaccaucgaaaauucuaccgccaacgugagccuggcugccaucgcuaaccaagccguugugcucaugggacuggauaaaggcuggcccauuuccaagauggaccuuggggucccucugcucgcgcugggaugcuacucucaggugaauccccugacacucacggccgcuguucuucugcuggugacccauuacgccaucauuggcccugggcuccaggcuaaagccacaagagaggcccagaagcgcaccgcggcuggaaucaugaagaaccccacagucgauggcauuaugaccaucgaccuggauccugugaucuaugacagcaaauucgagaagcaacuuggccaggugaugcugcucguucugugugccguccagcugcuccuuaugcggacguccugggcucugugcgaagcccugacacucgccaccgggccgauuaccacacugugggagggaucucccggcaaauuuuggaauaccacaaucgcugugagcauggccaacauuuucagaggguccuaccuugcgggagccggccuggcuuuuagcaucaugaagucuguggggacgggacgccggggcaccggcucccagggggaaacacucggagagaaauggaagaagaaacugaaucaacugagcagaaaggaguucgaucucuauaaaaaguccggcauuaccgaggucgaccggacagaggccaaagaagggcuuaagcgcggagagaccacgcaccaugcuguuucuagaggcagcgccaaacugcagugguuuguggaacggaacauggugaucccugaggggcgcgucaucgaucugggauguggcagaggcgggugguccuacuauugcgcgggacucaagaaggugaccgaaguucggggcuacacaaaagggggacccggccacgaggagccugugcccaugucuaccuauggguggaauauugucaagcugaugagcggaaaagacguguucuaccuuccgccugaaaagugugauacacugcucugcgacaucggcgaguccagccccucucccaccguugaagagucccgcacaauuagagugcugaaaauggucgagccuuggcugcggaacaaucaguucuguaucaaggugcucaaccccuacaugccuaccgugauugaacaccuugagcgccugcagagaaaguauggcgggaugcugguccggaauccgcucagcagaaacucuacgcaugaaauguacuggaucuccaauggaacaggcaacauuguuagcucugugaauauggugagccgccugcuucugaaccgguuuaccaugacccacagacgccccacaaucgagaaagaugucgaccucggggccggaacgcggcaugugaacgcugaaccugagacccccaauauggacguuaucggcgagagaauuaagcgcaucaaagaagaacacuccucuacauggcacuaugaugacgaaaacccuuacaagaccugggccuaucaugggagcuacgaggugaaagcuacaggauccgccagcuccaugauuaauggcgucgugaagcugcugaccaagcccugggauguugugccgauggucacacaaauggcuaugaccgacacgaccccuuucggccagcagcggguguuuaaagaaaagguugauacaagaacaccccgcccuaugcccgggacacggaaagugauggagaucaccgccgaguggcucuggagaacgcugggacgcaacaagaaaccucggcuuugcacaagagaagaguucaccaagaagguccgcacaaaugcggccaugggcgcuguguuuaccgaagagaaccaaugggacucugccagagcugccgucgaagaugaggaguucuggaaacugguggaccgggaacgcgagcuccacaagcuggggaaauguggaagcugcguuuauaauaugaugggcaagagagagaagaaacuuggggaguuuggcaaagccaagggaucccgggcgauuugguacauguggcugggcgcuagauaccucgaguucgaagcccugggguuucugaacgaggaucauugguucucucgggaaaauagcuauuccggaguggagggcgaagggcuccacaagcugggauacauccuucgcgacaucucuaaaauucccggcggggccauguaugcugaugacacggccggcugggacaccagaaucacagaggaugaccugcauaacgaggaaaagauuacccagcagauggauccggagcaccggcagcucgcuaaugccaucuuuaaacugacauaccaaaacaaggucgugaaagugcagcgcccuacccccaagggaacaguuauggacauuaucagcagaaaggaucagcggggcuccggacaggugggaaccuauggccuuaauacguucacaaacauggaagcgcaacugguccgccagauggagggggaaggagugcucagcaaagccgaccuggagaauccccaucugcucgagaagaaaaucacccaguggcuggaaaccaagggcguugagagacuuaaacggauggcuauuucuggggaugacugcguggucaagccuaucgaugaccgcuuugccaacgcucugcucgcccugaacgauaugggcaaggugagaaaagacauuccgcaguggcaacccuccaagggauggcaugauuggcagcaggucccuuucuguagccaccauuuccacgaacuuaucaugaaagacggccggaagcuggugguucccugccgcccucaggacgagcucauugggagagcgcggaucucucaaggagccggcuggucccugaaagaaacagcuugucuggggaaggccuacgcucagauguggagccucauguauuuucaccgcagagaucugcggcuugccucuaaugcuaucugcuccgccgugcccguccauuggauuccuaccagcagaacaacgugguccauccacgcgcaucaccaguggaugaccacagaggacaugcugaccguguggaaccgcguuuggauugaggauaaucccuggauggaagacaagacaccggugaccacgugggaggaugucccuuaccucggaaaacgggaagaccaaugguguggcagccugaucgggcuuaccucuagagccacaugggcucagaacauucugaccgccauccaacaggugcgcagccucauuggcgaugaggaguuccuggacuacaugcccuccaugaagcgguuuagaaaagaagaggaaucugagggagccaucugguga

SEQ ID NO: 20514 - RNA, 9873 nt, Artificial Sequence
  derived and/or modified CDS sequence (opt5) from DENV-3__HM181933__SS-prME
accagccugugccucaugaugaugcugcccgccacccuugcuuuccaccugacgucccgggacggcgaaccucggaugaucguggggaagaacgaacgcggaaaaucucuccuguuuaagaccgccuccggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaaacuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugaccaagaaggaggagcccgugaauauugaagcugagccuccguucggcgaaucuaacaucguuauugggaucggcgacaaagcccucaagauuaauugguauaagaaaggaagcuccaucggcaagauguuugaggccaccgcuagaggggcgagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugcuauuaauuggaagggaaaggaacuuaaaugcggcuccgggaucuucgugaccaacgagguucacacauggacggagcaguacaaguuucaagccgacagccccaaacggcucgcgaccgccauugcuggcgccugggaaaauggaguguguggcaucagaucuacaacccgcauggagaaccugcuguggaagcagauugcuaaugaacucaacuauauccugugggagaauaacaucaaacuuacagucgugguuggggauauuaucggagugcuggaacagggcaagcggacccucacgccucagcccauggagcugaaauacuccuggaagaccugggggaaggccaaaauugucacagccgagacccaaaauagcucuuucaucauugacggaccuaacacacccgaaugcccguccgcuagcagagcguggaacgugugggagguggaagacuauggcuuuggcgucuucaccacaaauaucuggcugaaacuucgcgagguuuacacccaguccugugaucaucggcucaugucugccgcuaucaaagacgaaagagccgugcacgccgauaugggguacuggauugagagccagaagaacggauccuggaaacuggagaaggcuucuuuuaucgaagugaagacgugcacauggccuaaaagccacacccugugguccaauggcguccucgagagcgacaugauuauccccaagucucuggccgggccuauuucccagcauaaccaccgccccggauaucauacccaaacagcgggcccuuggcaccuugggaaacuggaacucgauuucaauuacugcgagggaaccacggugguuaucacagagaacuguggcacccggagacccagccugcgcacaaccacagugucuggcaagcugauccacgaauggugcugucgguccugcacccuuccgccucucagauauaugggggaggacggauguugguacggcauggaaauucggcccaucaaugagaaagaagagaacauggucaagagccuggugucugcugggagcggaaagguugauaauuuuacgaugggcgugcugugccucgccauucuguucgaggaagucaugcgcgggaaauucggaaagaaacauaugaucgccggcgugcuuuuuaccuucguucugcuccuguccggccagauuacauggagagacauggcucacacccugaucaugauugggagcaacgccucugaucggaugggaaugggcgugacauaucuugcgcugaucgcuaccuuuaagauccagcccuuccucgcccugggguuuuuccucagaaaacugacgucccgcgagaaucuucugcucggagucggccuggccauggcuacaacccugcaacuuccugaagacauugagcagauggccaacgggaucgcucugggacucaugacacugaagcucauuacccaguuugaaaccuaccagcuguggacagcccuugugagccugacguguuccaauaccaucuucacacucaccguggcguggcggacagccacccugauucuggcuggcgucucucuucugccgcucugccaaagcuccucuaugagaaagacggauuggcugcccaugacaguugccgcuaugggcgugccuccccucccucuguuuaucuucagccuuaaagacacccccaagcgcagauccuggccucugaacgagggggugauggccgucggacuggugucuauccucgccagcucccugcuucggaaugauguucccauggcuggcccgcugguggccgggggacuccugauugccuguuaugucaucaccggcacaagcgcugaccucaccguggagaaagccgccgacguuacaugggaagaggaagcugagcagacgggggugucucauaaccugaugauuaccgucgaugacgauggaacaaugcgcaucaaggacgaugaaaccgagaacauucuuacagugcugcugaaaaccgcccuccugaucgucuccggcaucuuuccuuacagcauucccgcgacgcuucugguguggcacaccuggcagaagcagacacaaagaucuggcguucucugggacgugccuucucccccggagacccagaaagcugaacuggaggaaggggucuaccggaucaagcagcagggaauuuucggcaagacacaaguggggguuggagugcagaaagagggcgucuuucauaccauguggcacgugacacgcggggccgugcucacgcacaauggaaagagacuggagccuaacugggccagcguuaaaaaggaucuuaucagcuauggcggcggguggcggcugaaugcucaguggcaaaaaggagaagagguccaggugauugccguggaacccggcaagaacccuaagaauuuccagaccaugcccgggaucuuccagacaaccaccggagagauuggcgcgaucgcucuggacuuuaaacccgggacauccggaagcccuaucauuaaccgcgaaggcaaggucgugggccucuacgggaauggaguugugacgaaaaacggcggguaugucuccggaaucgcccaaaccaaugccgagccggauggccccacaccugagcuggaagaggaaauguucaagaaaagaaaccuuaccauuauggaccugcaucccgggagcggcaagacacggaaguaccucccugcuaucgugcgcgaggccauuaaaagacggcugagaacccucauccuggcucccacgcgcguuguggccgcggaaauggaggaggcccuuaagggacugccuauccgguaucagacaaccgcuaccaaaucugaacacacaggcagagagauugucgaucugaugugccaugccaccuuuacaaugcgccuccugagcccggugcggguucccaauuacaaccuugugaucauggacgaagcucacuucaccgauccugccuccauugccgcuagaggguauaucucuacgcgcgucggaaugggcgaggcggccgcuauuuuuaugacagccacacccccugggacagccgaggcuuucccccagagcaaugccccgauccaggacgaggagcgggacaucccugaaagauccuggaacucuggaaaugaguggauuaccgauuuugugggcaagacggugugguucguccccagcaucaaagcggggaacgacauugcuaacugucugcgcaagaauggcaagaaaguuauccaacucucccggaagaccuuugauacagaauaccagaaaaccagacugaacgacugggauuucguggugacaaccgacauuucugagaugggagccaauuuuaaggccgaucgggucaucgacccccgcagaugccugaaaccugugauucucacagauggccccgagcggguuauccuugcugggccuaugccggugaccgccgcgagcgccgcucagcgcagaggacgggucggcagaaacccccagaaggaaaaugaccaauacaucuucacggggcagccucugaacaaugaugaggaccaugcccacuggacagaagcuaagaugcugcucgacaacauuaauacccccgagggaaucauuccugcccuguucgaacccgagcgcgagaaauccgcugccaucgauggcgaauaucggcuuaagggggagagcagaaaaaccuuuguggaacugaugcgccggggcgaccucccgguuuggcuggcgcacaagguggccucugagggaauuaaauacacagauagaaaguggugcuucgacggcgaacgcaacaaucagauccuggaggagaacauggaugucgaaaucuggaccaaagagggggaacggaagaagcucagaccucgcuggcuugacgcuagaacauauuccgauccccuggcccugaaagaguuuaaggacuucgcugccggacggaaaagcauugcccucgaucuggugacggaaaucggccgcgucccuucucaucuugcucacagaacccggaaugcgcuggacaaccucgugaugcugcauacauccgagcacgggggacgcgccuacagacacgcuguugaggaacugcccgagaccauggaaacacuccuucugcugggccucaugauucugcuuaccggcggggccaugcuguuucucaucagcggaaagggcauugggaaaacguccaucggacugaucugugugauugugucuagcggcaugcuguggauggccgaugucccucuccaguggaucgcuuccgccauuguucuugaguucuuuaugauggugcugcugauccccgagccggaaaagcaacggaccccucaggacaaucagcucgcguauguggucauugggauccugacacuugccgcuauuguggccgcuaacgagaugggacugcucgaaaccacaaagagagaucugggcaugagcaaagagcccggcguugugucucccaccuccuaccuggacgucgaccuccauccugccagcgcguggacgcuuuaugccguggcuacaaccgucaucacaccgaugcugcgccacaccaucgaaaauucuaccgccaacgugagccuggcugccauugcuaaccaagccguugugcucauggggcuggauaagggauggcccaucuccaaaauggaccuuggcgucccucugcucgcgcuggggugcuacucucaggugaauccccugacacucacggccgcuguucuucugcuggugacccauuacgccauuaucggaccuggccuccaggcuaaggccacacgggaggcccagaaaagaaccgcggcugggauuaugaagaaccccacagucgauggaaucaugaccaucgaccuggauccugugauuuaugacagcaaguucgagaaacaacuuggccaggugaugcugcucguucugugugccguccagcugcuccuuaugcgcacguccugggcucugugcgaagcccugacacucgccaccggcccgaucaccacacugugggaggggucucccggaaaguuuuggaauaccacaauugcugugagcauggccaacaucuuccggggcuccuaccuugcgggggccggacuggcuuuuagcauuaugaaaucugugggcacggggagacggggaaccggcucccagggcgaaacacucggggagaaguggaaaaagaagcugaaucaacugagccgcaaagaguucgaucucuauaagaaauccggaaucaccgaggucgacagaacagaggccaaggaaggccuuaaacgcggggaaaccacgcaccaugcuguuucucggggaagcgccaagcugcagugguuuguggaaagaaacauggugaucccugagggccgggucauugaucugggguguggacgcggcggcugguccuacuauugcgcggggcucaaaaaggugaccgaaguuagaggauacacaaagggcgggcccggacacgaggagccugugcccaugucuaccuauggcuggaauaucgucaaacugaugagcgggaaggacguguucuaccuuccgccugaaaaaugugauacacugcucugcgacauuggagaguccagccccucucccaccguugaagagucccggacaauccgcgugcugaagauggucgagccuuggcugagaaacaaucaguucuguauuaaagugcucaaccccuacaugccuaccgugaucgaacaccuugagcggcugcagagaaaguauggcggcaugcugguccgcaauccgcucagccggaacucuacgcaugaaauguacuggauuuccaaugggacaggaaacaucguuagcucugugaauauggugagcagacugcuucugaaccgcuuuaccaugacccaccggagacccacaaucgagaaggaugucgaccucggcgccgggacgcgccaugugaacgcugaaccugagacccccaauauggacguuauuggagagcggaucaaaagaauuaaggaagaacacuccucuacauggcacuaugaugacgaaaacccuuacaaaaccugggccuaucauggcagcuacgaggugaaggcuacaggguccgccagcuccaugaucaauggagucgugaaacugcugaccaagcccugggauguugugccgauggucacacaaauggcuaugaccgacacgaccccuuucggccagcagcgcguguuuaaggaaaaaguugauacacggacccccagaccuaugcccggcacacgcaaggugauggagauuaccgccgaguggcucuggcggacgcuggggagaaacaaaaagccucgccuuugcacaagagaagaguucaccaaaaagguccggacaaaugcggccaugggagcuguguuuaccgaagagaaccaaugggacucugcccgcgcugccgucgaagaugaggaguucuggaagcugguggacagagaacgggagcuccacaaacugggcaagugugggagcugcguuuauaauaugaugggaaaaagagaaaagaaacuuggcgaguuugggaaggccaaaggcucccgggcgaucugguacauguggcugggagcucgcuaccucgaguucgaagcccugggcuuucugaacgaggaucauugguucucuagagaaaauagcuauuccgggguggagggagaaggccuccacaagcugggguacauccuucgggacauuucuaagauccccggaggcgccauguaugcugaugacacggccgggugggacacccgcauuacagaggaugaccugcauaacgaggagaagaucacccagcagauggauccggagcacagacagcucgcuaaugccauuuuuaagcugacauaccaaaacaaagucgugaaggugcagcggccuacccccaaaggcacaguuauggacaucaucagccgcaaggaucagagaggauccggccagguggggaccuauggacuuaauacguucacaaacauggaagcgcaacugguccggcagauggagggcgaaggggugcucagcaaggccgaccuggagaauccccaucugcucgagaaaaagauuacccaguggcuggaaaccaaaggaguugagcgccuuaagagaauggcuaucucuggcgaugacugcguggucaaaccuauugaugaccgguuugccaacgcucugcucgcccugaacgauauggggaaggugcgcaaggacaucccgcaguggcaacccuccaaaggcuggcaugauuggcagcaggucccuuucuguagccaccauuuccacgaacuuauuaugaaggacggaagaaaacuggugguucccugccggccucaggacgagcucaucggccgcgcgagaaucucucaaggggccggauggucccugaaggaaacagcuugucugggcaaagccuacgcucagauguggagccucauguauuuucaccggagagaucugcgccuugccucuaaugcuauuugcuccgccgugcccguccauuggaucccuaccagccggacaacgugguccauucacgcgcaucaccaguggaugaccacagaggacaugcugaccguguggaacagaguuuggaucgaggauaaucccuggauggaagacaagacaccggugaccacgugggaggaugucccuuaccucgggaagcgcgaagaccaaugguguggaagccugauuggccuuaccucucgggccacaugggcucagaacauccugaccgccauucaacaggugagaagccucaucggggaugaggaguuccuggacuacaugcccuccaugaaacgcuuucggaaggaagaggaaucugagggcgccaucugguga

SEQ ID NO: 20515 - RNA, 9873 nt, Artificial Sequence
  derived and/or modified CDS sequence (opt5) from DENV-3__JF295012__SS-prME
accucccugugccucaugaugaugcugcccgccacacuugcuuuccaccugacgucccgggacggagaaccucggaugaucguggggaagaacgaacgcggaaagucucuccuguuuaagaccgccagcggcauuaauauguguacccuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaacaaaaaggaacugcucgugacauuuaaaaaugcccaugcuaagaagcaagagguugugguccuggggucccaggaaggagcgaugcacaccgcccugacaggcgcuaccgagauccagaacagcgggggcaccucuauuuucgccggacaccucaaaugucggcugaagauggauaaacuugaacugaagggcauguccuacgccaugugccucaauacauuugugcugaaaaaggagguuagcgagacgcagcaugggaccauccugauuaagguggaauacaaaggagaggacgcucccuguaagaucccuuucuccacagaagauggccaagggaaagcccacaacggacgccuuaucaccgcgaaccccgucgugacaaagaaagaggagcccgugaauauugaagcugagccuccguucggcgaaucuaacaucguuauugggaucggcgacaaggcccucaagauuaauugguauaaaaagggaagcuccaucggcaaaauguuugaggccaccgcuagaggggcccggagaauggcuauccugggagauacggccugggacuucggcagcgucgggggagugcugaacucucucggcaagauggugcaucagauuuuuggguccgcguacacagcccuguucagcggcgucucuuggaucaugaaaauuggaaucggcgugcuucugaccuggauugggcucaauagcaagaacaccuccaugucuuuuagcugcaucguuauuggaaucaucacacuguaucugggcgcugugguccaggccgauauggggugugugauuaauuggaagggaaaagaacuuaagugcggcuccgggaucuucguuaccaacgaggugcacacauggacggagcaguacaaauuucaagcugacagccccaagcgccucgccaccgcgauugccggcgcuugggaaaauggagucuguggcauccggucuacaaccagaauggagaaccugcuguggaaacagauugccaaugaacucaacuauauccugugggagaauaacaucaaacuuacagugguugugggggauauuaucggaguccuggaacagggcaaacgcacccucacgccucagcccauggagcugaaguacuccuggaagaccugggggaaagcuaagauugugacagccgagacccaaaauagcucuuucaucauugacggaccuaacacacccgaaugcccguccgccagccgggcuuggaacgugugggaggucgaagacuauggcuuuggcguuuucaccacaaauaucuggcugaaacuuagagagguguacacccaguccugugaucaucgccucaugucugcggccaucaaggacgaacgggcugugcacgccgauaugggguacuggauugagagccagaaaaacggauccuggaagcuggagaaggccucuuuuaucgaagucaaaacgugcacauggccuaagagccacacccugugguccaauggcgugcucgagagcgacaugauuauccccaaaucucuggcugggccuauuucccagcauaaccacagacccggauaucauacccaaacagccggcccuuggcaccuugggaagcuggaacucgauuucaauuacugcgagggaaccacgguugugaucacagagaacuguggcacccgcggccccagccugcggacaaccacagucucugggaaacugauccacgaauggugcuguagauccugcacccuuccgccucuccgcuauaugggagaggacggcuguugguacgggauggaaauucggcccaucaaugagaaggaagagaacaugguuaagagccuggugucugcgggaagcggcaaaguggauaauuuuacgauggggguccugugccucgcuauucuguucgaggaagugaugagaggaaaguucggcaaaaagcauaugaucgccggcguucuuuuuaccuucgugcugcuccuguccgggcagauuacauggcgggacauggcccacacccugaucaugauuggaagcaacgcuucugaucgcaugggcaugggggucacauaucuugcccugaucgcgaccuuuaaaauccagcccuuccucgcucugggauuuuuccucagaaagcugacgucccgggagaaucuucugcucggcguggggcuggccauggccacaacccugcaacuuccugaagacauugagcagauggcuaacggaaucgcccugggccucaugacacugaagcucauuacccaguuugaaaccuaccagcuguggacagcucuugugagccugacguguuccaauaccaucuucacacucaccgucgccuggagaacagcgacccugauucuggccggcguuucucuucugccgcucugccaaagcuccucuaugcgcaaaacggauuggcugcccaugacaguggcugccaugggggugccuccccucccucuguuuaucuucagccuuaaggacacccccaaacggagauccuggccucugaacgagggagucauggcugugggccugguuucuauccucgccagcucccugcuucgcaaugaugugcccauggccgggccgcuggucgcuggaggccuccugauugcguguuaugugaucaccgggacaagcgccgaccucaccguugagaaggcugccgacgugacaugggaagaggaagccgagcagacgggagucucucauaaccugaugauuaccguggaugacgauggcacaaugagaaucaaagacgaugaaaccgagaacauucuuacaguccugcugaagaccgcucuccugaucguguccggcaucuuuccuuacagcauucccgccacgcuucugguuuggcacaccuggcagaaacagacacaacggucuggggugcucugggacgucccuucucccccggagacccagaaggcggaacuggaggaaggaguguaccgcaucaagcagcagggcauuuucgggaaaacacaaguuggagugggcguccagaaggaggggguguuucauaccauguggcacgugacaagaggagcuguucucacgcacaauggcaaacggcuggagccuaacugggccagcgucaagaaagaucuuaucagcuauggcgggggauggcgccuguccgcccaguggcaaaagggcgaagagguccaggugauugcugucgaacccgggaagaauccuaaaaacuuccagaccaugcccggaaucuuccagacaaccaccggcgagauuggggccaucgcgcuggacuuuaagcccggaacaagcggcuccccuaucauuaauagagaaggcaaagugguugggcucuacggaaacggcguggucacgaagaaugggggauaugugagcggcaucgcucaaaccaacgccgagccggaugggcccacaccugagcuggaagaggaaauguucaaaaagcggaaucuuaccauuauggaccugcaucccggcucuggaaagacacgcaaauaccucccugccaucguuagagaggcuauuaagcggcgccugagaacccucauccuggcccccacgcggguggucgcugccgaaauggaggaggcgcuuaaaggccugccuaucagauaucagacaaccgccaccaagagcgaacacacagggcgcgagauuguggaucugaugugccaugcuaccuuuacaaugcggcuccuguccccgguuagagugcccaacuacaaucuugucaucauggacgaagcccacuucaccgauccugcuucuauugccgcccgcggauauaucagcacgcgggugggcaugggggaggcugcggccauuuuuaugacagcuacacccccuggaacagccgacgccuucccccaguccaacgcuccgauccaggacgaagagagagauaucccugagcgcucuuggaauagcggcaacgaauggauuaccgacuuugccgggaaaacggugugguucguccccuccaucaaggcgggcaaugauauugcuaacugucugcggaagaacggcaagaagguuauccaacucucuagaaaaaccuuugacacagaguaccagaagaccaaacugaaugauugggacuucguggugacaaccgauauuagcgaaaugggcgccaacuuuaaggccgaccgcgucaucgauccccggagaugccugaagccugugauucucacagacgggcccgagcggguuauccuugcuggaccuaugccggugaccgccgcguccgccgcucagcgcagaggccgggucgggcgcaauccccagaaagagaacgaucaauacaucuucacgggacagccucugaauaacgacgaagaccaugcccacuggacagaggcuaagaugcugcucgauaauauuaacacccccgaaggcaucauuccugcccuguucgagcccgaaagagagaaaagcgcugccaucgacggggaguaucggcuuaagggcgaaucuagaaaaaccuuuguggagcugaugcgccggggagaucucccgguuuggcuggcgcacaagguggccuccgaaggcauuaaauacacagacagaaaguggugcuucgauggggagcgcaauaaccagauccuggaagagaauauggacgucgagaucuggaccaaggaaggagagcggaaaaagcucagaccucgcuggcuugaugcucggacauauagcgacccccuggcccugaaagaauuuaaggauuucgcugccggcagaaaaucuauugcccucgaccuggugacggagaucgggcgcgucccuucccaucuugcucacagaacccggaacgcgcuggauaaucucgugaugcugcauacaagcgaacacggaggccgcgccuacagacacgcuguugaggagcugcccgaaaccauggagacacuccuucugcugggccucaugauucugcuuaccgggggagccaugcuguuucucaucuccggcaaggggauuggaaagacgucuaucggccugaucugugugauugugagcuccgggaugcuguggauggccgacgucccucuccaguggaucgcuagcgccauuguucuugaguucuuuaugauggugcugcugauccccgagccggagaaacaacggaccccucaggauaaccagcucgcguauguggucauuggaauccugacacuugccgcuauuguggccgcuaaugaaaugggccugcucgagaccacaaagcgcgaccugggcaugucuaaagaacccgggguugugucccccaccagcuaccuggacgucgaucuccauccugccucugcguggacgcuuuaugccguggcuacaaccgucaucacaccgaugcugagacacaccaucgagaacagcaccgccaaugugucccuggcugccauugcuaaccaagccguugugcucaugggacuggacaagggcuggcccaucucuaaaauggaucuuggggucccucugcucgcgcugggaugcuacagccaggugaacccccugacacucacggccgcuguucuucugcuggugacccauuacgccauuaucggcccugggcuccaggcuaaggccacacgggaagcccagaagagaaccgcggcuggaauuaugaaaaaucccacagucgacggcaucaugaccaucgaucuggacccugugauuuaugauuccaaguucgagaaacaacuuggccaggugaugcugcucguucugugugccguccagcugcuccuuaugcgcacgucuugggcucugugcgaggcccugacacucgccaccgggccgaucaccacacugugggaaggaagccccggcaaguuuuggaacaccacaauugcuguguccauggccaauaucuuccgggggagcuaccuugcgggagccggccuggcuuuuucuauuaugaaauccguggggacgggaagacgcggcaccggcagccagggggagacacucggagaaaaguggaagaaaaagcugaaccaacugucccggaaagaguucgaccucuauaagaaaucuggcaucaccgaagucgauagaacagaggccaaggaggggcuuaaacggggagaaaccacgcaccaugcuguuagccgcggcuccgccaagcugcagugguuuguggagagaaauauggugaucccugaagggcgggucauugaccugggauguggccgcggcggguggucuuacuauugcgcgggacucaagaaagugaccgagguuagaggcuacacaaaaggcgggcccgggcacgaagaaccugugcccaugagcaccuauggguggaacaucgucaaacugauguccggaaaggauguguucuaccuuccgccugagaaaugugacacacugcucugcgauauuggcgaaagcucucccucccccaccguugaggaaagccggacaauccgcgugcugaagauggucgagccuuggcugagaaauaaccaguucuguauuaaggugcucaaucccuacaugccuaccgugaucgagcaccuugaacggcugcagcgcaaauauggcgggaugcuggucagaaacccgcucucuagaaauuccacgcaugagauguacuggauuagcaacggaacaggcaauaucguuucuagcgugaacaugguguccagacugcuucugaaucgcuuuaccaugacccaccggagacccacaaucgaaaaggacgucgaccucggggccggaacgcgccaugugaacgcugagccugaaacccccaacauggauguuauuggcgagcggaucaaaagaauuaaggaggaacacucuagcacauggcacuaugacgaugagaauccuuacaaaaccugggccuaucauggguccuacgaagugaaggcuacaggaagcgccuccucuaugaucaacggcgucgugaagcugcugaccaaacccugggacguugugccgauggucacacaaauggcuaugaccgauacgaccccuuucggccagcagcgcguguuuaaggagaaaguugacacacggacccccagaccuaugcccgggacacgcaaggugauggaaauuaccgccgaguggcucuggcggacgcugggaagaaauaaaaagccucgccuuugcacacgggaggaguucaccaagaaagucagaacaaacgcggccaugggcgcuguguuuaccgaggaaaaucaaugggauagcgcccgcgcugccgucgaggacgaagaguucuggaagcugguggauagagagcgggaacuccacaaacuggggaaguguggauccugcguuuauaacaugaugggcaaacgcgagaagaaacuuggggaauuuggcaaggccaagggaucuagagcgaucugguacauguggcugggcgcucgguaccucgaguucgaggcccugggguuucugaaugaagaccauugguucagcagagagaacuccuauucuggaguggaaggcgaggggcuccacaaacugggauacauccuucgggauauuagcaagauccccggcggggccauguaugcugacgacacggccggcugggauacccgcauuacagaagacgaucugcauaaugaggagaaaaucacccagcagauggacccggaacacagacagcucgcuaacgccauuuuuaagcugacauaccaaaauaaagucgugaaggugcagcggccuacccccaagggaacaguuauggauaucaucucccgcaaagaccagagaggcagcggacaggugggaaccuauggccuuaacacguucacaaauauggaggcgcaacugguccggcagauggaaggggagggagugcucucuaaggccgaucuggaaaacccccaucugcucgagaaaaagauuacccaguggcuggagaccaaaggcguugaacgccuuaagagaauggcuaucuccggggacgauugcguggucaagccuauugacgaucgguuugccaaugcucugcucgcccugaacgacaugggcaaagugcgcaaggauaucccgcaguggcaacccagcaaaggauggcaugacuggcagcaggucccuuucuguucucaccauuuccacgagcuuauuaugaaggacggcagaaaacuggugguucccugccggccucaggaugaacucaucgggcgcgcgagaaucucccaaggagccggcuggagccugaaggagacagcuugucuggggaaggccuacgcucagauguggucucucauguauuuucaccggcgcgaccugagacuugccuccaacgcuauuugcagcgccgugcccguccauuggaucccuaccucccggacaacguggagcauucacgcgcaucaccaguggaugaccacagaagauaugcugaccguguggaauagaguuuggaucgaggacaaccccuggauggaggauaaaacaccggugaccacgugggaagacgucccuuaccucggaaagcgcgaggaucaaugguguggcucucugauugggcuuaccagccgggccacaugggcucagaauauccugaccgccauucaacaggugagaucccucaucggcgacgaagaguuccuggauuacaugcccucuaugaaacgcuuucggaaggaggaagagagcgaaggagccaucugguga

SEQ ID NO: 20516 - RNA, 9873 nt, Artificial Sequence
  derived and/or modified CDS sequence (opt5) from DENV-3__FJ898463__SS-prME
accagccugugccucaugaugauccugcccgccgcucuugccuuccaccugacgucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcacagaaggcgccuggagacagguggaaaaaguugagaccugggcucuccgccaccccggcuucacgauccuggcccuuuuucuggcgcauuacaucgggacaucccucacccagaagguggucauuuucauccugcuuaugcuggugacaccuucuaugaccaugagauguguuggagugggcaaccgggacuuugucgaagggcucagcggagccaccuggguggaugugguccuggagcacggcgggugcguuacaacgauggcuaagaauaaacccacccuggacauugagcuccagaagacagaagccacccagcuggcuacacuucgcaaacuguguaucgagggaaagauuaccaacaucacgacagauuccagaugcccuacccagggcgaagccgugcucccggaggaacaggaccagaauuauguguguaaacacaccuacgucgaucggggcugggggaacggaugcggccuguucgggaagggaagccuugugacaugcgcgaaguuucaaugucuggagcccauugagggcaaaguugugcaguaugaaaaucucaaguacaccgucaucaucacagugcauacgggggaccagcaccagguuggaaacgagacccaaggcgugacagccgaaauuaccccucaggcuucuacaaccgaggccauccugcccgaauauggcacgcuggggcucgagugcuccccucgcaccggacuggacuucaaugagaugauucuucugacaaugaaaaacaaggcuuggaugguccauagacagugguuuuucgaucucccccugccguggaccagcggcgccacaaccgaaacgccuacauggaaucggaaagagcuucuggugaccuuuaagaacgcccacgcuaaaaagcaagaagucgugguucucgggucucaggagggagcgaugcacacagcccugaccggcgcuaccgaaauccaaaauuccgggggcacaagcauuuucgccggacaucugaagugucgccucaaaauggacaagcuggagcuuaaaggcaugucuuacgccaugugcacgaacaccuuugugcugaagaaagaggucuccgaaacacagcacgggaccauccucaucaagguggaguacaagggagaagaugcucccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggcgagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugcuuccagagcguggaacgucugggaaguggaggacuauggcuuuggcguguucaccacgaauaucuggcucaaacugcgcgaagucuacacacagcugugugaccaccggcuuaugagcgccgcuguuaaggaugagagagccgugcacgccgacaugggguacuggauugagucccagaaaaacggaucuuggaagcucgaaaaagcuagccugaucgaggugaagaccugcaccuggccuaagucccauacacuguggucuaauggcguccucgaaagcgauaugauuauccccaaaucccuggccgggccuauuagccagcacaaccaucgccccggauaucacacccaaacggcgggcccuuggcaccuugggaagcuggagcucgacuuuaauuacugcgagggaacaaccgugguuaucacagaaaacuguggcacccggggccccucucugagaacaaccacgguguccgggaaacugauccaugaguggugcugucgcagcugcacccuuccgccucuccgguauaugggagaagauggcuguugguacgggauggagauuagacccaucucugaaaaggaggagaauauggucaaaucccuggugagcgcuggaucuggcaagguugacaacuucacaaugggggugcugugccucgccauucuguuugaagaggucaugcggggaaaguucggcaaaaagcacaugaucgccggcguguucuuuaccuucguucuucugcucagcgggcagauuacauggcgcgauauggcucauacccugaucaugauuggauccaaugccagcgacagaaugggcaugggggugacguaucuggcgcuuaucgcuacauuuaaaauccagcccuuccuggcccucggauuuuuccugcggaagcucaccucuagagaaaaccugcuucugggcgucgggcucgccauggcuacaacccugcaacugccugaggauauugaacagauggccaauggaaucgcucuuggccugauggcccucaaacugauuacccaguuugagacauaccagcucuggacggcgcugaucucccuuaccuguagcaacacaauguucacccugacaguggccuggcgcaccgcuacgcucauucuggccggcgugucccugcuuccggucugccaaucuagcuccaugcggaagacagacuggcugcccauggcuguugccgccaugggggugccuccccucccucuguuuaucuucucucucaaggauacccugaaaagacgcagcuggccccuuaaugagggagugauggcugucggccugguguccauccuggcgucuagccuccugagaaacgacguuccuauggccgggccccuuguggcuggaggccugcucauugccuguuaugucaucaccgggacauccgccgaucugaccguggaaaaggcugccgacauuacaugggaggaagaggcggaacagacgggaguuagccacaaccucaugaucaccguggacgaugacggcacaaugcggauuaaagaugacgagaccgagaauauccugacaguccuucugaagaccgcucugcucaucgugucuggcgucuuuccguacuccauuccugccacgcugcuuguguggcauaccuggcagaaacagacacaacgcagcgggguucugugggaugugcccucuccucccgaaacccagaaggccgagcucgaagagggagucuacagaaucaaacagcagggcauuuucgggaagacacaagugggaguuggcgugcagaaggagggggucuuucacaccauguggcacgugacacggggagcugugcugacguauaacggcaaacgccucgaaccgaauugggccuccguuaagaaagaccugaucagcuacggcgggggauggagacuuucugcgcaguggcaaaagggcgaggaaguccaggugauugcuguggagccugggaaaaaccccaagaauuuccagaccaugccuggaacauuccagaccaccacaggcgaaaucggggccauugcccuggauuuuaagcccggaacguccggcagccccaucaucaaccgggagggcaaagucguggggcuguauggaaauggcguugugaccaagaacgggggauacgucuccggcauugcucaaacaaaugccgagccugacgggccgacccccgaacucgaggaagagauguucaaaaagcgcaaccugacaaucauggaucuucauccuggcagcggaaaaaccagaaaguaucugcccgcuauugugcgggaagccaucaagcgcagacuccggacgcugauucucgcgccuacaagaguuguggccgcugagauggaggaagcccugaaaggccuucccauccgcuaccagaccaccgcuacaaagucugagcacaccgggcgggaaaucgucgaccugaugugccaugccacauuuaccaugagacugcucagcccugugcgcguuccgaauuauaaccugauuaucauggaugaggcccacuucacggaccccgcuuccauugcggcccggggauacaucucuacaagagugggcaugggggaagcugccgccauuuuuaugaccgcuacaccucccggaaccgccgaugcguucccucagagcaaugcucccauccaggacgaggagcgcgacaucccggaacgguccuggaacucuggcaaugaguggauuacggauuuugccgggaaaaccgucugguucgugccuagcaucaaggccggcaacgacauugcuaacugucuucgcaaaaauggaaagaaggugauccaacuguccagaaaaacauuugauaccgaauaccagaagacaaaacucaacgacugggauuucgucguuaccacagacauuucugagaugggcgccaauuuuaaggcggaucgggugaucgaccccagacggugccugaaacccgugauucugaccgaugggccugagcgcgucauccucgccggacccaugccugugacggcugccagcgcugcccagagacggggccgcguugggagaaacucccagaaggaaaaugaccaauauaucuucacaggacagccgcuuaacaaugaugaggaccaugcucacuggaccgaagccaagaugcugcuggacaacauuaauacccccgagggcaucauuccugcccucuucgaacccgagcgggagaaaagcgccgcuaucgauggggaauacagacugaagggcgagucucgcaaaacauuuguggaacuuaugcggagaggagaccugccugucuggcucgcccacaagguggcuuccgagggcauuaaauauaccgaucgcaaguggugcuucgacgggcagcggaacaaucagauccuggaagagaacauggauguugagaucuggacaaaagaaggagagaagaagaaacugagaccccgcuggcucgacgcccggacguacagcgauccgcuugcccugaaggaauuuaaagacuucgcugcgggcagaaagucuauugcccuggaucucgugaccgagaucgggcgcgucccuucccaucuggcucacagaacacggaaugcccuugacaaccuggugaugcuccauaccagcgaacacggaggccgcgccuauagacacgcugucgaggagcugcccgaaacaauggagacccugcuccuucugggccugaugauucuccugacagggggagccaugcuuuuucugaucuccggcaaagggauuggaaagaccucuaucggccucaucugugugauugcgagcuccgggaugcuguggauggccgaaaucccucugcaauggauugcuagcgccaucguucucgaguucuuuaugauggugcuucugauucccgagccugaaaagcagcggacaccccaggauaaucaacuggcuuacguggucaucggcauucucacccuggccgcgaucaucgccgcuaacgagaugggccuucuggaaacaaccaaacgcgaccucggcaugucuaaggagccggggguuguguccccuacgagcuaucuggauguggaccugcaucccgccucugcuuggacacucuacgccgucgcuaccacagugauuacccccaugcuuagacacaccaucgaaaauagcacagccaacguuucccuggcggccauugcuaaccaggccgugguccugaugggacucgacaaaggcuggccuaucucuaagauggaucugggggugccgcuucuggcucucggaugcuacagccaggucaauccccugacgcugaccgccgccgugcuccuucugauuacacauuaugcgaucaucggcccugggcugcaggcuaaagccacccgggaggcucaaaagagaacagccgccggaauuaugaagaaccccaccguugacggcaucaugacgauugaucucgacccugugaucuacgauuccaaauucgagaagcagcugggccaggucaugcuucuggugcucugugcuguucagcugcugcucaugcgcacaucuugggcccuuugcgaagcgcugacccuggccaccgggcccauuacaacccucugggagggaagcccuggcaaauuuuggaauacaacgaucgcuguguccauggccaacaucuuccgggggagcuaucuggcuggagccggccuugcguuuucuauuaugaaguccgucgggaccggaaaaagaggcacaggcagccaaggggaaacccugggagagaaguggaagaaaaagcucaaucagcugucccgcaaagaguucgaccuguacaagaaaucuggcaucacagagguggaucggaccgaggccaaggaagggcucaaaagaggagagacgacccaccaugcugugagccggggcuccgccaaacuucagugguuuguugaacgcaacauggucauuccggaggggagagugaucgaccugggauguggccggggcggguggucuuauuacugcgcuggacugaagaaagugacagaaguccgcggcuauaccaaagggggacccggccacgaggagccuguucccaugagcacauacggguggaauauugugaaacucauguccggaaaggauguguucuaccugccucccgaaaaaugugacacccuucugugcgauaucggcgagagcucuccguccccuacagucgaagagagcagaaccauucgggugcucaagaugguugagcccuggcugaagaacaaucaguucuguaucaaagugcugaaccccuauaugccuacggucaucgaacaccucgagcgccuucaaagaaagcauggcgggaugcuggugcggaauccccugucucgcaacuccacacacgaaauguacuggauuagcaauggaaccggcaacaucguugccucugugaauauggucagcagacuccugcuuaaccgguuuaccaugacacauagacgcccuacgauugagaaagacguggaucugggggcuggaacccggcacgugaacgccgaaccggagacacccaauauggacgucaucggcgagagaauuaagcgcaucaaagaagaacacaacuccaccuggcauuaugacgaugaaaauccuuacaagacaugggcguaucacgggucuuacgagguuaaggccaccggaagcgcuuccagcaugaucaacggcguggugaaacuccugacaaagcccugggacgucgugccuaugguuacccagauggccaugacggauaccacacccuucggccagcaacggguguuuaaagaaaaggucgacaccagaacaccgcgcuccaugccugggacccggagagugaugggaauuacggcugaguggcuguggacaacccucggccgcaauaaaaagccccggcugugcacaagagaggaguucaccaagaaaguucgcacgaacgccgccaugggggcgguguuuaccgaggaaaaucagugggauucugcuaaggccgccgucgaggacgaagauuucuggaaacuuguggaccgggagagagagcugcauaagcucggaaaauguggcagcugcguuuauaacaugauggggaagcgcgagaagaagcugggcgaguuuggaaaggcuaaaggcuccagagccaucugguacauguggcuuggggcucgguaccuggaguucgaggcccucggauuucugaaugaggaucacugguucucucgcgaaaacagcuauuccggcguggagggggaaggacugcauaagcucggcuacauucugagagacaucucuaaaauuccugggggcgcgauguaugccgaugacacagcuggaugggacacccggaucacagaggaugaccuucacaaugaagagaagaucacccagcagauggaucccgagcacagacaacuggccaacgcuauuuuuaaacucacauaccagaauaaggucgugaagguccagcggccuacccccacgggcacagugauggacaucauuagccgcaaagaucagagaggguccggacaaguuggcaccuaugggcugaacaccuucacaaauauggaagcccagcuuauccggcagauggagggagaaggcgugcugagcaaggcggaccucgagaacccgcaucugccugagaagaagauuacccaguggcuggagacaaaaggggucgagcgccucaagagaauggccaucucuggcgaugacugcguggugaagcccaucgaugaccgguuugcuaacgcccugcuugcucugaaugauaugggaaaaguucgcaaggacauuccccaauggcagccuuccaaaggcuggcacgauuggcaacaggugccguucuguagccaucacuuccacgaacucaucaugaaggacgggagaaaacuggucgugcccugccggccucaagacgagcuuauuggacgcgccagaaucucucagggcgcuggguggucccugcgggaaacggccugucucggaaaggcguacgcccagauguggagccugauguauuuucaucgcagagaucugcggcucgcuucuaacgccauuugcuccgccguucccgugcacugggucccuaccagccgcacaaccugguccauccaugcucaccaucaauggaugacaaccgaggacaugcugacgguguggaauagagucuggauugaagauaaccccuggauggaggacaagaccccugugacaaccugggagaauguucccuaccuuggcaaacgggaagaucaguggugugggagccugaucggccucacaucuagagccaccugggcgcagaacaucccgacggcuauucagcaagugcgcagccugaucggaaaugaggaguuccuugacuacaugccuuccaugaagcgguuuagaaaagaggaggaaucugagggcgccauuugguga

SEQ ID NO: 20517 - RNA, 9873 nt, Artificial Sequence
  derived and/or modified CDS sequence (opt5) from DENV-3__GQ868616__SS-prME
accagccugugccucaugaugauccugcccgccgcucuugccuuccaccugacgucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcacagaaggcgccuggagacagguggaaaaaguugagaccugggcucuccgccaccccggcuucacgauccuggcccuuuuucuggcgcauuacaucgggacaucccucacccagaagguggucauuuucauccugcuuaugcuggugacaccuucuaugaccaugagauguguuggagugggcaaccgggacuuugucgaagggcucagcggagccaccuggguggaugugguccuggagcacggcgggugcguuacaacgauggcuaagaauaaacccacccuggacauugagcuccagaagacagaagccacccagcuggcuacacuucgcaaacuguguaucgagggaaagauuaccaacaucacgacagauuccagaugcccuacccagggcgaagccgugcucccggaggaacaggaccagaauuauguguguaaacacaccuacgucgaucggggcugggggaacggaugcggccuguucgggaagggaagccuugugacaugcgcgaaguuucaaugucuggagcccauugagggcaaaguugugcaguaugaaaaucucaaguacaccgucaucaucacagugcauacgggggaccagcaccagguuggaaacgagacccaaggcgugacagccgaaauuaccccucaggcuucuacaaccgaggccauccugcccgaauauggcacgcuggggcucgagugcuccccucgcaccggacuggacuucaaugagaugauucuucugacaaugaaaaacaaggcuuggaugguccauagacagugguuuuucgaucucccccugccguggaccagcggcgccacaaccgaaacgccuacauggaaucggaaagagcuucuggugaccuuuaagaacgcccacgcuaaaaagcaagaagucgugguucucgggucucaggagggagcgaugcacacagcccugaccggcgcuaccgaaauccaaaauuccgggggcacaagcauuuucgccggacaucugaagugucgccucaaaauggacaagcuggagcuuaaaggcaugucuuacgccaugugcacgaacaccuuugugcugaagaaagaggucuccgaaacacagcacgggaccauccucaucaagguggaguacaagggagaagaugcucccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggcgagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugcuuccagagcguggaacgucugggaaguggaggacuauggcuuuggcguguucaccacgaauaucuggcucaaacugcgcgaagucuacacacagcugugugaccaccggcuuaugagcgccgcuguuaaggaugagagagccgugcacgccgacaugggguacuggauugagucccagaaaaacggaucuuggaagcucgaaaaagcuagccugaucgaggugaagaccugcaccuggccuaagucccauacacuguggucuaauggcguccucgaaagcgauaugauuauccccaaaucccuggccgggccuauuagccagcacaaccaucgccccggauaucacacccaaacggcgggcccuuggcaccuugggaagcuggagcucgacuuuaauuacugcgagggaacaaccgugguuaucacagaaaacuguggcacccggggccccucucugagaacaaccacgguguccgggaaacugauccaugaguggugcugucgcagcugcacccuuccgccucuccgguauaugggagaagauggcuguugguacgggauggagauuagacccaucucugaaaaggaggagaauauggucaaaucccuggugagcgcuggaucuggcaagguugacaacuucacaaugggggugcugugccucgccauucuguuugaagaggucaugcggggaaaguucggcaaaaagcacaugaucgccggcguguucuuuaccuucguucuucugcucagcgggcagauuacauggcgcgauauggcucauacccugaucaugauuggauccaaugccagcgacagaaugggcaugggggugacguaucuggcgcuuaucgcuacauuuaaaauccagcccuuccuggcccucggauuuuuccugcggaagcucaccucuagagaaaaccugcuucugggcgucgggcucgccauggcuacaacccugcaacugccugaggauauugaacagauggccaauggaaucgcucuuggccugauggcccucaaacugauuacccaguuugagacauaccagcucuggacggcgcugaucucccuuaccuguagcaacacaauguucacccugacaguggccuggcgcaccgcuacgcucauucuggccggcgugucccugcuuccggucugccaaucuagcuccaugcggaagacagacuggcugcccauggcuguugccgccaugggggugccuccccucccucuguuuaucuucucucucaaggauacccugaaaagacgcagcuggccccuuaaugagggagugauggcugucggccugguguccauccuggcgucuagccuccugagaaacgacguuccuauggccgggccccuuguggcuggaggccugcucauugccuguuaugucaucaccgggacauccgccgaucugaccguggaaaaggcugccgacauuacaugggaggaagaggcggaacagacgggaguuagccacaaccucaugaucaccguggacgaugacggcacaaugcggauuaaagaugacgagaccgagaauauccugacaguccuucugaagaccgcucugcucaucgugucuggcgucuuuccguacuccauuccugccacgcugcuuguguggcauaccuggcagaaacagacacaacgcagcgggguucugugggaugugcccucuccucccgaaacccagaaggccgagcucgaagagggagucuacagaaucaaacagcagggcauuuucgggaagacacaagugggaguuggcgugcagaaggagggggucuuucacaccauguggcacgugacacggggagcugugcugacguauaacggcaaacgccucgaaccgaauugggccuccguuaagaaagaccugaucagcuacggcgggggauggagacuuucugcgcaguggcaaaagggcgaggaaguccaggugauugcuguggagccugggaaaaaccccaagaauuuccagaccaugccuggaacauuccagaccaccacaggcgaaaucggggccauugcccuggauuuuaagcccggaacguccggcagccccaucaucaaccgggagggcaaagucguggggcuguauggaaauggcguugugaccaagaacgggggauacgucuccggcauugcucaaacaaaugccgagccugacgggccgacccccgaacucgaggaagagauguucaaaaagcgcaaccugacaaucauggaucuucauccuggcagcggaaaaaccagaaaguaucugcccgcuauugugcgggaagccaucaagcgcagacuccggacgcugauucucgcgccuacaagaguuguggccgcugagauggaggaagcccugaaaggccuucccauccgcuaccagaccaccgcuacaaagucugagcacaccgggcgggaaaucgucgaccugaugugccaugccacauuuaccaugagacugcucagcccugugcgcguuccgaauuauaaccugauuaucauggaugaggcccacuucacggaccccgcuuccauugcggcccggggauacaucucuacaagagugggcaugggggaagcugccgccauuuuuaugaccgcuacaccucccggaaccgccgaugcguucccucagagcaaugcucccauccaggacgaggagcgcgacaucccggaacgguccuggaacucuggcaaugaguggauuacggauuuugccgggaaaaccgucugguucgugccuagcaucaaggccggcaacgacauugcuaacugucuucgcaaaaauggaaagaaggugauccaacuguccagaaaaacauuugauaccgaauaccagaagacaaaacucaacgacugggauuucgucguuaccacagacauuucugagaugggcgccaauuuuaaggcggaucgggugaucgaccccagacggugccugaaacccgugauucugaccgaugggccugagcgcgucauccucgccggacccaugccugugacggcugccagcgcugcccagagacggggccgcguugggagaaacucccagaaggaaaaugaccaauauaucuucacaggacagccgcuuaacaaugaugaggaccaugcucacuggaccgaagccaagaugcugcuggacaacauuaauacccccgagggcaucauuccugcccucuucgaacccgagcgggagaaaagcgccgcuaucgauggggaauacagacugaagggcgagucucgcaaaacauuuguggaacuuaugcggagaggagaccugccugucuggcucgcccacaagguggcuuccgagggcauuaaauauaccgaucgcaaguggugcuucgacgggcagcggaacaaucagauccuggaagagaacauggauguugagaucuggacaaaagaaggagagaagaagaaacugagaccccgcuggcucgacgcccggacguacagcgauccgcuugcccugaaggaauuuaaagacuucgcugcgggcagaaagucuauugcccuggaucucgugaccgagaucgggcgcgucccuucccaucuggcucacagaacacggaaugcccuugacaaccuggugaugcuccauaccagcgaacacggaggccgcgccuauagacacgcugucgaggagcugcccgaaacaauggagacccugcuccuucugggccugaugauucuccugacagggggagccaugcuuuuucugaucuccggcaaagggauuggaaagaccucuaucggccucaucugugugauugcgagcuccgggaugcuguggauggccgaaaucccucugcaauggauugcuagcgccaucguucucgaguucuuuaugauggugcuucugauucccgagccugaaaagcagcggacaccccaggauaaucaacuggcuuacguggucaucggcauucucacccuggccgcgaucaucgccgcuaacgagaugggccuucuggaaacaaccaaacgcgaccucggcaugucuaaggagccggggguuguguccccuacgagcuaucuggauguggaccugcaucccgccucugcuuggacacucuacgccgucgcuaccacagugauuacccccaugcuuagacacaccaucgaaaauagcacagccaacguuucccuggcggccauugcuaaccaggccgugguccugaugggacucgacaaaggcuggccuaucucuaagauggaucugggggugccgcuucuggcucucggaugcuacagccaggucaauccccugacgcugaccgccgccgugcuccuucugauuacacauuaugcgaucaucggcccugggcugcaggcuaaagccacccgggaggcucaaaagagaacagccgccggaauuaugaagaaccccaccguugacggcaucaugacgauugcucucgauccugugaucuacgacuccaaauucgagaagcagcugggccaggucaugcuucuggugcucugugccguucagcugcugcucaugcgcacaucuugggcgcuuugcgaagcccugacccuggcuaccgggcccauuacaacccucugggagggaagcccuggcaaauuuuggaauacaacgaucgccguguccauggcuaacaucuuccgggggagcuaucuggccggagcgggccuugccuuuucuauuaugaaguccgucgggaccggaaaaagaggcacaggcagccaaggggaaacccugggagagaaguggaagaaaaagcucaaucagcugucccgcaaagaguucgaucuguacaagaaaucuggcaucacagagguggaccggaccgaggcuaaggaagggcucaaaagaggagagacgacccaccaugccgugagccggggcuccgcuaaacuucagugguuuguugaacgcaacauggucauuccggaggggagagugaucgaucugggauguggccggggcggguggucuuauuacugcgccggacugaagaaagugacagaaguccgcggcuauaccaaagggggacccggccacgaggagccuguucccaugagcacauacggguggaauauugugaaacucauguccggaaaggacguguucuaccugccucccgaaaaaugugauacccuucugugcgacaucggcgagagcucuccguccccuacagucgaagagagcagaaccauucgggugcucaagaugguugagcccuggcugaagaacaaucaguucuguaucaaagugcugaaccccuauaugccuacggucaucgaacaccucgagcgccuucaaagaaagcauggcgggaugcuggugcggaauccccugucucgcaacuccacacacgaaauguacuggauuagcaauggaaccggcaacaucguugcuucugugaauauggucagcagacuccugcuuaaccgguuuaccaugacacauagacgcccuacgauugagaaagauguggaccugggggccggaacccggcacgugaacgcggaaccggagacacccaauauggaugucaucggcgagagaauuaagcgcaucaaagaagaacacaacuccaccuggcauuaugacgacgaaaauccuuacaagacaugggccuaucacgggucuuacgagguuaaggcuaccggaagcgccuccagcaugaucaacggcguggugaaacuccugacaaagcccugggaugucgugccuaugguuacccagauggcuaugacggacaccacacccuucggccagcaacggguguuuaaagaaaaggucgauaccagaacaccgcgcuccaugccugggacccggagagugaugggaauuacgcccgaguggcuguggcgcccucucggccggaauaaaaagcccagacugugcccucgcgaggaguucacaaagaaaguucggaccaacgcccccaugggggccguguuuacagaggaaacccagugggcgucugcuaaggccgccgucgaggacgaagauuucuggaaacuuguggacagagagcgcgagcugcauaagcucggaaaauguggcagcugcguuuauaauaugauggggaagagagagaagaagcugggcgaguuuggaaaggcuaaaggcucccgggccaucugguacauguggcuuggggcucgcuaccuggaguucgaggcccucggauuucugaacgaggaucacugguucucuagagaaaauagcuauuccggcguggagggggaaggacugccgaagcucggcuacauucugcgggacaucucuaaaauuccugggggcgcgauguaugccgaugacacggcuggaugggauaccagaaucacagaggacgaccuucauaacgaagagaagaucacccagcagauggaucccgagcaccggcaacuggccaaugcuauuuuuaaacucacauaccagaacaaggucgugaagguccagcgccccaccccuacaggcaccgugauggacaucauuagcagaaaagaucagcggggguccggacaaguuggcacguaugggcugaauacauucaccaacauggaagcccagcuuauccgccagauggagggagaaggcgugcugagcaaggcggaccucgagaauccgcaucugcccgagaagaagauuacccaguggcuggagacaaaaggggucgagagacucaagcggauggccaucucuggcgaugacugcguggugaagccuaucgaugaccgcuuugcuaacgcccugcuugcucugaacgauaugggaaaaguuagaaaggacauuccccaauggcagccuuccaaaggcuggcaugauuggcaacaggugcccuucuguagccaccauuuccacgaacucaucaugaaggacgggcggaaacuggucgugccuugccgcccccaagaugagcuuauuggacgggcccggaucucucagggcgcuggguggucccugcgcgaaaccgccugucucggaaaggcguacgcccagauguggagccugauguauuuucacagacgggaccugcgccucgcuucuaaugccauuugcuccgccguuccggugcauugggucccuacaagcagaacgaccugguccauccacgcucaucaccaauggaugacaaccgaggacaugcugacaguguggaaccgggucuggauugaagauaaucccuggauggaggacaagaccccugugacgaccugggagaacguucccuaccuuggcaaaagagaagaucaguggugugggagccugaucggccucacaucucgcgccaccugggcgcagaauaucccgacagcuauucagcaagugcggagccugaucggaaacgaggaguuccuugacuacaugccuuccaugaagagauuucgcaaagaggaggaaucugagggcgccauuugguga

SEQ ID NO: 20518 - RNA, 9873 nt, Artificial Sequence
  derived and/or modified CDS sequence (opt5) from DENV-3__GQ199887__SS-prME
accucccugugccucaugaugauccugcccgcugcucuugccuuccaccugacgucccgggacggcgagccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagucuauugagggcaaaguugugcaguaugaaaaucucaaguacacagucaucaucaccgugcauacaggggaccagcaccagguuggaaacgagacgcaaggcgugaccgcugaaauuacaccccaggccuccaccacagaggcuauccugccugaauauggcacccuggggcucgagugcagcccccgcacgggacuggacuucaaugagaugauucuucugaccaugaaaaacaaggccuggaugguccauagacagugguuuuucgaucucccucugcccuggacaucuggcgccaccacagaaaccccgacguggaaucggaaagagcuucuggugacauuuaagaacgcucacgcgaaaaagcaagaagucgugguucucgggucccaggagggagccaugcacaccgcucugacaggcgccaccgaaauccagaauagcgggggcaccucuauuuucgccggacaucugaagugucgccucaaaauggacaagcuggagcuuaaaggcauguccuacgcuaugugcacaaacacguuugugcugaagaaagaggucagcgaaacccagcacgggacaauccucgugaagguugaguacaagggagaagaugccccuuguaaaauccccuucuccaccgaggacggccaagggaaggcgcauaacggaagacugauuacagcuaauccuguggucaccaaaaaggaggaacccgugaacaucgaggccgaacccccuuucggcgagucuaauauugugaucgggauuggcgauaacgcccugaaaaucaauugguauaagaagggaagcuccaucggcaaaauguuugaagcuacggccagaggggcuagacgcauggccauucuuggagacacagcgugggauuucggcagcguugggggaguccucaacucucugggcaagauggugcaccagaucuuuggguccgccuacaccgcucuguucagcggcgugucuugggucaugaaaauuggaaucggcgugcuccugaccuggauugggcuuaauagcaagaacacauccaugucuuuuagcugcaucgccauuggaaucaucacccuguaucucggcgcuguugugcaggccgacauggggugugucauuaauuggaaaggaaaggagcugaagugcggcuccgggaucuucgugacaaacgagguucauacguggaccgaacaguacaaauuucaagcggauagcccgaagcggcuggccacagcuauugccggcgcuugggagaauggaguguguggcaucagaucuaccacacgcauggaaaaccuucucuggaaacagauugccaaugagcugaacuauauccugugggaaaauaacaucaagcucaccgucgugguuggggacacgauuggagugcuggagcagggcaaacggacccuuacaccccagccuauggagcugaaguacuccuggaaaaccugggggaaggccaagaucgucacagcugaaauucaaaacagcucuuucaucauugauggacccaauaccccugagugccccuccgcgagcagagccuggaacgugugggaaguggaggacuauggcuuuggcgucuucacaaccaauaucuggcucaaacugcgcgaaguuuacacgcagcugugugaccaccggcuuauguccgcugccgugaaggaugagagagccgugcacgcugacaugggguacuggaucgagucucagaaaaacggaagcuggaagcucgaaaaagccuccuuuauugaggucaagacaugcaccuggccgaagucucauacccuguggagcaauggcgugcuggaauccgauaugaucauuccuaaaagccucgcggggcccaucucucagcacaacuaucgcccuggauaccauacacaaaccgcuggccccuggcaccuggggaaacuugagcuggacuucaauuauugcgagggaacgacaguugugauuaccgaaaacuguggcacacggggcccuucccucagaaccacaaccgucagcgggaaacugauccacgaguggugcugucgcucuugcacgcugcccccgcuucgguacaugggagaagauggcuguugguaugggauggagaucagaccuauuuccgaaaaggaggagaauauggugaaaagccucgccucugccggaagcggcaagguugacaacuuuaccaugggggugcugugccuggcuauccucuucgaagaggucaugcggggaaaguucggcaaaaagcauaugauugccggcguguuuuucacauuuguucugcuucuguccgggcagaucaccuggcgcgauauggcgcacacacucauuaugaucggaagcaaugcuucugacagaaugggcaugggggugaccuaccuggcccugauugccacguucaaaauccagcccuuucuugcucugggauucuuucuccggaagcugacauccagagaaaaccuccugcuuggcgucgggcuggccauggcuaccacacuccaacugcccgaggauaucgaacagauggccaauggaauugcgcugggccuuauggcccugaaacucaucacccaguucgagaccuaucagcuguggacagcucucgugagccugacguguuccaacaccauguuuacacuuaccguggccuggcgcacagcuacccugauucucgccggcgucucucugcugccuguuugccaaagcuccucuaugcggaagacggacuggcuuccgaugacaguggccgcuaugggggugcccccucugccccucuucaucuuuagccugaaggauacccucaaaagacgcuccuggccucugaaugagggagucauggcggugggccuuguuucuauucuggccagcucccugcucagaaacgacgugcccauggcugggccucuggucgccggaggccuucugaucgccuguuacgugaucaccgggacaagcgcugaucucaccguugaaaaggccgcggacgugacaugggaggaagaggcugaacagacgggagucucucauaaccugaugauuaccguggacgaugacggcacaaugcggaucaaagaugacgagaccgagaauauucucacaguccugcuuaagaccgcccugcugaucguguccggcauuuuccccuacagcaucccggccacgcuccugguuuggcacaccuggcagaaacagacacaacgcucuggggugcuuugggaugucccuucucccccugaaacccagaaggcugagcuggaagagggaguguauagaaucaaacagcagggcauucucgggaagacacaaguuggagugggcguccagaaggaggggguguuucauaccauguggcacgugacacggggagccguucugacgcacaacggcaaacgccucgaacccaauugggcgagcgucaagaaagaccugaucagcuacggcgggggauggagacuuuccgcucaguggcaaaagggcgaggaaguccaggugauugccgucgagccggggaaaaacccuaagaauuuccagaccaugcccggaacauuccagaccaccacaggcgaaaucggggccauugcucuggauuuuaagccuggaacgagcggcucccccaucauuaaccgggagggcaaagugguugggcuguauggaaauggcguggucaccaagaacgggggauacgugagcggcaucgcccaaacaaaugcugagcccgacgggccuaccccggaacucgaggaagagauguuccgcaaaagaaaccugacaaucauggaucuucaucccggcucuggaaagacccggaaauaucugccugccauuguucgcgaagcgaucaagagacggcucagaacgcugauucucgcccccacacgcguggucgcugccgagauggaggaagcucugaagggccuuccuauccgguaccagaccaccgccacaaaaagcgagcacaccgggagagaaauuguggaccugaugugccaugccacauuuaccaugcgccugcucucccccguucgggugccuaauuauaaccugaucaucauggaugaggcucacuucacggacccggcgucuauugccgcuagaggauacaucagcacacgcgucggcaugggggaagccgccgcuauuuuuaugaccgccacacccccuggaaccgcggaugcuuucccccaguccaaugccccuauccaggacgaggagcgggacauucccgaaagaucuuggaacagcggcaaugaguggaucacggauuuugccgggaagaccgugugguucgugccguccaucaaagcuggcaacgacauugccaacugucuucgcaagaauggcaaaaaggucauccaacugucucggaagacauuugauaccgaauaccagaaaacaaagcucaacgacugggauuucguugugaccacagacauuagcgagaugggagcgaauuuuaaagccgauagagugaucgacccucggcgcugccugaagcccgucauucugaccgaugggcccgagagagugauccucgcuggaccuaugcccguuacggccgcuuccgccgcucagcggcgcggcagaguggggcggaacccucagaaagaaaaugaccaauauauuuucacaggacagccgcuuaacaaugaugaggaccaugcccacuggaccgaagcgaagaugcugcuggacaacaucaauacccccgagggcaucauuccugcccucuucgaacccgagagagaaaagagcgcugccaucgauggggaauaccgccugaaaggcgagucucggaagacauuugucgaacuuaugagacgcggagaccugccuguguggcucgcucacaaaguugccuccgagggcauuaaguauaccgaucggaaauggugcuucgacgggcagagaaacaaucagauccuggaagagaacauggauguggagauuuggacaaaggaaggagagaaaaagaagcugcgcccccgguggcucgacgccagaacguacagcgauccgcuugcucugaaagaauuuaaggacuucgcggccggccgcaaaucuaucgcucuggaucucgucaccgagaucgggagagugccuucccaucuggcccaccggacacgcaaugcccuugacaaccuggucaugcuccauaccagcgaacacggaggcagagcuuaucggcacgccguggaggagcugcccgaaacaauggagacccugcuccuucugggccugaugauucuccugacagggggaguuaugcuuuuucugaucuccggcaaggggauuggaaaaaccucuaucggccucauuugugugaucgcgagcuccgggaugcuguggauggccgaugugccucugcaauggaucgcuagcgccauuguccucgaguucuuuaugaugguucuucugauccccgagccugagaagcagcgcacaccccaggacaaucaacuggcuuacguggugauuggaauccucacccuggccgcgauuaucgccgcuaacgaaaugggccuucuggagacaaccaagagagaucucggcaugucuaaagaaccgggggucguguccccuacgagcuaucuggacguugaccugcaucccgccucugcuuggacacucuacgccguggcuaccacagucauuacccccaugcuucggcacaccaucgagaauagcacagccaacgugucccuggcggccaucgcuaaccaggccgucgugcugaugggacucgauaagggcuggccuauuucuaaaauggaccuggggguuccgcuucuggcucucggaugcuacagccaggugaauccccugacgcugaccgccgccguccuccuucugaucacacauuaugcgauuaucggcccugggcugcaggcuaaggccaccagagaagcucaaaaacgcacagccgccggaauuaugaagaaccccaccguggauggcaucaugacgaucgaccucgauccuguuauuuacgacuccaaguucgagaaacagcugggccaggugaugcuucugguccucugugcugugcagcugcugcucaugcggacaucuugggcccuuugcgaggcgcugacccuggccaccgggcccaucacaacccucugggaaggaagcccuggcaaguuuuggaauacaacgauugcuguguccauggccaacaucuucagagggagcuaucuggcuggagccggccuugcguuuucuauuaugaaauccguugggaccggaaagcgcggcacaggcagccaaggggagacccugggagaaaaauggaagaagaaacucaaucagcugucccggaaggaguucgaucuguacaaaaagucuggcaucacagaagucgacagaaccgaggccaaagaggggcucaagcggggagaaacgacccaccaugcugugagccgcggcuccgccaaacuucagugguuuguggagagaaacauggucaucccggaagggcggguuauugaucugggauguggccgcggcggguggucuuauuacugcgcuggacugaagaaggugacagaggugagaggcuauaccaaagggggacccggccacgaagaaccuguccccaugagcacauacggguggaauaucgugaagcucauguccggaaaagacguuuucuaccugccucccgagaagugugauacccuucugugcgacauuggcgaaagcucuccguccccuacaguggaggaaagccggaccauccgcguccucaaaaugguggagcccuggcugaagaacaaucaguucuguauuaagguucugaaccccuauaugccuacggugaucgagcaccucgaaagacuucaacggaaacauggcgggaugcugguccgcaauccccugucuagaaacuccacacacgagauguacuggauuagcaauggaaccggcaacaucgugucuagcgugaauauggucucccggcuccugcuuaacagauuuaccaugacacaucgccggccuacgaucgaaagagauguugaccugggggccggaacccgccacgugaacgcugagccggaaauucccaauauggacgugaucggcgagcggauuaagagaaucaaagaggaacacaacucuacauggcauuaugaugacgagaauccuuacaagaccugggccuaucacgggagcuacgaagucaaagcgacaggauccgccagcuccaugauuaacggcgugguuaagcuccugaccaagcccugggauguggucccuauggugacacagauggcuaugaccgacacgacccccuucggccagcaacgcguuuuuaaagagaagguggauacacggaccccgagaccuaugcccgggacacgcaaagucauggaaaucaccgccgaguggcuguggcggacgcucggaagaaauaagcgcccucggcugugcacaagagaggaguucaccaaaaaggugcgcacaaacgcugccaugggcgccguuuuuaccgaggaaaaucagugggacucugcgaaggcugccguggaggaugaagaguucuggaaacuugucgacagagagcgggaacugcauaagcucgggaaauguggaagcugcguguauaacaugaugggcaagcgcgagaaaaagcugggggaauuuggcaaagccaagggauccagagcuaucugguacauguggcuuggcgcccgguaccuggaguucgaggcucucggguuucugaaugaagaucacugguucucuagagagaacagcuauuccggagucgaaggcgaggggcugcauaagcucggauacauucugcgggacaucucuaaaauucccggcggggccauguaugcggaugacacggccggcugggacacccgcaucacagaagaugaccuucacaaugaggagaagauuacccagcagauggauccugaacacagacaacuggcuaacgccaucuuuaaacucacauaccagaauaaggugguuaaagugcagcggcccaccccgacaggaaccgucauggacaucauuagccgcaaggaucagagaggcuccgggcaagugggaacguauggccugaacacauucaccaauauggaggcucagcuugugcggcagauggaaggggagggaguucugagcaaggccgaccucgaaaacccucaucugcuggagaaaaagaucacccaguggcucgagacaaaaggcguggaacgccugaagagaauggcgauuucuggggaugacugcgucgugaaacccaucgaugaccgguuugccaacgcccuucuggcccucaaugauaugggcaagguucgcaaggacauuccccaauggcagccuuccaaaggauggcacgauuggcaacaggugccguucuguagccaucacuuccacgagcugaucaugaaggacggcagaaaacuugucgugcccugccggccucaagacgaacugaucgggcgcgcuagaauuucucagggagccggcuggucccuccgggagaccgcuugucuggggaaggccuacgcgcagauguggagccugauguauuuucaucgcagagaucuccggcuggccucuaacgcuaucugcuccgccguccccgugcacuggguuccuacaagcagaacgaccugguccauucaugcccaccaucaauggaugacaaccgaagacaugcuuacaguguggaaucgcgucuggaucgaggauaaccccuggauggaggacaaaaccccugugacgaccugggaaaauguucccuaccugggaaagcgggaggaucagugguguggcagccucauugggcugacaucuagagcuaccugggcccagaacaucccgacagcgauucagcaagugcgcagccuuaucggcaaugaagaguuccuggacuacaugccuuccaugaagcgguuuagaaaagaggaagagucugaaggagcuaucugguga

SEQ ID NO: 20519 - RNA, 9873 nt, Artificial Sequence
  derived and/or modified CDS sequence (opt5) from DENV-3__GQ199888__SS-prME
accucccugugccucaugaugauccugcccgccgcucuugccuuccaccugaccucccgggacggagagccucggaugauuguggggaagaacgaacgcggaaaaucucuccuguuuaagacggcgagcggcaucaauauguguacccuuauugcuauggaucugggggagaugugcgacgauaccgugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagucuauugagggcaaaguugugcaguaugaaaaucucaaguacacagucaucaucaccgugcauacaggggaccagcaccagguuggaaacgagacgcaaggcgugaccgcugaaauuacaccccaggccuccaccacagaggcuauccugccugaauauggcacccuggggcucgagugcagcccccgcacgggacuggacuucaaugagaugauucuucugaccaugaaaaacaaggccuggaugguccauagacagugguuuuucgaucucccucugcccuggacaucuggcgccaccacagaaaccccgacguggaaucggaaagagcuucuggugacauuuaagaacgcucacgcgaaaaagcaagaagucgugguucucgggucccaggagggagccaugcacaccgcucugacaggcgccaccgaaauccagaauagcgggggcaccucuauuuucgccggacaucugaagugucgccucaaaauggacaagcuggagcuuaaaggcauguccuacgcuaugugcacaaacacguuugugcugaagaaagaggucagcgaaacccagcacgggacaauccucgugaagguugaguacaagggagaagaugccccuuguaaaauccccuucuccaccgaggacggccaagggaaggcgcauaacggaagacugauuacagcuaauccuguggucaccaaaaaggaggaacccgugaacaucgaggccgaacccccuuucggcgagucuaauauugugaucgggacgggcgauaacgcccugaaaauuaauugguauaagaagggaagcuccaucggcaaaauguuugaagcuacagccagaggggcuagacgcauggccauccuuggagacaccgcgugggauuucggcagcguugggggaguccucaacucucugggcaagauggugcaccagauuuuuggguccgccuacaccgcucuguucagcggcgugucuugggucaugaaaaucggaauuggcgugcuccugacauggaucgggcuuaauagcaagaacaccuccaugucuuuuagcugcauugccaucggaauuaucacacuguaucucggcgcuguugugcaggccgacauggggugugucaucaauuggaaaggaaaggagcugaagugcggcuccgggauuuucgugacgaacgagguucauaccuggacagaacaguacaaauuucaagcggauagcccgaagcggcuggccaccgcuaucgccggcgcuugggagaauggaguguguggcauuagaucuacaacccgcauggaaaaccuucucuggaaacagaucgccaaugagcugaacuauauucugugggaaaauaacaucaagcucacggucgugguuggggacaccaucggagugcuggagcagggcaaacggacacuuacaccccagccuauggagcugaaguacuccuggaaaacaugggggaaggccaagauugucaccgcugaaauccaaaacagcucuuucauuaucgauggacccaauacaccugagugccccuccgcgagcagagccuggaacgugugggaaguggaggacuauggcuuuggcgucuucaccacgaauauuuggcucaaacugcgcgaaguuuacacacagcugugugaccaccggcuuauguccgcugccgugaaggaugagagagccgugcacgcugacaugggguacuggaucgagucucagaaaaacggaagcuggaagcucgaaaaagccuccuuuaucgaggucaagaccugcaccuggccgaagucucauacacuguggagcaauggcgugcuggaauccgauaugauuaucccuaaaagccucgcggggcccauuucucagcacaacuaucgcccuggauaccauacccaaacggcuggccccuggcaccuggggaaacuugagcuggacuucaauuauugcgagggaacaaccguugugaucacagaaaacuguggcacccggggcccuucccucagaacaaccacggucagcgggaaacugauucacgaguggugcugucgcucuugcacccugcccccgcuucgguacaugggagaagauggcuguugguaugggauggagaucagaccuaucuccgaaaaggaggagaauauggugaaaagccucgccucugccggaagcggcaagguugacaacuuuacaaugggggugcugugccuggcuauucucuucgaagaggucaugcggggaaaguucggcaaaaagcauaugaucgccggcguguuuuucaccuuuguucugcuucuguccgggcagauuacauggcgcgauauggcgcacacccucaucaugauuggaagcaaugcuucugacagaaugggcaugggggugacguaccuggcccugaucgccacauucaaaauucagcccuuucuugcucugggauucuuucuccggaagcugaccuccagagaaaaccuccugcuuggcgucgggcuggccauggcuacaacccuccaacugcccgaggauaucgaacagauggccaauggaaucgcgcugggccuuauggcccugaaacucauuacccaguucgagacauaucagcuguggacggcucucgugagccugaccuguuccaacacaauguuuacccuuacaguggccuggcgcaccgcuacgcugauccucgccggcgucucucugcugccuguuugccaaagcuccucuaugcggaagacagacuggcuuccgaugaccguggccgcuaugggggugcccccucugccccucuucauuuuuagccugaaggauacccucaaaagacgcuccuggccucugaaugagggagucauggcggugggccuuguuucuauccuggccagcucccugcucagaaacgacgugcccauggcugggccucuggucgccggaggccuucugauugccuguuacgugaucacagggaccagcgcugaucucacaguugaaaaggccgcggacgugacgugggaggaagaggcugaacagaccggagucucucauaaccugaugaucacaguggacgaugacggcaccaugcggauuaaagaugacgagacagagaauauccucaccguccugcuuaagacggcccugcugauuguguccggcaucuuccccuacagcauuccggccacccuccugguuuggcacacauggcagaaacagacccaacgcucuggggugcuuugggaugucccuucucccccugaaacacagaaggcugagcuggaagagggaguguauagaaucaaacagcagggcauccucgggaagacccaaguuggagugggcguccagaaggaggggguguuucauacaauguggcacgugacgcggggagccguucugacccacaacggcaaacgccucgaacccaauugggcgagcgucaagaaagaccugauuagcuacggcgggggauggagacuuuccgcucaguggcaaaagggcgaggaaguccaggugaucgccgucgagccggggaaaaacccuaagaauuuccagacaaugcccggaaccuuccagaccacaacgggcgaaauuggggccaucgcucuggauuuuaagccuggaaccagcggcucccccauuaucaaccgggagggcaaagugguugggcuguauggaaauggcguggucacaaagaacgggggauacgugagcggcauugcccaaaccaaugcugagcccgacgggccuacaccggaacucgaggaagagauguuccgcaaaagaaaccugaccaucauggaucuucaucccggcucuggaaagacgcggaaauaucugccugccaucguucgcgaagcgauuaagagacggcucagaacacugauccucgcccccacccgcguggucgcugccgagauggaggaagcucugaagggccuuccuauucgguaccagaccacagccaccaaaagcgagcacacagggagagaaaucguggaccugaugugccaugccaccuuuacgaugcgccugcucucccccguucgggugccuaauuauaaccugauuaucauggaugaggcucacuucacagacccggcgucuaucgccgcuagaggauacauuagcacccgcgucggcaugggggaagccgccgcuaucuuuaugacagccacacccccuggaacggcggaugcuuucccccaguccaaugccccuauucaggacgaggagcgggacauccccgaaagaucuuggaacagcggcaaugaguggauuaccgauuuugccgggaagacagugugguucgugccguccaucaaagcuggcaacgacaucgccaacugucuucgcaagaauggcaaaaaggucauucaacugucucggaagaccuuugauacagaauaccagaaaaccaagcucaacgacugggauuucguugugacaaccgacaucagcgagaugggagcgaauuuuaaagccgauagagugauugacccucggcgcugccugaagcccgucauccugacggaugggcccgagagagugauucucgcuggaccuaugcccguuacagccgcuuccgccgcucagcggcgcggcagaguggggcggaacccucagaaagaaaaugaccaauauaucuucaccggacagccgcuuaacaaugaugaggaccaugcccacuggaccgaagcgaagaugcugcuggacaacauuaauacacccgagggcaucaucccugcccucuucgaacccgagagagaaaagagcgcugccauugauggggaauaccgccugaaaggcgagucucggaagaccuuugucgaacuuaugagacgcggagaccugccuguguggcucgcucacaaaguugccuccgagggcaucaaguauacagaucggaaauggugcuucgacgggcagagaaacaaucagauucuggaagagaacauggauguggagaucuggacgaaggaaggagagaaaaagaagcugcgcccccgguggcucgacgccagaaccuacagcgauccgcuugcucugaaagaauuuaaggacuucgcggccggccgcaaaucuauugcucuggaucucgucacagagaucgggagagugccuucccaucuggcccaccggacccgcaaugcccuugacaaccuggucaugcuccauacaagcgaacacggaggcagagcuuaucggcacgccguggaggagcugcccgaaaccauggagacgcugcuccuucugggccugaugauccuccugaccgggggagcgaugcuuuuucugauuuccggcaaggggaucggaaaaacaucuauuggccucaucuguguuauugccagcuccgggaugcuguggauggcugaugugccucugcaauggaucgccagcgcuaucgugcucgaguucuuuaugaugguccuucugauucccgagccugagaagcagcgcacaccccaggacaaucaacuggccuacguugugaucggcauucucacacuggcggccaucauugcugccaacgaaaugggccuucuggagaccacgaagagagaucucggcaugucuaaagaaccggggguggucuccccuacaagcuaucuggacguggaccugcaucccgcuucugccuggacccucuacgcuguugccacaaccgugaucacccccaugcuucggcacacaauugagaauagcacggcgaacgucucccuggccgcuaucgccaaccaggcugugguccugaugggacucgauaagggcuggccuaucucuaaaauggaccugggggugccgcuucuggcccucggaugcuacagccagguuaauccccugacccugacagccgcggugcuccuucugauuacccauuaugcuaucauuggcccugggcugcaggccaaggcuacaagagaagcccaaaaacgcaccgccgcuggaaucaugaagaaccccacggucgauggcauuaugacaaucgaccucgauccugugaucuacgacuccaaguucgagaaacagcugggccagguuaugcuucuggugcucugugccguccagcugcugcucaugcggaccucuugggcgcuuugcgaggcccugacccuggcuacagggcccauuaccacacucugggaaggaagcccuggcaaguuuuggaauacgaccaucgccguguccauggcuaacauuuucagagggagcuaucuggccggagcgggccuugccuuuucuaucaugaaauccguggggacaggaaagcgcggcaccggcagccaaggggagacacugggagaaaaauggaagaagaaacucaaucagcugucccggaaggaguucgaucuguacaaaaagucuggcauuaccgaaguugacagaacggaggcuaaagaggggcucaagcggggagaaaccacacaccaugccgucagccgcggcuccgcuaaacuucagugguuuguggagagaaacauggugaucccggaagggcgggucaucgaucugggauguggccgcggcggguggucuuauuacugcgccggacugaagaagguuaccgaggugagaggcuauacaaaagggggacccggccacgaagaaccugugcccaugagcaccuacggguggaauauugucaagcucauguccggaaaagacguguucuaccugccucccgagaagugugauacacuucugugcgacaucggcgaaagcucuccguccccuaccguugaggaaagccggacgauucgcgugcucaaaauggucgagcccuggcugaagaacaaucaguucuguaucaaggugcugaaccccuauaugccuacaguuauugagcaccucgaaagacuucaacggaaacauggcgggaugcuggugcgcaauccccugucuagaaacuccacccacgagauguacuggaucagcaauggaaccggcaacauugucucuagcgugaauauggugucccggcuccugcuuaacagauuuacaaugacgcaucgccggccuaccaucgaaagagaugucgaccugggggcuggaacacgccacguuaacgccgagccggaaauccccaauauggacgugauuggcgagcggaucaagagaauuaaagaggaacacaacucuaccuggcauuaugaugacgagaauccuuacaagacaugggcguaucacgggagcuacgaagugaaagccaccggauccgcuagcuccaugaucaacggcgucgugaagcuccugacaaagcccugggauguugugccuauggucacccagauggccaugacggacaccacacccuucggccagcaacgcguguuuaaagagaagguugauacccggacaccgagaccuaugcccgggacccgcaaagugauggaaauuacggcugaguggcuguggcggacacucggaagaaauaagcgcccucggcugugcaccagagaggaguucaccaagaagguccgcaccaacgccgccaugggcgcgguguuuacggaggaaaaucagugggacucugcuaaggccgccguugaggaugaagaguucuggaaacuuguggacagagagcgggaacugcauaagcucgggaaauguggaagcugcgucuauaacaugaugggcaagcgcgagaaaaagcugggggaauuuggcaaagcuaagggauccagagccaucugguacauguggcuuggcgcucgguaccuggaguucgaggcccucggguuucugaaugaagaucacugguucucuagagagaacagcuauuccggaguggaaggcgaggggcugcauaagcucggauacauccugcgggacauuucuaaaauccccggcggggcgauguaugccgaugacaccgcuggcugggacacacgcauuaccgaagaugaccuucacaaugaggagaagaucacacagcagauggauccugaacacagacaacuggccaacgcuauuuuuaaacucaccuaccagaauaaggucgugaaaguucagcggcccacaccgaccggaacggugauggacaucaucagccgcaaggaucagagaggcuccgggcaagucggaacauauggccugaacaccuucaccaauauggaggcccagcuugugcggcagauggaaggggaggacgugcugagcaaggcggaucucgaaaacccucaucugcuggagaaaaagauuacacaguggcucgagaccaaaggaguugaacgccugaagagaauggccaucucuggcgacgauugcguggucaaacccauugacgaucgguuugcuaacgcccuucuggcucucaaugacauggggaaggugcgcaaggauaucccccaauggcagccuuccaaaggcuggcacgacuggcagcagguuccguucuguagccaucacuuccacgagcugauuaugaaggacggaagaaaacuugugguccccugccggccucaagaugaacugaucggccgcgccagaaucucucagggggcuggauggucccuccgggagacagccugucugggcaaggcguacgcccagauguggagccugauguauuuucaucgcagagaccuccggcuggcuucuaacgccauuugcuccgccgugcccguccacugggugccuacgagcagaaccacaugguccauccaugcucaccaucaauggaugaccacagaagauaugcuuaccguuuggaaucgcguguggauugaggacaaccccuggauggaggauaaaacgccugucaccacaugggaaaaugugcccuaccuggggaagcgggaggaccagugguguggaagccucaucggccugaccucuagagccacaugggcgcagaacauuccgaccgcuauccagcaaguucgcagccuuauugggaaugaagaguuccuggauuacaugccuuccaugaagcgguuuagaaaagaggaagagucugaaggcgccaucugguga

SEQ ID NO: 20520 - RNA, 9873 nt, Artificial Sequence
  derived and/or modified CDS sequence (opt5) from DENV-3__GQ252674__SS-prME
accagccugugccucaugaugauccugcccgccgcucuugccuuccaccugacaucccgggacggcgaaccucggaugauuguggggaagaaugaacgcggaaagucucuccuguuuaagacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggaauuggcaaccgggacuuuguggaagggcucagcggagcuaccugggucgauguggugcuggagcacggcgggugcgucaccacaauggccaagaauaaacccacgcuggacaucgagcuccagaagaccgaagcuacacagcuggccacccuucgcaaacuguguauugagggaaagaucacaaacauuaccacggauuccagaugcccuacacagggcgaagcgguucucccggaggaacaggaccagaauuauguguguaaacacaccuacguggaucggggcugggggaacggaugcggccuguucgggaagggaagccuugugacaugcgccaaguuucaaugucuggagcccaucgagggcaaagugguucaguaugaaaaucucaaguacacagugaucauuaccguccauacaggggaccagcaccaggugggaaacgagacgcaaggcguuaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaaguggucgugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguucugaagaaagagguguccgaaacccagcacgggacaauccucauuaaggucgaguacaagggagaagaugcccccuguaaaaucccuuucagcaccgaggacggccaagggaaggcgcauaacggaagacugauuacagcuaaucccgugguuaccaaaaaggaggaacccgugaacaucgaggccgaaccuccguucggcgaguccaauauugucaucgggaucggcgauaacgcccugaaaauuaauugguauaagaagggaucuagcaucggcaaaauguuugaagcuacggccagaggggcuagacgcauggccauucuuggagacacagcgugggauuucggcuccgucgggggagugcucaacagccugggcaagaugguucaccagaucuuugggucugccuacaccgcucuguucuccggcgucagcugggugaugaaaauuggaaucggcgugcuccugaccuggauugggcuuaauucuaagaacacaagcauguccuuuucuugcaucgccaucggaauuaucacccuguaucucggcgcugucgugcaggccgacaugggguguguuauuaauuggaaaggaaaggagcugaagugcggcagcgggaucuucgugacaaacgagguccauacguggaccgaacaguacaaauuucaagcggauucccccaagcggcuggccacagcuauugccggcgcuugggagaauggaguguguggcaucagaagcaccacacgcauggaaaaccuucucuggaaacagaucgccaaugagcugaacuauauucugugggaaaauaacaucaagcucaccguuguggucggggacacgauuggagugcuggagcagggcaaacggacccuuacaccucagcccauggagcugaaguacucuuggaaaaccugggggaaggccaagaucguuacagcugaaacccaaaacuccagcuucauuaucgauggaccuaauacacccgagugcccgucugcguccagagccuggaacgugugggaagucgaggacuauggcuuuggcguguucaccacgaauaucuggcucaaacugcgcgacguguacacacagcugugugaucaccggcuuaugagcgcugccgucaaggacgaaagagccguucacgcugauaugggguacuggauugagucccagaaaaacggaucuuggaagcucgagaaagccagccugaucgaagugaagaccugcaccuggccuaagucccauacacuguggucuaauggcgugcucgagagcgacaugauuauccccaaaucccuggcggggccuauuagccagcacaacuaucgccccggauaccauacccaaacggcuggcccuuggcaccuugggaagcuggaacucgauuuuaauuauugcgagggaacaaccgucgugaucacagagaacuguggcacccggggccccucucugagaacaaccacgguuuccgggaaacugauccacgaauggugcugucgcagcugcacccuuccgccucuccgguacaugggagaggacggcuguugguaugggauggaaauuagacccaucucugagaaggaagagaauauggugaaaucccuggucagcgccggaucuggcaagguggauaacuucacaauggggguucugugccucgccauucuguuugaggaagugaugcggggaaaguucggcaaaaagcauaugaucgcuggcguccuuuucaccuuugugcugcuccugagcgggcagauuacauggcgcgacauggcccacacccugaucaugauuggauccaaugcgagcgauagaaugggcauggggguuacguaccuugcucugaucgccacauucaaaauccagcccuuucucgcccugggauucuuucuccggaagcugaccucuagagagaaccuucugcucggcguggggcuggcuauggccacaacccugcaacuuccugaagacauugagcagauggcuaauggaaucgcccugggccucauggcgcugaaacucauuacccaguucgaaacauaucagcuguggacggcccuugucucccugaccuguagcaacacaauccucacccugacaguggcuuggcgcaccgccacgcugauucuugcuggcgugucccugcucccggucugccaaucuagcuccaugcggaagacagauuggcugcccaugaccguugccgccaugggggugccuccccucccucuguuuaucuucucucuuaaggacacccugaaaagacgcagcuggccccugaaugagggagugauggcugucggccucguguccauccuggcgucuagccuucugagaaacgauguuccuauggccgggccccucguggcuggaggccugcucauugccuguuacgucaucacagggaccuccgccgaccugacaguggagaacgcugccgacguuacgugggaagaggaagcggagcagaccggagugagccauaaucuuaugauuacagucgaugacgauggcaccaugcggaucaaggacgaugaaacagagaacauucugaccgugcugcucaaaacggcucugcuuaucgucucuggcaucuuuccguacuccauuccugccacccugcucguguggcacacauggcagaagcagacccaacgcagcgggguucugugggacgugcccucuccucccgagacacagaaagccgaacucgaggaaggagucuauagaaucaagcagcagggcauuuucgggaaaacccaagugggaguuggcgugcagaaggagggggucuuucauacaauguggcacgugacgcggggagcugugcugacccacaauggcaagcgccuugagccgaacugggccuccguuaaaaaggaucugaucagcuacggcgggggauggagacugucugcgcaguggcaacggggcgaagagguccaggugauugcuguggaaccugggaaaaaucccaagaacuuccagacaaugccuggaaccuuucagaccacaacgggcgagaucggggccauugcccucgacuucaaacccggaaccuccggcagccccaucaucaaucgcgaaggcaaggucguggggcuguauggaaacggcguugugacaaagaaugggggauacgucuccggcauugcucaaaccaacgccgagccugaugggccgacacccgagcuugaagaggaaauguucaaaaagagaaaucugaccaucauggaccuccauccuggcagcggaaaaacgcggaaguaucugcccgcuauugugcgcgaggccaucaaaagacggcucagaacacugauucuugcgccuacccgcguuguggccgcugaaauggaggaggcccugaagggccugcccauccgguaccagaccacagcuaccaagucugaacacacagggagagagaucgucgaucucaugugccaugccaccuuuacgaugcgccugcuuagcccugugcggguuccgaacuauaaucugauuaucauggacgaagcccacuucacagaucccgcuuccauugcggccagaggauacaucucuacccgcgugggcaugggggaggcugccgccauuuuuaugacagcuaccccucccggaacggccgacgcguucccucagagcaacgcucccauccaggacgaagaacgggauaucccggagagauccuggaacucuggcaacgaauggauuaccgacuuugccgggaaaacagucugguucgugccuagcaucaaggccggcaacgauauugcuaauugucuccgcaaaaacggaaagaaagugauccaacugucccggaagaccuuugacacagaguaccagaagaccaaacugaaugauugggacuucgucguuacaaccgauauuucugaaaugggcgccaacuuuaaggcggacagagugaucgauccccggcgcugccucaaacccgugauucuuacggacgggccugagagagucauccuggccggacccaucccugugacagcugccagcgcugcccagcggcgcggcagaguugggcggaauccgcagaaggagaacgaucaauauauuuucaccggacagccccugaauaacgacgaagaccaugcucacuggaccgaggccaaaaugcuccuggauaauaucaacacaccugaaggcauuauccccgcgcuuuuugagccugaaagagagaaguccgccgcuauugacggggaguaccgccugaagggcgaaagccggaaaaccuucguggagcucaugagacgcggagaucugcccgucuggcuggcccacaagguggcuucugaaggcaucaaauauacagaccggaaguggugcuucgaugggcagagaaauaaccagauccucgaggaaaauauggacguugagauuuggacgaaagagggagaaaagaagaaacuucgcccgcgguggcuggaugccagaaccuacuccgacccucuggcccucaaagaguuuaaagauuucgcugcgggccgcaagagcaucgcccuggaccuugugacagaaauugggagaguccccucucaucuggcucaccggacccgcaacgcccucgauaaucuggugaugcugcauacauccgagcacggaggcagagccuaucggcacgcugucgaagaacucccugagaccauggaaacgcuucugcugcucggccugaugauccuucugaccgggggagccaugcucuuucugauuagcggcaaagggaucggaaagacauccaucggccugauuugugugaucgcgucuagcgggaugcucuggauggccgagauuccccuucaauggaucgcuuccgccauuguucuggaguucuuuaugauggugcugcucaucccugagcccgagaaacagcgcaccccgcaggacaaccaacuggcuuacguggucauuggaauccuuacacuggccgcgaucauugccgcuaaugaaaugggccuccuggagaccacgaagagagaucugggcaugagcaaggaaccugggguugugucucccacauccuaucucgacguggaccuucaucccgccagcgcuuggacccuguacgccgucgcuacaaccgugaucaccccuaugcugcggcacacaauugagaacucuacggccaacguuagccucgcggccaucgcuaaucaggccgugguccugaugggacuugauaaaggcuggccgauuuccaagauggaccugggggugccccuccuggcucugggaugcuacucucaggucaacccucucacccuuacagccgccgugcugcugcucaucacccauuaugcgaucauuggccccgggcugcaggcuaaagccacaagagaagcucaaaagcgcaccgccgccggaaucaugaaaaauccuacgguugauggcauuaugacaaucgaccuugaucccgugauuuacgacagcaaguucgagaagcagcugggccaggucaugcuccuggugcugugugcuguucagcuccuucugaugcggaccuccugggcccugugcgaggcgcucacccuggccacagggccuaucaccacacuuugggaaggaucuccgggcaaauuuuggaacacgaccaucgcugugagcauggccaauauuuucagaggguccuaucuggcuggagccggccucgcguuuagcaucaugaagucugucgggacaggaaaacgcggcaccggcucccaaggggagacacugggagaaaaguggaaaaagaagcugaaccagcucagccggaaagaguucgaucuuuacaagaaauccggcauuaccgaaguggacagaacggaggccaaggaggggcugaaacggggagaaaucacccaccaugcugugucucgcggcagcgccaagcugcagugguuuguugagagaaauauggucauucccgaagggcgggugaucgaucucggauguggccgcggcgggugguccuauuacugcgcuggacugaaaaaggugacagaggucagaggcuauaccaaagggggaccuggccacgaagaacccguuccuaugucuacauacggguggaacauugugaaacuuaugagcggaaaggacguguucuaccugcccccggagaaaugugauacccuccugugcgacaucggcgaauccagcccuucucccacagucgaggaaucccggaccauccgcgugcugaagaugguugagcccuggcucaaaaauaaccaguuuuguauuaaggugcuuaauccuuauaugcccacggucaucgagcaccuggaaagacugcaacggaagcauggcgggaugcucgugcgcaacccucugagcagaaauucuacacacgagauguacuggauuuccaacggaaccggcaauaucguuagcucugugaacauggucagccggcuucugcucaacagauucaccaugacacaucgccggccgacgauugaaaaagauguggaccugggggccggaaccagacacgugaaugcugagcccgaaacaccuaacauggacgucaucggcgagcgcaucaagcggauuaaagaggaacacaauuccaccuggcauuaugaugacgagaaccccuacaagacaugggccuaucacgggucuuacgaaguuaaagcgaccggaagcgccuccagcaugaucaauggcguggugaagcugcucacaaagccuugggaugucgugcccaugguuacccagauggcuaugacggacaccacaccguucggccagcaaagaguguuuaaagagaaggucgauacccgcacaccucgguccaugcccgggaccagaaaagugaugggaauuacggccgaauggcuguggcgcacacuuggccggaacaagagaccucgccugugcacccgggaggaguucaccaagaagguuagaaccaaugcugccaugggggccguguuuacggaagagaaccagugggacucugcgaaggcugccgucgaagaugaggaguucuggaaacucguggaccgcgagagagagcugcauaaacuuggaaaauguggcagcugcguuuauaauaugauggggaagcgggagaagaagcugggcgaguuuggaaaagccaagggcucccgcgcuaucugguacauguggcucggggccagauaccuggaguucgaggcucugggauuucucaacgaggaucacugguucucucgggacaauagcuauuccggcguggaaggggagggacugcauaaacuuggcuacauucugagagauaucucuaaaauccccgggggcgccauguaugcggacgacaccgccggaugggauacacggauuaccgaagacgaucuccacaacgaggaaaagaucacacagcagauggacccugagcaccgccaacuggcuaaugccauuuuuaaacuuaccuaccagaacaaggucgugaaaguccagagacccacaccgaccggcacggugauggauaucauuagccggaaggaccagcgcggguccggacaaguuggcacauaugggcugaauaccuucaccaacauggaggugcagcucgucagacagauggaaggagagggcgugcugagcaaggcugaucuggaaaacccucaucuccccgagaaaaagaucacacaguggcuggaaaccaaagggguggagcggcuuaagcgcauggccaucucuggcgacgauugcguugugaaacccauugacgauagauuugcgaaugcccugcucgcucugaacgacaugggaaagguccggaaggauaucccucaauggcagccguccaaaggcuggcacgacuggcaacaggugcccuucuguagccaucacuuucacgagcuuauuaugaaggacgggcgcaaacugguugugccuugcagaccccaagaugaacucaucggacgggcccgcauuucucagggcgcuggguggucccugagagagacagccugucugggaaaggcuuacgcccagauguggagccucauguauuuccaucggcgcgaccugagacuugcgucuaaugccaucugcuccgcugucccugugcacuggguccccacgagccggaccacaugguccauucaugcccaccaucaauggaugaccacagaagauaugcugaccguguggaacagaguuuggaucgaggacaauccuuggauggaaaacaaaacgcccgugaccacaugggagaaugucccguaccucggcaagcgcgaggaucaguggugugggagccugaucggccuuaccucucgggccacaugggcucagaacauuccuaccgccauccagcaagugagaagccugauuggaaaugaagaguuccucgacuacaugcccuccaugaagcgcuuucggaaagaagaggagucugaaggcgcgaucugguga

SEQ ID NO: 20521 - RNA, 9873 nt, Artificial Sequence
  derived and/or modified CDS sequence (opt5) from DENV-3__GQ199889__SS-prME
accagccugugccucaugaugauccugcccgccgcucuugccuuccaccugaccucccgggacggcgagccucggaugauuguggggaagaaugaacgcggaaaaucucuccuguuuaagacggcguccggcaucaauauguguacccuuauugcuauggaucugggggagaugugcgacgauacggucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggcggcaggucgaaaaaguugagacaugggcccuccgccaccccggcuucaccauccuggcgcuuuuucuggcccauuacaucgggacgucccucacacagaagguggucauuuucauccugcuuauucuggugaccccuucuauggcuaugagauguguuggagugggcaaccgggacuuugucgaagggcucagcggagccacauggguggaugugguccuggagcacggcgggugcguuaccaccauggcuaagaauaaacccacacuggacaucgagcuccagaagacggaagccacccaacuggcgacacuucgcaaacuguguauugagggaaagaucaccaacauuacaaccgauuccagaugcccuacgcagggcgaagccauccucccggaggaacaggaccagaauuauguguguaaacacacauacguggaucggggcugggggaacggaugcggccuguucgggaagggaagccuugugacaugcgcuaaguuucaaugucuggagucuaucgagggcaaagugguucaguaugaaaaucucaaguacaccgugauuaucacaguccauaccggggaccagcaccaggugggaaacgagacacaaggcguuacggccgaaauuacaccccaggcuuccacaaccgaggccauccugccugaauauggcacacuggggcucgagugcagcccccgcaccggacuggacuucaaugagaugauucuucugacgaugaaaaacaaggccuggauggugcauagacagugguuuuucgaucucccucugcccuggaccucuggcgcuacaaccgaaacaccgaccuggaaucggaaagagcuucuggucacguuuaagaacgcgcacgccaaaaagcaagaaguggucgugcucgggucccaggagggagcuaugcacacagcccugaccggcgccacagaaauccagaauagcgggggcaccucuaucuucgcuggacaucugaagugucgccucaaaauggacaagcuggagcuuaaaggcauguccuacgccaugugcaccaacacauuuguucugaagaaagaggugagcgaaacgcagcacgggaccauucucaucaaggucgaguacaagggagaagaugcgccuuguaaaauucccuucuccacagaggacggccaagggaaggcucauaacggaagacugaucaccgccaauccugugguuaccaagaaggaggaacccgugaacauugaggccgaacccccuuucggcgagucuaauaucgucaucgggauuggcgauaacgcucugaaaaucaauugguauaagaagggaagcuccauuggcaaaauguuugaagccaccgcuagaggggccagacgcauggcgauccuuggagacacggccugggauuucggcagcgucgggggagugcucaacucucugggcaagaugguucaccagauuuuuggguccgcuuacacagcccuguucagcggcgucucuugggugaugaaaaucggaauuggcgugcuccugaccuggaucgggcuuaauagcaagaacaccuccaugucuuuuagcugcaucgcuauuggaaucauuacacuguaucucggcgccgucgugcaggcggacaccggguguguuaucaauuggaaaggaaaggagcugaagugcggcuccgggauuuucgugacaaacgagguccauacguggaccgaacaguacaaauuucaagccgauagcccgaagcggcuggcuacagccaucgcuggcgccugggagaauggaguguguggcaucagaucuaccacacgcauggaaaaccuucucuggaaacagauugccaaugagcugaacuauauccugugggaaaauaacauuaagcucaccguuguggucggggacacgaucggagugcuggagcagggcaaacggacccuuacaccccagccuauggagcugaaguacuccuggaaaaccugggggaaggcuaagauuguuacagcggaaauccaaaacagcucuuucaucauugauggacccaauaccccugagugccccuccgccagcagagcuuggaacgugugggaagucgaggacuauggcuuuggcguguucacaaccaauaucuggcucaaacugcgcgaaguguacacgcagcugugugaccaccggcuuauguccgccgccgucaaggaugagagagcuguucacgccgacaugggguacuggauugagucucagaaaaacggaagcuggaagcucgaaaaagcguccuuuaucgaggugaagacaugcaccuggccgaagucucauacccuguggagcaauggcgugcuggaauccgauaugauuaucccuaaaagccucgcugggcccaucucucagcacaacuaucgcccuggauaccauacacaaaccgccggccccuggcaccuggggaaacuugagcuggacuucaauuauugcgagggaacgacagucgugauuaccgaaaacuguggcacacggggcccuucccucagaaccacaaccguuagcgggaaacugauccacgaguggugcugucgcucuugcacgcugcccccgcuucgguacaugggagaagauggcuguugguaugggauggagauuagaccuaucuccgaaaaggaggagaauauggugaaaagccucgccucugcuggaagcggcaaggucgacaacuuuaccaugggggugcugugccuggccauucucuucgaagagguuaugcggggaaaguucggcaaaaagcauaugaucgcgggcguguuuuucacauuuguccugcuucuguccgggcagauuaccuggcgcgauauggcucacacacucaucaugaucggaagcaaugccucugacagaaugggcaugggggugaccuaccuggcccugauugcuacguucaaaauccagcccuuucuugcccugggauucuuucuccggaagcugacauccagagaaaaccuccugcuuggcguugggcuggcuauggccaccacacuccaacugcccgaggauauugaacagauggcgaauggaaucgcccugggccuuauggcucugaaacucauuacccaguucgagaccuaucagcuguggacagcccucaucagccugacguguuccaacaccauguuuacacuuaccguggcuuggcgcacagccacccugauccucgccggcgucucucugcugccugugugccaaagcuccucuaugcggaagacggacuggcuuccgaugacaguggcugcgaugggggugcccccucugccccucuucauuuuuagccugaaggauacccucaaaagacgcuccuggccucugaaugagggaguuauggccgugggccuugugucuauccuggcuagcucccugcucagaaacgacguccccauggccgggccucugguggccggaggcaugcuuauugcuuguuacguuaucaccgggacaagcgccgaucugaccguggaaaaggcggcugacgucacaugggaggaagaggccgaacagacgggagugucucauaaccucaugauuaccguugacgaugacggcacaaugcggaucaaagaugacgagaccgagaauauccugacagugcuccugaagaccgcccuucugauugucuccggcaucuuccccuacagcauuccggcuacgcugcucguguggcacaccuggcagaaacagacacaacgcucugggguccugugggaugugccuucucccccugaaacccagaaggccgagcuugaagagggaguuuauagaaucaaacagcagggcauucuggggaagacacaagugggagucggcgugcagaaggaggggguuuuucauaccauguggcacgugacacggggagcgguccucacgcacaacggcaaacgccuggaacccaauugggcuagcgugaagaaagaccucaucagcuacggcgggggauggagacuguccgcccaguggcaaaagggcgaggaagugcagguuauugccgucgagccggggaaaaacccuaagaauuuccagaccaugcccggaacauuccagaccaccacaggcgaaaucggggcuaucgcccuugauuuuaagccuggaacgagcggcucccccauuaucaaccgggagggcaaagugguggggcuguauggaaauggcgucgugaccaagaacgggggauacguuagcggcauugcucaaacaucugccgagcccgacgggccuaccccggaacuggaggaagagauguuccgcaaaagaaaucucacaaucauggaucugcaucccggcagcggaaagacccggaaauaucuuccugcgauugugcgcgaagccaucaagagacggcugagaacgcucauccuggcucccacacgcgucguggccgcugagauggaggaagcccucaagggccugccuauucgguaccagaccaccgccacaaaauccgagcacaccgggagagaaaucguugaccuuaugugccaugcuacauuuaccaugcgccugcugucucccgugcgggucccuaacuauaaucucauuaucauggaugaggcgcacuucacggacccggccagcauugcugccagaggauacaucuccacacgcgugggcaugggggaagccgcugccaucuuuaugaccgcgacacccccuggaaccgcugaugccuucccccagucuaacgccccuauucaggacgaggagcgggacauccccgaaagaagcuggaacuccggcaacgaguggauuacggauuuugcugggaagaccguuugguucgugccgucuaucaaagccggcaaugacauugcgaacugucugcgcaagaacggcaaaaaggucauccaacuuagccggaagacauuugauaccgaauaccagaaaacaaagcugaaugacugggauuucguggugaccacagacauuuccgagaugggagccaacuuuaaagcugauagagucaucgacccucggcgcugccucaagcccguuauccugaccgaugggcccgagagagugauucuggccggaccuaugcccgugacggcugccagcgcugcccagcggcgcggcagagucgggcggaauccucagaaagaaaacgaccaauauaucuucacaggacagccgcucaauaacgaugaggaccaugcgcacuggaccgaagccaagaugcuucuggacaauauuaacacccccgagggcaucauuccugcucuguucgaacccgagagagagaagucugccgcuaucgauggggaauaccgccucaaaggcgagucccggaagacauuuguggaacugaugagacgcggagaccuuccuguuuggcuggcccacaaaguggccagcgagggcaucaaguauaccgaucggaaauggugcuucgacgggcagagaaauaaccagauucucgaagagaauauggaugucgagaucuggacaaaggaaggagagaaaaagaagcugcgcccccgguggcuggacgcuagaacguacucugauccgcucgcgcuuaaagaauuuaaggacuucgccgcuggccgcaaauccauugcccuggaucuggugaccgagaucgggagaguuccuagccaucucgcccaccggacacgcaacgcucuggacaaucuugugaugcugcauaccuccgaacacggaggcagagccuaucggcacgcggucgaggagcuccccgaaacaauggagacccugcugcuccuuggccugaugauucugcucacagggggagccaugcuguuucuuaucucuggcaaggggaucggaaaaaccagcauuggccugaucugugugauugcuuccagcgggaugcucuggauggccgaugucccucugcaauggaucgcuucugccauugugcuggaguucuuuaugaugguucuccuuauccccgagccugagaagcagcgcacaccccaggacaaccaacuggcguacguggugauuggaauccugacccucgccgcuaucauugccgcuaaugaaaugggccugcuugagacaaccaagagagaucugggcauguccaaagaaccgggggucguuagcccuacgucuuaucucgacguggaccugcaucccgccagcgcuuggacacuguacgccguggcgaccacagucaucacccccaugcuccggcacaccauugagaacuccacagccaaugugucucuugcugccaucgcuaaccaggccguugugcugaugggacuggauaagggcuggccuauuagcaaaauggaccucggggucccgcugcuugcccugggaugcuacucccaggugaacccccucacgcugaccgcggcuguccugcuccuuaucacacauuaugccaucauuggcccugggcugcaggcuaaggccaccagagaagcccaaaaacgcacagcugccggaaucaugaagaaucccaccguggauggcauuaugacgaucgaccuggauccuguuauuuacgacucuaaguucgagaaacagcucggccaggugaugcugcuuguccugugugcggugcagcuccugcugaugcggacaagcugggcccucugcgaggcucuuacccuggccaccgggcccaucacaacccugugggaaggauccccuggcaaguuuuggaacacaacgaucgcuguuagcauggccaauauuuucagagggucuuaucucgcgggagccggccuggcuuuuuccaucaugaaaagcguggggaccggaaagcgcggcacaggcucccaaggggagacccuuggagaaaaauggaagaagaaacugaaccagcucucucggaaggaguucgaucuguacaaaaagagcggcauuacagaagucgacagaaccgaggccaaagaggggcugaagcggggagaaacgacccgccacgcuguguccagaggcucugccaaacuccagugguuuguggagcggaauaugguuaucccggaagggcgcgucauugaucuuggauguggcagaggcggguggagcuauuacugcgcuggacugaagaaggugacagaggugcggggcuauaccaaagggggacccggccaugaagaaccuguccccauguccacauacggguggaacaucguuaagcugaugagcggaaaagacguguucuaccucccucccgagaagugugauacccugcuuugcgacauuggcgaaucuuccccgagcccuacaguggaggaaucucgcaccaucagaguccugaaaaugguggagcccuggcucaagaauaaccaguucuguaucaagguucugaaucccuauaugccuacggugauugagcaccuggaacggcuccaacgcaaacacggcgggaugcuugucagaaacccccugucccggaauagcacacaugagauguacuggaucucuaacggaaccggcaauauugugagcuccguuaacauggugucuagacugcuccugaaucgcuuuaccaugacacaccggagaccuacgaucgaacgcgaugucgaccuuggggccggaacccggcaugugaacgcggagccggaaauucccaacauggacgugaucggcgagagaaucaagcgcauuaaagaggaacacaauagcacauggcacuaugaugacgagaacccuuacaagaccugggccuaucauggguccuacgaagucaaagcuacaggaagcgccuccucuaugaucaauggcguugugaagcugcucaccaagcccugggauguggucccuauggugacacagauggcuaugaccgacacgacccccuucggccagcaacggguuuuuaaagagaagguggauacaagaaccccgcgcccuaugcccgggacacggaaagucauggaaauuaccgccgaguggcuguggagaacgcugggacgcaacaagcggccuagacucugcacacgcgaggaguucaccaaaaaggugagaacaaaugccgcgaugggcgcuguuuuuaccgaggaaaaccagugggacagcgccaaggccgcuguggaggaugaagaguucuggaaacuggucgaccgggagcgcgaacuucacaagcuggggaaauguggauccugcguguauaauaugaugggcaagagagagaaaaagcucggggaauuuggcaaagccaagggaucucgggcuaucugguacauguggcugggcgccagauaccuugaguucgaggcgcugggguuucucaacgaagaucauugguucagccgggaaaauuccuauucuggaguugaaggcgaggggcugcacaagcugggauacauucuccgcgacaucagcaaaauccccggcggggccauguaugcugaugacacggccggcugggacaccagaauuacagaagaugaccugcauaacgaggagaagaucacccagcagauggauccugaacaccggcaacuugcuaaugccauuuuuaaacugacauaccagaacaagguggucaaagugcagcgccccaccccgacaggaaccgucauggacaucauuuccagaaaggaucagcggggcagcgggcaagugggaacguauggccucaauacauucaccaacauggaggcgcagcugguucgccagauggaaggggagggagugcuuucuaaggccgaccuggaaaauccucaccuccuggagaaaaagaucacccaguggcuggagacaaaaggcgucgaaagacucaagcggauggcuaucuccggggaugacugcguggugaaacccauugaugaccgcuuugccaacgcucugcuugcccugaacgauaugggcaagguuagaaaggacaucccccaauggcagccuagcaaaggauggcaugauuggcaacaggugccguucuguucucaccauuuccacgagcucauuaugaaggacggccggaaacuggucgugcccugccgcccucaagacgaacuuaucgggagagcucggauuucccagggagccggcuggagccugcgcgagaccgcgugucucgggaaggccuacgcucagauguggucucugauguauuuucacagacgggaucugagacucgccuccaaugccaucugcagcgcuguucccgugcauugggucccuacaucccgcacgaccuggagcauucacgcccaucaccaauggaugacaaccgaagacaugcugacaguguggaaccgggucuggaucgaggauaaucccuggauggaggacaaaaccccugugacgaccugggaaaacguucccuaccuuggaaagagagaggaucagugguguggcucucugaucgggcucacaagccgcgcgaccugggcucagaauauuccgacagccauccagcaagugcggucccugauuggcaacgaagaguuccuugacuacaugccuucuaugaagagauuucgcaaagaggaagagagcgaaggagccaucugguga

SEQ ID NO: 20522 - RNA, 9873 nt, Artificial Sequence
  derived and/or modified CDS sequence (opt5) from DENV-3__FJ882571__SS-prME
accagccugugccucaugaugauccugcccgccgcucuugccuuccaccugacgucccgggacggcgagccucggaugauuguggggaagaacgaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucauguggggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacacgaucggaguucuggagcagggcaaacggacccuuacaccucagcccauggagcugaaguacucuuggaaaaccugggggaaggccaagauugugacagcugaaacccaaaacuccagcuucaucauugauggaccuaauacacccgagugcccgucugcguccagagccuggaacgucugggaaguggaggacuauggcuuuggcguguucaccacgaauaucuggcucaaacugcgcgacgucuacacacagcugugugaucaccggcuuaugagcgcugccguuaaggacgaaagagccgugcacgcugauaugggguacuggaucgagucccagaaaaacggaucuuggaagcucgagaaagccagccugauugaagugaagaccugcaccuggccuaagucccauacacuguggucuaauggcguccucgagagcgacaugaucauucccaaaucccuggcggggccuaucagccagcacaacuaucgccccggauaccauacccaaacggcuggcccuuggcaccuugggaagcuggaacucgauuuuaauuauugcgagggaacaaccgugguuauuacagagaacuguggcacccggggccccucucugagaacaaccacgguguccgggaaacugauccacgaauggugcugucgcagcugcacccuuccgccucuccgguacaugggagaggacggcuguugguaugggauggaaaucagacccauuucugagaaggaagagaauauggucaaaucccuggugagcgccggaucuggcaagguugauaacuucacaaugggggugcugugccucgccauccuguuugaggaagucaugcggggaaaguucggcaaaaagcauaugauugcuggcgugcuuuucaccuuuguucugcuccugagcgggcagaucacauggcgcgacauggcccacacccugauuaugaucggauccaaugcgagcgauagaaugggcaugggggugacguaccuugcucugauugccacauucaaaauccagcccuuucucgcccugggauucuuucuccggaagcugaccucuagagagaaccuucugcucggcgucgggcuggcuauggccacaacccugcaacuuccugaagacaucgagcagauggcuaauggaauugcccugggccucauggcgcugaaacucaucacccaguucgaaacauaucagcuguggacggcccuugugucccugaccuguagcaacacaauucucacccugacaguggcuuggcgcaccgccacgcugauccuugcuggcgucucccugcucccgguuugccaaucuagcuccaugcggaagacagauuggcugcccaugaccguggccgccaugggggugccuccccucccucuguuuauuuucucucuuaaggacacccugaaaagacgcagcuggccccugaaugagggagucauggcugugggccucguuuccauccuggcgucuagccuucugagaaacgaugugccuauggccgggccccucgucgcuggaggccugcucaucgccuguuacgugauuacagggaccuccgccgaccugaucguugagaaggcugccgacgugacaugggaagaggaagcggagcagacgggagucagccauaaccuuaugauuaccguggaugacgauggcacaaugcggaucaaagacgaugaaaccgagaauauucugacaguccugcucaagaccgcucugcuuaucgugucuggcaucuuuccguacuccauuccugccacgcugcucguuuggcacaccuggcagaaacagacacaacgcagcggggugcugugggacguccccucuccucccgagacccagaaggccgaacucgaggaaggaguguauagaaucaaacagcagggcauucuggggaagacacaaguuggagugggcguccagaaggaggggguguuccauaccauguggcacgugacacggggagcuguucuuacgcacaacggcaaacgccuggagccgaauugggccuccgucaagaaagaucugaucagcuacggcgggggauggagacucucugcgcaguggcaaaagggcgaagagguccaggugauugcugucgaaccugggaaaaaccccaagaauuuucagaccaugccuggaacauuccagaccaccacaggcgagaucggggccauugcccuggacuuuaagcccggaacguccggcagccccaucaucaaccgggaaggcaaagugguugggcuuuauggaaauggcguggucaccaagaacgggggauacguguccggcauugcucaaacaaaugccgagccugaugggccgacccccgagcuggaagaggaaauguucaaaaagcgcaaccucacaaucauggaccugcauccuggcagcggaaaaaccagaaaguaucuccccgcuauuguucgggaggccaucaagcgcagacugcggacgcuuauucuggcgccuacaagaguggucgccgcugaaauggaggaggcccugaaaggccuccccauccgcuaccagaccaccgcuacaaagucugaacacaccgggcgggagaucguggaucugaugugccaugccacauucaccaugagacuucugagcccuguucgcgugccgaauuauaaccucauuaucauggacgaagcccacuuuacggaucccgcuuccauugcggcccggggauacaucucuacaagagucggcaugggggaggcugccgccauuuucaugaccgcuacaccucccggaaccgccgacgcguuuccucagagcaaugcucccauccaggacgaggaacgcgauaucccggagcgguccuggaacucuggcaaugaauggauuacggacuucgccgggaaaaccgugugguuugugccuagcaucaaggccggcaacgauauugcuaacugucugcgcaaaaauggaaagaaggucauccaacuguccagaaaaacauucgacaccgaguaccagaagacaaaacucaacgauugggacuuuguugugaccacagauauuucugaaaugggcgccaauuucaaggcggaccgggugaucgaucccagacggugccuuaaacccgucauucugaccgacgggccugagcgcgugauccuggccggacccaugccuguuacggcugccagcgcugcccagagacggggccgcguggggagaaacccgcagaaggagaaugaucaauauaucuuuacaggacagccccucaacaaugacgaagaccaugcucacuggaccgaggccaagaugcugcuugauaacauuaauaccccugaaggcaucauucccgcgcuguucgagccugaacgggagaaauccgccgcuaucgacggggaguacagacucaagggcgaaagccgcaaaacauuugucgagcugaugcggagaggagaucugcccguguggcucgcccacaagguugcuucugaaggcauuaaauauaccgaccgcaaguggugcuucgaugggcagcggaacaaucagauccuugaggaaaacauggacguggagaucuggacaaaagagggagaaaagaagaaacugagaccgcgcuggcuggaugcccggacguacuccgacccucucgcccugaaggaguucaaagauuuugcugcgggcagaaagagcauugcccuugaccuggucaccgaaaucgggcgcgugcccucucaucucgcucacagaacacggaaugcccuggauaaccuggucaugcuccauaccuccgagcacggaggccgcgccuauagacacgcuguggaagaacuuccugagacaauggaaacccugcugcuccugggccuuaugauucugcucacagggggagccaugcuguuccugaucagcggcaaagggauuggaaagaccuccaucggccucaucuguguuauugcgucuagcgggaugcuuuggauggccgagaucccccugcaauggauugcuuccgccaucgugcuggaauuuuucaugauggugcuccugauuccugagcccgagaagcagcggacaccgcaggacaaucaacuugcuuacgucguuaucggcauucucacccucgccgcgaucaucgccgcuaacgaaaugggacugcuggagacaaccaaacgcgaucucggcaugagcaaggaaccugggguggugucucccacguccuaucuugacgucgaccugcaucccgccagcgcuuggacacuguacgccguggcuaccacaguuauuaccccuaugcucagacacaccaucgaaaauucuacagccaacgugagccuggcggccauugcuaaccaggccgucgugcuuaugggacuggauaaaggcuggccgaucuccaagauggaccucggggucccccugcuggcucucggaugcuacucucaggugaauccucuuacgcugaccgccgccguucugcuccugauuacacauuaugcgaucaucggccccgggcuucaggcuaaagccacccgggaagcucaaaagagaacagccgccggaauuaugaagaacccuaccguggauggcaucaugacgauugaccuggaucccgucaucuacgacagcaaauuugagaagcagcucggccaggugaugcugcugguucucugugcugugcagcuucugcugaugcgcacauccugggcccucugcgaggcgcugacccuugccaccgggccuauuacaacccugugggaaggaucuccgggcaaauucuggaauacaacgaucgcugucagcauggccaacaucuuucggggguccuaucucgcuggagccggccuggcguucagcauuaugaagucuguggggaccggaaaaagaggcacaggcucccaaggggagacccugggagaaaaguggaagaaaaagcucaaucagcuuagccgcaaagaguuugaucuguacaagaaauccggcaucacagaaguggaccggaccgaggccaaggaggggcugaaaagaggagaaauuacgcaccaugcuguuucucggggcagcgccaagcuccagugguucgucgagcgcaacauggugauccccgaagggagagugauugaucugggauguggccggggcgggugguccuauuacugcgcuggacuuaagaaagucaccgagguucgcggcuauacaaaagggggaccuggccacgaggagcccgugccuaugucuaccuacggguggaauaucgugaaacugaugagcggaaaggacgucuuuuaccugcccccggagaaaugugauacacugcugugcgacauuggcgaauccagcccuucucccaccguggaggaauccagaacaauccggguucucaagaugguggagcccuggcuuaagaacaaucaguucuguaucaaaguccugaacccuuauaugcccaccgugauugagcaccuggaacgccuccaaagaaagcauggcgggaugcugguucggaauccucuuagccgcaacucuacgcacgagauguacuggaucuccaauggaacaggcaacauugugagcucugucaauauggugagcagacugcuccugaaccgguuuaccaugacccauagacgcccgacaaucgaaaaagauguggaccugggggccggaacgcggcacgucaacgcugagcccgaaaccccuaauauggacguuauuggcgagagaaucaagcgcaucaaagaggaacacaacuccacauggcauuaugaugacgagaaucccuacaagaccugggccuaucacgggucuuacgaagugaaggcgacaggaagcgccuccagcaugauuaacggcguggucaaacuccugaccaagccuugggaugugguucccauggugacacagauggcuaugaccgacacgaccccguucggccagcaacgggucuucaaagagaagguggauacaagaaccccucgccccaugccugggacacggaaaguuaugggaaucaccgccgaauggcuuuggagaacgcugggccgcaauaagcggcccagacucugcacacgcgaggaguuuaccaagaaagugcggacaaacgcugccaugggggccgucuucaccgaagagaaucagugggacuccgcgaaggcugccguggaagaugaggaauuuuggaaacugguugacagagagcgcgagcuucauaagcugggaaaauguggcucuugcguguauaacaugauggggaagagagagaagaagcucggcgaguucggaaaggccaaaggcagccgggcuauuugguacauguggcugggggcccgcuaccuggaauuugaggcucucggauuccugaaugaggaucacugguuuuccagagacaacucuuauagcggcgucgaaggggagggacuucauaagcugggcuacauccuccgggauauuuccaaaaucccugggggcgccauguaugcggacgacacggccggaugggauaccagaaucacagaagacgaucugcacaaugaggaaaagauuacccagcagauggaccccgagcaccggcaacuugcuaacgccaucuucaaacugacauaccagaauaagguggucaaggugcagcgcccgaccccuacaggcaccguuauggauauuaucucuagaaaagaccagcgggggagcggacaagugggcacguaugggcucaacacauuuaccaauauggagguccagcuggugcgccagauggaaggagagggcgugcuguccaaggcugaucucgaaaacccccaucugcccgagaaaaagauuacccaguggcuugaaacaaaagggguugagagacugaagcggauggccaucagcggcgacgauugcguggucaagccuaucgacgaucgcuucgcgaacgcccuccuggcucuuaaugacaugggaaaagugagaaaggauauuccgcaauggcagcccucuaaaggcaugcacgacuggcagcagguuccuuuuuguucccaucacuuccacgagcugaucaugaaggacgggcggaaacucgugguccccugccgcccucaagaugaacugauuggacgggcccggaucagccagggcgcuggguggucucugcgcgagaccgccugucucggaaaggcuuacgcccagauguggucccugauguauuuucauagacgggaccuucgccuggcgagcaacgccauuugcucugcugugcccguccacugggugccuacauccagaacgaccuggagcauccaugcccaccaucaauggaugacaaccgaagauaugcucgccguuuggaaucggguguggauugaggacaaccccuggauggaagauaagacaccggucaccacgugggaggacgugccuuaccugggcaaaagagaggaucaguggugugggucccuuaucggccugaccagccgcgcuacaugggcccagaauauccucaccgcgauucagcaaguucggucucugaucggaaacgaagaguuccuggacuacaugcccagcaugaagagauuccgcaaagaagaggaguccgaaggcgcuauuugguga

SEQ ID NO: 20523 - RNA, 9873 nt, Artificial Sequence
  derived and/or modified CDS sequence (opt5) from DENV-3__FJ882572__SS-prME
accagccugugccucaugaugauccugcccgccgcucuugccuuccaccugaccucccgggacggcgagccucggaugauuguggggaagaaugaacgcggaaaaucucuccuguuuaagacggcguccggcaucaauauguguacccuuauugcuauggaucugggggagaugugcgacgauaccgugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagucuauugagggcaaaguugugcaguaugaaaaucucaaguacacagucaucaucaccgugcauacaggggaccagcaccagguuggaaacgagacgcaaggcgugaccgcugaaauuacaccccaggccuccaccacagaggcuauccugccugaauauggcacccuggggcucgagugcagcccccgcacgggacuggacuucaaugagaugauucuucugaccaugaaaaacaaggccuggaugguccauagacagugguuuuucgaucucccucugcccuggacaucuggcgccaccacagaaaccccgacguggaaucggaaagagcuucuggugacauuuaagaacgcucacgcgaaaaagcaagaagucgugguucucgggucccaggagggagccaugcacaccgcucugacaggcgccaccgaaauccagaauagcgggggcaccucuauuuucgccggacaucugaagugucgccucaaaauggacaagcuggagcuuaaaggcauguccuacgcuaugugcacaaacacguuugugcugaagaaagaggucagcgaaacccagcacgggacaauccucaucaagguggaguacaagggagaagaugccccuuguaaaauucccuucuccaccgaggacggccaagggaaggcgcauaacggaagacugaucacagcuaauccuguugugaccaaaaaggaggaacccgucaacauugaggccgaacccccuuucggcgagucuaauaucgugauugggaucggcgauaacgcccugaaaaucaauugguauaagaagggaagcuccauuggcaaaauguuugaagcuacggccagaggggcuagacgcauggccauccuuggagacacagcgugggauuucggcagcgucgggggaguucucaacucucugggcaagaugguccaccagauuuuuggguccgccuacaccgcucuguucagcggcgugucuugggugaugaaaaucggaauuggcguccuccugaccuggaucgggcuuaauagcaagaacacauccaugucuuuuagcugcauugccaucggaaucauuacccuguaucucggcgcugugguucaggccgacacagggugugugaucaauuggaaaggaaaggagcugaagugcggcuccgggauuuucgucacgaacgaggugcauaccuggacagaacaguacaaauuucaagcggauagcccgaagcggcuggccaccgcuaucgccggcgcuugggagaauggaguuuguggcauuagaucuacaacccgcauggaaaaccuucucuggaaacagaucgccaaugagcugaacuauauccugugggaaaauaacauuaagcucacgguggucgugggggacaccaucggaguucuggagcagggcaaacggacacuuacaccccagccuauggagcugaaguacuccuggaaaacaugggggaaggccaagauugugaccgcugaaauccaaaacagcucuuucauuaucgauggacccaauacaccugagugccccuccgcgagcagagccuggaacgucugggaaguggaggacuauggcuuuggcguguucaccacgaauaucuggcucaaacugcgcgaagucuacacacagcugugugaccaccggcuuauguccgcugccguuaaggaugagagagccgugcacgcugacaugggguacuggauugagucucagaaaaacggaagcuggaagcucgaaaaagccuccuuuaucgaggugaagaccugcaccuggccgaagucucauacacuguggagcaauggcguccuggaauccgauaugauuaucccuaaaagccucgcggggcccauuucucagcacaacuaucgcccuggauaccauacccaaacggcuggccccuggcaccuggggaaacuugagcuggacuucaauuauugcgagggaacaaccgugguuaucacagaaaacuguggcacccggggcccuucccucagaacaaccacggugagcgggaaacugauccacgaguggugcugucgcucuugcacccugcccccgcuucgguacaugggagaagauggcuguugguaugggauggagauuagaccuaucuccgaaaaggaggagaauauggucaaaagccucgccucugccggaagcggcaagguggacaacuuuacaauggggguucugugccuggcuauucucuucgaagaggugaugcggggaaaguucggcaaaaagcauaugaucgccggcgucuuuuucaccuuugugcugcuucuguccgggcagauuacauggcgcgauauggcgcacacccucaucaugauuggaagcaaugcuucugacagaaugggcauggggguuacguaccuggcccugaucgccacauucaaaauccagcccuuucuugcucugggauucuuucuccggaagcugaccuccagagaaaaccuccugcuuggcguggggcuggccauggcuacaacccuccaacugcccgaggauauugaacagauggccaauggaaucgcgcugggccuuauggcccugaaacucauuacccaguucgagacauaucagcuguggacggcucucaucagccugaccuguuccaacacaauguuuacccuuacagucgccuggcgcaccgcuacgcugauucucgccggcgugucucugcugccugugugccaaagcuccucuaugcggaagacagacuggcuuccgaugaccgucgccgcuauggggguucccccucugccccucuucaucuuuagccugaaggauacccucaaaagacgcuccuggccucugaaugagggagugauggcggugggccuugucucuauccuggccagcucccugcucagaaacgacgugcccauggcugggccucugguugccggaggcaugcuuauugccuguuacgugaucacagggaccagcgcugaucugacagucgaaaaggccgcggacgugacgugggaggaagaggcugaacagaccggaguuucucauaaccucaugauuacaguggacgaugacggcaccaugcggaucaaagaugacgagacagagaauauucugaccguccuccugaagacggcccuucugaucguguccggcaucuuccccuacagcauuccggccacccugcucgucuggcacacauggcagaaacagacccaacgcucuggggugcugugggauguuccuucucccccugaaacacagaaggcugagcuugaagagggaguguauagaaucaaacagcagggcauucuggggaagacccaagucggagugggcguucagaaggaggggguguuucauacaauguggcacgucacgcggggagccgugcucacccacaacggcaaacgccuggaacccaauugggcgagcgugaagaaagaccucaucagcuacggcgggggauggagacuguccgcucaguggcaaaagggcgaggaaguucaggucauugccguggagccggggaaaaacccuaagaauuuccagacaaugcccggaaccuuccagaccacaacgggcgaaaucggggccauugcucuugauuuuaagccuggaaccagcggcucccccaucaucaaccgggagggcaaaguggucgggcuguauggaaauggcgugguuacaaagaacgggggauacgugagcggcauugcccaaaccucugcugagcccgacgggccuacaccggaacuggaggaagagauguuccgcaaaagaaaucucaccaucauggaucugcaucccggcagcggaaagacgcggaaauaucuuccugccauuguccgcgaagcgaucaagagacggcugagaacacucauucuggcccccacccgcgugguugcugccgagauggaggaagcucucaagggccugccuauccgguaccagaccacagccaccaaauccgagcacacagggagagaaaucguggaccuuaugugccaugccaccuuuacgaugcgccugcugucucccguccgggugccuaacuauaaucucauuaucauggaugaggcucacuucacagacccggcgagcauugccgcuagaggauacaucuccacccgcguuggcaugggggaagccgccgcuauuuuuaugacagccacacccccuggaacggcggaugcuuucccccagucuaacgccccuauccaggacgaggagcgggacauccccgaaagaagcuggaacuccggcaacgaguggauuaccgauuuugccgggaagacagugugguucgucccgucuaucaaagcuggcaaugacauugccaacugucugcgcaagaacggcaaaaaggugauccaacuuagccggaagaccuuugauacagaauaccagaaaaccaagcugaaugacugggauuucguggucacaaccgacauuuccgagaugggagcgaacuuuaaagccgauagaguuaucgacccucggcgcugccucaagcccgugauucugacggaugggcccgagagagugauccuggcuggaccuaugcccgucacagccgcuagcgccgcucagcggcgcggcagaguggggcggaauccucagaaagaaaacgaccaauauaucuucaccggacagccgcucaauaacgaugaggaccaugcccacuggaccgaagcgaagaugcuucuggacaauauuaacacacccgagggcaucauuccugcccuguucgaacccgagagagagaagucugcugccaucgauggggaauaccgccucaaaggcgagucccggaagaccuuuguugaacugaugagacgcggagaccuuccuguguggcuggcucacaaagucgccagcgagggcauuaaguauacagaucggaaauggugcuucgacgggcagagaaauaaccagauccucgaagagaauauggauguggagaucuggacgaaggaaggagagaaaaagaagcugcgcccccgguggcuggacgccagaaccuacucugauccgcucgcucuuaaagaauuuaaggacuucgcggccggccgcaaauccauugcucuggaucugguuacagagaucgggagagugccuagccaucucgcccaccggacccgcaacgcccuggacaaucuugucaugcugcauacauccgaacacggaggcagagcuuaucggcacgccguggaggagcuccccgaaaccauggagacgcugcugcuccuuggccugaugauucugcucaccgggggagcgaugcuguuucuuaucucuggcaaggggauuggaaaaacaagcaucggccugaucugugucauugccuccagcgggaugcucuggauggcugaugugccucugcaauggaucgccucugcuauuguucuggaguucuuuaugauggugcuccuuauccccgagccugagaagcagcgcacaccccaggacaaccaacuggccuacguggucauuggaauccugacacucgcggccauuaucgcugccaaugaaaugggccugcuugagaccacgaagagagaucugggcauguccaaagaaccggggguugugagcccuacaucuuaucucgacguggaccugcaucccgcuagcgccuggacccuguacgcugucgccacaaccgugaucacccccaugcuccggcacacaauugagaacuccacggcgaauguuucucuugccgcuaucgccaaccaggcugugguccugaugggacuggauaagggcuggccuauuagcaaaauggaccucggggugccgcugcuugcccugggaugcuacucccaggucaacccccucacccugacagccgcggugcugcuccuuaucacccauuaugcuauuaucggcccugggcugcaggccaaggcuacaagagaagcccaaaaacgcaccgccgcuggaaucaugaagaaucccacgguugauggcauuaugacaaucgaccuggauccugugauuuacgacucuaaguucgagaaacagcucggccaggucaugcugcuugugcugugugccguucagcuccugcugaugcggaccagcugggcgcucugcgaggcccuuacccuggcuacagggcccaucaccacacugugggaaggauccccuggcaaguuuuggaacacgaccauugccgugagcauggcuaauaucuucagagggucuuaucucgccggagcgggccuggccuuuuccaucaugaaaagcgucgggacaggaaagcgcggcaccggcucccaaggggagacacuuggagaaaaauggaagaagaaacugaaccagcucucucggaaggaguucgaucuguacaaaaagagcggcauuaccgaaguggacagaacggaggcuaaagaggggcugaagcggggagaaaccacacaccaugccgugucccgcggcucugcuaaacuccagugguuuguugagagaaauauggucaucccggaagggcgggugauugaucuuggauguggccgcggcggguggagcuauuacugcgccggacugaagaaggugaccgaggucagaggcuauacaaaagggggacccggccacgaagaaccuguucccauguccaccuacggguggaacaucgugaagcugaugagcggaaaagacguguucuaccucccucccgagaagugugauacacugcuuugcgacauuggcgaaucuuccccgagcccuaccgucgaggaaucucggacgauccgcgugcugaaaaugguugagcccuggcucaagaauaaccaguucuguauuaaggugcugaaucccuauaugccuacagucaucgagcaccuggaaagacuccaacggaaacauggcgggaugcuugugcgcaacccccuguccagaaauagcacccacgagauguacuggaucucuaacggaaccggcaauauuguuagcuccgugaacauggucucucggcugcuccugaauagauuuacaaugacgcaucgccggccuaccaucgaaagagauguggaccuuggggcuggaacacgccacgugaacgccgagccggaaauucccaacauggacgucaucggcgagcggauuaagagaaucaaagaggaacacaauagcaccuggcauuaugaugacgagaacccuuacaagacaugggcguaucacggguccuacgaaguuaaagccaccggaagcgcuuccucuaugaucaauggcguggugaagcugcucacaaagcccugggaugucgugccuaugguuacccagauggccaugacggacaccacacccuucggccagcaacgcguguuuaaagagaaggucgauacccggacaccgagaccuaugcccgggacccgcaaagugauggaaauuacggcugaguggcuguggcggacacugggaagaaacaagcgcccucggcucugcaccagagaggaguucaccaagaagguucgcaccaaugccgccaugggcgcgguguuuacggaggaaaaccagugggacagcgcuaaggccgccgucgaggaugaagaguucuggaaacugguggacagagagcgggaacuucauaagcuggggaaauguggauccugcguuuauaauaugaugggcaagcgcgagaaaaagcucggggaauuuggcaaagcuaagggaucuagagccaucugguacauguggcugggcgcucgguaccuugaguucgaggcccugggguuucucaacgaagaucacugguucagcagagaaaauuccuauucuggaguggaaggcgaggggcugcauaagcugggauacauucuccgggacaucagcaaaauucccggcggggcgauguaugccgaugacaccgcuggcugggacacacgcaucaccgaagaugaccugcacaacgaggagaagaucacacagcagauggauccugaacacagacaacuugccaaugcuauuuuuaaacugaccuaccagaacaaggucgugaaaguccagcggcccacaccgaccggaacggugauggacaucauuucccgcaaggaucagagaggcagcgggcaaguuggaacauauggccucaauaccuucaccaacauggaggcccagcuggugcggcagauggaaggggagggaguccuuucuaaggcggaccuggaaaauccucaucuccuggagaaaaagaucacacaguggcuggagaccaaaggcguggaacgccucaagagaauggccauuuccggggaugacugcgugguuaaacccaucgaugaccgguuugcuaacgcccugcuugcucugaacgauaugggcaaggugcgcaaggacaucccccaauggcagccuagcaaaggauggcacgauuggcagcaggucccguucuguucucaucacuuccacgagcucauuaugaaggacggcagaaaacuggugguucccugccggccucaagacgaacuuaucgggcgcgccagaauuucccagggagcuggcuggagccugcgggagacagccugucucgggaaggcguacgcccagauguggucucugauguauuuucaucgcagagaucugcggcucgcuuccaaugccaucugcagcgccgugcccguccacugggugccuacguccagaaccacauggagcauucaugcucaccaucaauggaugaccacagaagacaugcugaccgucuggaaccgcguguggaucgaggauaaucccuggauggaggacaaaacgccuguuaccacaugggaaaacgugcccuaccuuggaaagcgggaggaucagugguguggcucucugauugggcucaccagcagagccacaugggcgcagaauaucccgaccgcuauccagcaaguccgcucccugauuggcaacgaagaguuccuugacuacaugccuucuaugaagcgguuuagaaaagaggaagagagcgaaggagccaucugguga

SEQ ID NO: 20524 - RNA, 9873 nt, Artificial Sequence
  derived and/or modified CDS sequence (opt5) from DENV-3__FJ882573__SS-prME
accagccugugccucaugaugauccugcccgccgcucuugccuuccaccugaccucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucauguugggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggugauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccgugggccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccagaauagcgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagaugcgcccuguaaaauuccuuucagcacagaggacggccaagggaaggcucauaacggaagacugaucaccgccaaucccguugugaccaagaaggaggaacccgucaacauugaggccgaaccuccguucggcgaguccaauaucgugauugggaucggcgauaacgcucugaaaaucaauugguauaagaagggaucuagcauuggcaaaauguuugaagccaccgcuagaggggccagacgcauggcgauccuuggagacacggccugggauuucggcuccgucgggggaguucucaacagccugggcaagaugguccaccagauuuuugggucugcuuacacagcccuguucuccggcgugagcugggugaugaaaaucggaauuggcguccuccugaccuggaucgggcuuaauucuaagaacacccccaugagcuuuuccugcauugcuaucggaaucauuacacuguaucucggcgccgugguucaggcggacauggggugugugaucaauuggaaaggaaaggagcugaagugcggcucugggauuuucgucaccaacgaggugcauacauggacggaacaguacaaauuucaagccgauagcccuaagcggcuggcuaccgccaucgcuggcgccugggagaauggaguuuguggcauuagauccacaacccgcauggaaaaccuucucuggaaacagaucgccaaugagcugaacuauauccugugggaaaauaacauuaagcucacaguggucgugggggacaccacgggaguucuggagcagggcaaacggacccuuacaccccagccuauggagcugaaguacagcuggaaaaccugggggaaggcuaagaucgugacagcggaaacccaaaacucuuccuucauuaucgauggacccaauacaccggagugcccuagcgccucuagagcuuggaacgucugggaaguggaggacuauggcuuuggcguguucaccacgaauauuuggcucaaacugcgcgaagucuacacacagcugugugaccaccggcuuauguccgccgccguuaaggaugagagagcugugcacgccgacaugggguacuggaucgagagccagaaaaacggauccuggaagcucgaaaaagcgucucugaucgaggugaagaccugcaccuggcccaagagccauacacugugguccaauggcguccucgaaucugauaugauuaucccuaaaagccuggcugggcccauuucccagcacaacuaucgcccuggauaccauacccaaacggccggccccuggcaccuugggaagcuggagcucgacuuuaauuauugcgagggaacaaccgugguuaucacagaaaacuguggcacccggggcccgagccugagaacaaccacggugucugggaaacugauucacgaguggugcugucgcuccugcacccuuccuccccuccgguacaugggagaagauggcuguugguaugggauggagaucagacccaucagcgaaaaggaggagaauauggucaaaucucugguguccgccggaagcggcaagguugacaacuucacaaugggggugcugugccucgcuauucuguuugaagaggucaugcggggaaaguucggcaaaaagcauaugaucgccggcguguucuuuaccuucguucuucugcucucugggcagauuacauggcgcgauauggcgcacacccugaucaugauuggaagcaaugcuuccgacagaaugggcaugggggugacguaccuggcccuuaucgccacauuuaaaauucagccuuuccuggcucucggauuuuuccugcggaagcucaccagcagagaaaaccugcuucugggcgucgggcucgccauggcuacaacccugcaacugccggaggauaucgaacagauggccaauggaaucgcgcuuggccugauggcccucaaacugauuacccaguuugagacauaucagcucuggacggcucuggugucucuuaccuguuccaacacaaucuucacccugacaguggccuggcgcaccgcuacgcucauucuggccggcgucagccugcuucccguuugccaauccucuagcaugcggaagacagacuggcugccuaugaccguggccgcuaugggggugcccccucucccccuguuuaucuucucccucaaggauacccugaaaagacgcucuuggccucuuaaugagggagucauggcggugggccugguuagcauucuggccuccucucuccugagaaacgacgugcccauggcugggccgcuugucgccggaggccugcucaucgccuguuacgugaucacagggaccagcgcugaucugacaguugaaaaggccgcggacgugacgugggaggaagaggcugaacagaccggagucucccauaaccucaugauuacaguggacgaugacggcaccaugcggaucaaagaugacgagacagagaauauucugaccguccuucugaagacggcccugcucaucgugagcggcauuuuuccuuacucuauccccgccacccugcuuguuuggcacacauggcagaaacagacccaacgcuccggggugcugugggaugucccuucucccccggaaacacagaaggcugagcucgaagagggaguguauagaaucaaacagcagggcauucuggggaagacccaaguuggagugggcguccagaaggaggggguguuccauacaauguggcacgugacgcggggagccguucucacccacaacggcaaacgccuggaaccuaauugggcguccgucaagaaagaccuuaucuccuacggcgggggauggagacugagcgcucaguggcaaaagggcgaggaaguccaggugauugccgucgagcccgggaaaaacccuaagaauuuucagacaaugcccggaaccuuccagaccacaacgggcgaaaucggggccauugcucuggauuucaagcccggaaccucuggcuccccuaucauuaaccgggagggcaaagugguugggcucuauggaaauggcguggucacaaagaacgggggauacgugagcggcaucgcccaaaccaaugcugagccggacgggcccacaccugaacuggaggaagagauguuuaaaaagcgcaaccuuaccaucauggaucugcaucccggcuccggaaaaacgagaaaguaucucccugccauuguucgggaagcgaucaagcgcagacugcggacacucauucuggcccccaccagaguggucgcugccgagauggaggaagcucuuaaaggccugccuauccgcuaccagaccacagccaccaagagcgagcacacagggcgggaaauuguggaccugaugugccaugccaccuucacgaugagacuccugucuccgguucgcgugcccaauuauaaccuuaucaucauggaugaggcucacuuuacagacccugcgagcauugccgcucggggauacaucuccaccagagucggcaugggggaagccgccgcuauuuucaugacagccacacccccuggaacggcggaugcuuuuccccagucuaaugccccgauccaggacgaggagcgcgacauuccugaacggagcuggaacuccggcaaugaguggaucaccgauuucgccgggaaaacagugugguuugugcccucuaucaaggcuggcaacgacauugccaacugucugcgcaaaaauggaaagaaggucauccaacucagcagaaaaaccuucgauacagaauaccagaagaccaaacugaacgacugggauuuuguugugacaaccgacauuuccgagaugggcgcgaauuucaaggccgaucgggugaucgaccccagacggugccugaaaccugucauucucacggaugggcccgagcgcgugauccuugcuggaccuaugccgguuacagccgcuucugccgcucagagacggggccgcguggggagaaacccccagaaggaaaaugaccaauauauuuuuaccggacagccucugaacaaugaugaggaccaugcccacuggaccgaagcgaagaugcugcucgacaacaucaauacacccgagggcaucauuccugcccuguucgaacccgagcgggagaaaagcgcugccaucgauggggaauacagacuuaagggcgagucccgcaaaaccuucgucgaacugaugcggagaggagaccucccgguguggcuggcucacaagguugccagcgagggcauuaaauauacagaucgcaaguggugcuuugacgggcagcggaacaaucagauccuggaagagaacauggauguggagauuuggacgaaagaaggagagaagaagaaacucagaccucgcuggcuugacgcccggaccuacucugauccccuggcucugaaggaguucaaagacuuugcggccggcagaaaguccaucgcucucgaucuggucacagagaucgggcgcgugccuagccaucuugcccacagaacccggaaugcccuggacaaccucgucaugcugcauacaucugaacacggaggccgcgcuuauagacacgccguggaggagcugcccgaaaccauggagacgcuccuucugcugggccucaugauucugcuuaccgggggagcgaugcuguuccucaucuccggcaaagggauuggaaagacaagcaucggccugauuuguguuaucgccuccucugggaugcuguggauggcugaagugccucuccaauggaucgccagcgcuauugugcuugaguuuuucaugaugguccugcugauccccgagccggaaaagcagcggaccccucaggauaaucaacucgccuacguugugauuggaauccugacacuugcggccaugauugcugccaacgagaugggccugcucgaaaccacgaaacgcgaccugggcauguccaaggagcccgggguggucagccccacaucuuaucuggauguggaccuccauccugcuuccgccuggacccuuuacgcuguugccacaaccgugaucaccccgaugcugagacacacaauugaaaauagcacggcgaacgucucucuggccgcuaucgccaaccaggcugugguccucaugggacuggacaaaggcuggcccaucagcaagauggaucuuggggugccucugcucgcccugggaugcuacucccagguuaauccccugacccucacagccgcggugcuucugcugauuacccauuaugcuaucauuggcccugggcuccaggccaaagcuacacgggaggcccaaaagagaaccgccgcuggaaucaugaagaaccccacggucgacggcauuaugacaaucgaucuggacccugugaucuacgauucuaaauuugagaagcagcuuggccagguuaugcugcucgugcugugugccguccagcugcuccuuaugcgcaccagcugggcgcugugcgaagcccugacccucgcuacagggccgauuaccacacugugggagggaucccccggcaaauucuggaauacgaccaucgccgugucuauggcuaacauuuuucgggggagcuaucuugccggagcgggccuggccuucuccaucaugaaaagcguggggacaggaaaaagaggcaccggcucucaaggggaaacacucggagagaaguggaagaaaaagcugaaucagcugucccgcaaagaauuugaccucuacaagaaaagcggcauuaccgagguugaucggacggaggcuaaggaagggcuuaaaagaggagagaucacccaccaugccgucucccggggcucugcuaagcugcagugguucguggaacgcaacaugguggucccugaggggagaguuaucgaccugggauguggccggggcggguggagcuauuacugcgccggacucaagaaagugacagaagugcgcggcuauaccaaagggggacccggccacgaggagccuguccccauguccacauacggguggaauauugugaaacugaugucuggaaaggaugucuuuuaccuuccgccugaaaaaugugacacccugcucugcgauaucggcgagagcucccccagccccacaguggaagagucuagaaccauucggguccugaagaugguggagccuuggcugaagaacaaucaguucuguaucaaaguucucaaccccuauaugccuacggugauugaacaccuugagcgccugcaaagaaagcauggcgggaugcugguccggaauccgcucucccgcaacagcacacacgaaauguacuggaucucuaauggaaccggcaacauuguguccagcgugaauauggucucuagacugcuucugaaccgguucaccaugacacauagacgccccacgaucgagaaagacguugaucucggggcuggaacccggcacgugaacgccgaaccugagacacccaauauggacgugaucggcgagagagucaagcgcauuaaagaagaacacaacagcaccuggcauuaugacgaugaaaauccuuacaagacaugggcguaucacggguccuacgaggugaaggccaccggaucugcuagcuccaugaucaacggcguugugaaacugcugacaaagcccugggacgucgugccgaugguuacccagauggccaugacggauaccacaccuuuuggccagcaacggguguucaaagaaaaggucgacaccagaacaccccgcccuaugcccgggacccggaaagugauggagauuacggcugaguggcucuggagaacacugggacgcaauaagcggccuagacuuugcacccgcgaagaguuuacaaagaaaguucggaccaacgccgccaugggcgcgguguucacggaagagaaucagugggauagcgcuaaggccgccgucgaagacgaggaguuuuggaaacugguggauagagaacgcgagcuccauaagcuggggaaauguggauccugcgucuauaacaugaugggcaagagagagaagaaacuuggggaguucggcaaggcuaaaggaucucgggccaucugguacauguggcugggcgcucgcuaccucgaguuugaagcccugggguuccugaaugaggaccacugguuuagcagagaaaacuccuauucuggaguggagggcgaagggcuccauaagcugggauacauucuucgggauaucagcaaaauccccggcggggcgauguaugccgacgauaccgcuggcugggacacaagaauuaccgaggacgaucugcacaaugaggaaaagaucauucagcagauggacccggagcaccggcaacucgccaacgcuaucuucaaacugacauaccagaauaagguugugaagguccagcgcccuacccccacaggaaccgugauggauauuaucuccagaaaagaccagcggggcucugggcaagugggaacguauggccuuaacacauuuaccaauauggaagcccagcugguucgccagauggagggggaaggagugcucaccaaggcggaucuggagaacccccaucugcucgagaaaaagaucacacaguggcuggaagccaaaggcgucgagagacuuaagcggauggcuauuagcggggacgauugcgugguuaagccuaucgacgaucgcuucgccaacgcucugcucgcccugaaugacaugggcaaagugagaaaggauauuccgcaauggcagcccuccaaaggauggcacgacuggcagcaggucccuuuuuguagccaucacuuccacgaacuuaucaugaaggauggccggaaacuggugguccccugccgcccucaagacgagcucauugggagagcucggaucucucagggagccggcuggucccugcgcgaaaccgcgugucuggggaaggccuacgcucagauguggagccucauguauuuccauagacgggaccugcgccuugccucuaacgccaucugcuccgcugugcccguucacugggugccuacaagcagaacgaccuggucuauucaugcccaccaucaauggaugacaaccgaggauaugcugacagucuggaaucggguguggaucgaggaaaaccccuggauggaggacaagaccccgguuacgaccugggaaaaugugccuuaccucggaaaaagagaggaucagugguguggcucccugauugggcuuacaagccgcgcgaccugggcucagaacauccccacagccauucagcaaguccggucccugaucggcaaugaggaauuucucgacuacaugccuagcaugaagagauuccgcaaagaggaagagucugaaggagccauuugguga

SEQ ID NO: 20525 - RNA, 9873 nt, Artificial Sequence
  derived and/or modified CDS sequence (opt5) from DENV-3__FJ898440__SS-prME
accagccugugccucaugaugauccugcccgcggcucuugccuuccaccugaccucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaucaccgaggcuauucugcccgaauauggcacacuggggcucgagugcuccccucgcaccggacuggacuucaaugagaugguccuucugacgaugaaaaacaaggccuggauggugcauagacagugguuuuucgaucucccccugccguggaccagcggcgccacaaccgaaacaccuaucuggaaucggaaagagcuucuggucaccuuuaagaacgcucacgcgaaaaagcaagaagugguugugcucgggucucaggagggagccaugcacacggcucugacaggcgccaccgaaauucaaaauuccgggggcacaagcaucuucgccggacaucugaagugucgccucaaaauggacaagcuggagcuuaaaggcaugucuuacgcuaugugcaccaacaccuuuguccugaagaaagagguguccgaaacacagcacgggacgauccucauuaagguugaguacaagggagaagaugcccccuguaaaaucccuuucagcaccgaggacggccaagggaaggcgcauaacggaagacugauuacagcuaaucccguggucaccaaaaaggaggaacccgugaacaucgaggccgaaccuccguucggcgaguccaauauugugaucgggaucggcgauaacgcccugaaaauuaauugguauaagaagggaucuagcaucggcaaaauguuugaagcuacagccagaggggcuagacgcauggccauucuuggagacaccgcgugggauuucggcuccguugggggaguccucaacagccugggcaagauggugcaccagaucuuugggucugccuacacggcucuguucuccggcgugagcugggucaugaaaauuggaaucggcgugcuccugacauggauugggcuuaauucuaagaacaccagcauguccuuuucuugcaucgccaucggaauuaucacccuguaucucggcgcuguugugcaggccgacacagggugugucauuaauuggaaaggaaaggagcugaagugcggcagcgggaucuucgugaccaacgagguucauacauggacggaacaguacaaauuucaagcggauucccccaagcggcuggccaccgcuauugccggcgcuugggagaauggaguguguggcaucagaagcacaacccgcauggaaaaccuucucuggaaacagaucgccaaugagcugaacuauauucugugggaaaauaacaucaagcucacagucgugguuggggacauuaucggagugcuggagcagggcaaacggacccuuacgccucagcccauggagcugaaguacucuuggaaaaccugggggaaggccaagauugucacagcugaaacccaaaacuccagcuucaucaucgauggaccuaauacacccgagugcccgucugcguccagagccuggaacgugugggaaguggaggacuauggcuuuggcgucuucaccacaaauauuuggcucaaacugcgcgaaguuuacacccagcugugugaccaccggcuuaugagcgcugccgugaaggaugagagagccgugcacgcugacaugggguacuggaucgagucccagaaaaacggaucuuggaagcucgaaaaagccagccugauugaggucaagacgugcacauggccuaagucccauacccuguggucuaauggcgugcucgaaagcgauaugaucauucccaaaucccuggcggggccuaucagccagcacaacuaucgccccggauaccauacccaaacagcuggcccuuggcaccuugggaagcuggagcucgacuuuaauuauugcgagggaaccacgguugugaucacagaaaacuguggcacccggggccccucucugagaacaaccacagucuccgggaaacugauucacgaguggugcugucgcagcugcacccuuccgccucuccgguacaugggagaagauggcuguugguaugggauggagaucagacccauuucugaaaaggaggagaauauggugaaaucccugguuagcgccggaucuggcaagguggacaacuucacgauggggguccugugccucgccauccuguuugaagaggugaugcggggaaaguucggcaaaaagcauaugauugcuggcguuuucuuuaccuucgugcuucugcucagcgggcagaucacauggcgcgauauggcccacacccugauuaugaucggauccaaugcgagcgacagaaugggcaugggggucacauaccuggcucuuaucgccaccuuuaaaauucagcccuuccuggcccucggauuuuuccugcggaagcucacgucuagagaaaaccugcuucugggcguggggcucgcuauggccacaacccugcaacugccugaggauaucgaacagauggcuaauggaauugcccuuggccugauggcgcucaaacugaucacacaguuugagaccuaucagcucuggaccgcccugauuucccuuacauguagcaacacgaucuucacccugacaguggcuuggcgcaccgccacacucauccuggcuggcgucucccugcuuccgguuugccaaucuagcuccaugcggaagaccgacuggcugcccaugacgguggccgccaugggggugcagccucucccccuguuuauuuucucucucaaggauacacugaaaagacgcagcuggccucuuaaugagggagucauggcugugggccugguuuccauccuggcgucuagccuccugagaaacgacgugcccauggccgggccucuugucgcuggaggccugcucauugccuguuacgugaucaccgggaccuccgccgaucugacaguugaaaaggcugccgacgugaccugggaggaagaggcggaacagacaggagucagccauaaccucaugauuacgguggacgaugacggcaccaugcggaucaaagaugacgagacagagaauauccugaccguccuucugaagacagcucugcucauugugucuggcaucuuucccuacuccauuccggccacccugcuuguuuggcacacguggcagaaacaaacccagcgcagcggggugcugugggaugucccuucucccccugaaacacagaaggccgagcucgaagagggaguguauagaaucaaacagcaaggcauuuucgggaagacccagguuggagugggcguccagaaggaggggguguuucauacaauguggcacgugacccggggagcuguucugacauacaacggcaaacgccucgaacccaauugggccuccgucaagaaagaccugaucagcuauggcgggggauggagacuuucugcgcaauggcagaagggcgaggaaguccaggugauugcugucgagccggggaaaaacccuaagaauuuccagacgaugcccggaaccuuccaaacaaccaccggcgaaaucggggccaucgcccuggauuuuaagccuggaacauccggcagccccauuaucaaccgggagggcaaagugguugggcuguacggaaauggcguggucacgaagaacgggggauauguguccggcauugcucagaccaaugccgagcccgacgggccuacaccggaacucgaggaagagauguucaaaaagcgcaaccugaccaucauggaucuucaccccggcagcggaaaaacaagaaaguaccugccugcuauuguucgggaagccaucaagcgcagacuccggacccugauccucgcgcccacgagaguggucgccgcugagauggaggaagcccugaaaggccuuccuauucgcuaucagacaaccgcuaccaagucugagcauacagggcgggaaaucguggaccugaugugccacgccaccuuuacaaugagacugcucagccccguucgcgugccuaauuacaaccugauuaucauggaugaggcccauuucaccgacccggcuuccauugcggcccggggauacaucucuacgagagucggcaugggggaagcugccgccaucuuuaugacagcuacacccccuggaacagccgaugcguucccccagagcaaugcuccuauucaagacgaggagcgcgacauccccgaacgguccuggaacucuggcaaugaguggauuaccgauuuugccgggaaaacggugugguucgugccgagcaucaaggccggcaacgacauugcuaacugucuucgcaaaaauggaaagaaggucauccagcuguccagaaaaaccuuugauacagaauaucagaagaccaaacucaacgacugggauuucguugugacaaccgacauuucugagaugggcgccaauuuuaaggcggaucgggugaucgacccuagacggugccugaaacccgucauccugacagaugggcccgagcgcgugauucucgccggaccuaugcccguuaccgcugccagcgcugcccagagacggggccgcguggggagaaacccucaaaaggaaaaugaccaguacaucuucacgggacagccgcuuaacaaugaugaggaccacgcucauuggacagaagccaagaugcugcuggacaacauuaauacccccgagggcaucauuccugcccucuucgaacccgagcgggagaaauccgccgcuaucgauggggaauauagacugaagggcgagagccgcaaaaccuuugucgaacuuaugcggagaggagaccugccuguguggcucgcccacaagguugcuucugagggcaucaaauacacagaucgcaaguggugcuucgacgggcagcggaacaaucaaauucuggaagagaacauggauguggagaucuggaccaaagaaggagagaagaagaaacugagaccccgcuggcucgacgcccggacauauuccgauccgcuugcccugaaggaauuuaaagacuucgcugcgggcagaaagagcauugcccuggaucucgucacggagaucgggcgcgugccuucucaccuggcucauagaacccggaaugcccuugacaaccuggucaugcuccacacauccgaacauggaggccgcgccuacagacacgcuguggaggagcugcccgaaaccauggagacacugcuccuucugggccugaugauucuccugaccgggggagccaugcuuuuucugaucagcggcaaagggaucggaaagacguccauuggccucaucuguguuauugcgucuagcgggaugcuguggauggccgaaaucccucugcaguggauugcuuccgccaucgugcucgaguucuuuaugauggugcuucugauucccgagccugaaaagcagcggacaccccaggauaaucagcuggcuuaugucguuaucggaauccucacacuggccgcgauuaucgccgcuaacgagaugggccuucuggaaaccaccaagaaggaccucggcaugagcaaagagccggggguggugucuccuaccuccuaccuggaugucgaccugcaccccgccagcgcuuggacgcucuacgccguggcuacaaccguuauuacacccaugcuucgccauaccaucgaaaauucuaccgccaacgugagccuggcggccauugcuaaccaggccgucgugcugaugggacucgacaagggcuggccuaucuccaaaauggaucugggggucccgcuucuggcucucggaugcuauucucaggugaauccccugacacugacggccgccguucuccuucugaucacccacuacgcgauuaucggcccugggcugcaagcuaaggccacaagagaggcucagaagcggaccgccgccggaauuaugaaaaaccccacaguggacggcaucaugaccauugaucucgacccugucaucuaugauagcaaguucgagaaacagcugggccaggugaugcuucugguucucugugcugugcaacugcugcucaugagaacguccugggcccuuugcgaagcgcugacacuggccaccgggcccaucaccacacucugggagggaucuccuggcaaguuuuggaauaccacaauugcugucagcauggccaacaucuuccgcggguccuaccuggcuggagccggccuugcguuuagcauuaugaaaucuguggggacgggaaagcggggcaccggcucccagggggaaacacugggagagaaguggaaaaagaaacucaaucagcugagcagaaaggaguucgaccuguauaaaaaguccggcaucaccgagguggaucgcacagaggccaaagaagggcucaagcggggagagauuacccaucacgcuguuucuagaggcagcgccaaacuucagugguuugucgaacggaacauggugaucccggaggggcgcgugauugaccugggauguggcagaggcgggugguccuacuauugcgcuggacugaaaaaggucacggaaguucggggcuacaccaaagggggacccggccaugaggagccugugcccaugucuacauacggguggaauaucgugaagcucaugagcggaaaagaugucuucuaucugccucccgaaaagugugacacccuucugugcgauaucggcgaguccagcccgucuccuacaguggaagagucccgcaccauuagaguucucaagaugguggagcccuggcugaaaaacaaucaauucuguaucaagguccugaaccccuacaugccuacagugauugaacaccucgagcggcuucagcgcaaacacggcgggaugcugguuagaaauccccugagccggaacucuacccaugaaauguauuggaucuccaauggaacgggcaacauuguggccagcgucaauauggugucucgccuccugcuuaacagauuuacaaugacccaccggagaccuaccaucgagaaggacguggaucugggggcuggaacacgccaugucaacgccgaaccggagacgcccaauauggacguuaucggcgagcggauuaaaagaaucaaggaagaacacaacagcaccuggcacuacgacgaugaaaauccuuauaagacaugggcguaccauggguccuaugaggugaaagccaccggaucugcuagcuccaugauuaacggcguggucaagcuccugacaaaacccugggacgugguuccuauggugacccagauggccaugacagauaccacgcccuucggccaacagcgcgucuuuaaggaaaaaguggacacccggacaccgagaagcaugccugggacccgccggguuaugggaaucacagcugaguggcuguggagaacccucggccgcaauaagaagccccggcugugcacgagagaggaguucaccaagaaggugcgcaccaacgccgccaugggggcggucuuuacagaggaaaaucagugggauuccgcuaaagccgccguggaggacgaagauuucuggaaacuuguugaccgggagagagagcugcacaaacucggaaaguguggcucuugcguguacaacaugauggggaaacgcgaaaagaagcugggcgaguuuggaaaagcuaagggcagcagagccauuugguacauguggcuuggggcucgguaucuggaguucgaggcccucggauuucugaaugaggaucauugguucucccgcgaaaacucuuacagcggcgucgagggggaaggacugcacaaacucggcuauauccugagagacaucuccaagauuccugggggcgcgauguacgccgaugacaccgcuggaugggacacgcggaucaccgaggaugaccuucauaaugaagagaaaauuacacagcaaaugaaccccgagcacagacagcuggccaaugcuaucuuuaagcucaccuaucagaacaagguggucaaagugcagcggccuacacccaccggcacaguuauggauauuaucucucgcaaggaccaaagagggagcggacaggugggcaccuacgggcugaauacguucacaaacauggaagcccagcuuauccggcagauggagggagaaggcguccuguccaaagcggaucucgagaacccgcaucugccugaaaagaaaauuacccaauggcuggagaccaaggggguggagcgccucaagagaauggccaucagcggcgacgauugcgugguuaaacccauugacgaucgguuugcuaaugcccugcuugcucugaacgacaugggaaaggugcgcaaagauaucccccaguggcagccuucuaagggcuggcaugacuggcagcaagucccguucuguucccaccauuuccacgaacucauuaugaaagaugggagaaagcuggugguucccugccggccucaggacgagcuuaucggacgcgccagaauuagccagggcgcuggguggucucugcgggaaacagccugucucggaaaggcguaugcccaaauguggucccugauguacuuucaccgcagagaccugcggcucgcuagcaaugccaucugcucugccgugcccguccauugggugccuaccucccgcacaacguggagcauccacgcucaucaccaguggaugaccacagaggauaugcugaccgucuggaacagaguguggauugaagacaaucccuggauggaggauaaaacaccuguuaccacgugggagaacgugcccuaccuuggcaagcgggaagaccaguggugugggucccugaucggccucaccagcagagccacaugggcgcagaauauuccgaccgcuauccaacagguccgcucucugauuggaaacgaggaguuccuugauuauaugccuagcaugaaacgguuuagaaaggaggaggaauccgagggcgccaucugguga

SEQ ID NO: 20526 - RNA, 9873 nt, Artificial Sequence
  derived and/or modified CDS sequence (opt5) from DENV-3__FJ898441__SS-prME
accagccugugccucaugaugauccugcccgcggcucuugccuuccaccugaccucccgggacggcgagccucggaugauuguggggaagaacgaacgcggaaagucucuccuguuuaagacggcgagcggcaucaauauguguacccuuauugcuauggaucugggggagaugugcgacgauaccgugaccuacaaguguccgcacaucaccgaaguugagcccgaagacauugauugcugguguaaccucaccuccacaugggugaccuauggaacgugcaaucaggccggcgagcaccggcgggacaagcgcucuguggcccuggcuccucauguggggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaaugguucaguaugaaaaucucaaguacacagugaucaucaccguccauacaggggaccagcaccaggugggaaacgagacgcaaggcguuaccgcugaaauuacaccucaggccucuaucaccgaggcuauucugcccgaauauggcacacuggggcucgagugcuccccucgcaccggacuggacuucaaugagaugauccuucugacgaugaaaaacaaggccuggauggugcauagacagugguuuuucgaucucccccugccguggaccagcggcgccacaaccgaaacaccuaccuggaaucggaaagagcuucuggucacguuuaagaacgcucacgcgaaaaagcaagaaguggucgugcucgggucucaggagggagccaugcacacagcucugaccggcgccacagaaauucagaauagcgggggcaccaccaucuucgccggacaucugaagugucgccucaaaauggacaagcuggagcuuaaaggcaugagcuacgcuaugugcacaaacacguuuguucugaagaaagaggugucugaaacccagcacgggacaauccucauuaaggucgaguacaagggagaagaugcccccuguaaaaucccuuucuccaccgaggacggccaagggaaggcgcauaacggaagacugauuacagcuaaucccgugguuaccaaaaaggaggaacccgugaacaucgaggccgaaccuccguucggcgagagcaauauugucaucgggaucggcgauaacgcccugaaaauuaauugguauaagaagggauccucuaucggcaaaauguuugaagcuacggccagaggggcuagacgcauggccauucuuggagacacagcgugggauuucggcagcgucgggggagugcucaacucccugggcaagaugguucaccaggucuuugggagcgccuacaccgcucuguucucuggcguguccugggugaugaaaaucggaauuggcguccuccugaccuggaucgggcuuaauagcaagaacacaucuaugagcuuuuccugcauugccaucggaaucauuacccuguaucucggcgcugugguucaggccgacacagggugugugaucaauuggaaaggaaaggagcugaagugcggcucugggauuuucgucacgaacgaggugcauaccuggacagaacaguacaaauuucaagcggauagccccaagcggcuggccaccgcuaucgccggcgcuugggagaauggaguuuguggcauuagauccacaacccgcauggaaaaccuucucuggaaacagaucgccaaugagcugaacuauauccugugggaaaauaacauuaagcucacgguggucgugggggacaucauuggaguucuggagcagggcaaacggacccuuacaccucagcccauggagcugaaguacagcuggaaaaccugggggaaggccaagaucgugacagcugaaacccaaaacucuuccuucauuaucgauggaccuaauacacccgagugcccgagcgcgucuagagccuggaacgucugggaaguggaggacuauggcuuuggcguguucaccacgaauaucuggcucaaacugcgcgaagucuacacacagcugugugaccaccggcuuauguccgcugccguuaaggaugagagagccgugcacgcugacaugggguacuggauugagagccagaaaaacggauccuggaagcucgaaaaagccucucugaucgaggugaagaccugcaccuggccuaagagccauacacugugguccaauggcguccucgaaucugauaugauuauccccaaaagccuggcggggccuauuucccagcacaacuaucgccccggauaccauacccaaacggcuggcccuuggcaccuugggaagcuggagcucgacuuuaauuauugcgagggaacaaccgugguuaucacagaaaacuguggcacccggggccccagccugagaacaaccacggugucugggaaacugauccacgaguggugcugucgcuccugcacccuuccgccucuccgguacaugggagaagauggcuguugguaugggauggagauuagacccaucagcgaaaaggaggagaauauggucaaaucucugguguccgccggaagcggcaagguugacaacuucacaaugggggugcugugccucgccauucuguuugaagaggucaugcggggaaaguucggcaaaaagcauaugaucgugggcguuuucuuuaccuucgugcuucugcucucugggcagauuacauggcgcgauauggcucacacccugaucaugauuggaagcaaugccuccgacagaaugggcaugggggucacguaccuggcgcuuaucgcuacauuuaaaauccagcccuuccuggcccucggauuuuuccugcggaagcucaccagcagagaaaaccugcuucugggcguggggcucgccauggcuacaacccugcaacugccugccgauauugagcagauggcuaauggaaucgcccuuggccugauggcgcucaaacugauuacccaguuugaaacauaucagcucuggacggcccugaucucucuuaccuguuccaacacaauuuucacccugacaguggcuuggcgcaccgccacgcucauccuggcuggcgucagccugcuuccgguuugccaauccucuagcaugcggaagacagacuggcugcccaugaccguggccgccaugggggugcagccucucccccuguuuaucuucucccucaaggauacccugaaaagacgcucuuggccucuuaaugagggagucauggcugugggccugguuagcauucuggcguccucucuccugagaaacgacgugcccauggccgggccucuugucgcuggaggccugcucaucgccuguuacgugauuacagggaccagcgccgaucugacaguugagaaggcugccgacgugacgugggaagaggaagcggagcagaccggagucucccauaaccucaugaucacaguggacgaugacggcaccaugcggauuaaagaugacgaaacagagaauauccugaccguccuucugaagacggcucugcucaucgugagcggcauuuuucccuacucuaucccggccacccugcuuguuuggcacacauggcagaaacaaacccagcgcuccggggugcugugggaugucccuucucccccugagacacagaaggccgaacucgaggaaggaguguauagaauuaaacagcaaggcaucuucgggaagacccagguuggagugggcguccagaaggaggggguguuucauacaauguggcacgugacgcggggagcuguucugaccuacaacggcaaacgccucgagcccaauugggccuccgucaagaaagaccugauuuccuauggcgggggauggagacuuagcgcgcaauggcagaagggcgaagagguccaggugaucgcugucgaaccggggaaaaacccuaagaauuuccagacaaugcccggaaccuuccaaaccacaacgggcgagauuggggccaucgcccuggauuuuaagccuggaaccucuggcucccccaucauuaaccgggaaggcaaagugguugggcuguacggaaauggcguggucacaaagaacgggggauaugugagcggcaucgcucagaccaaugccgagcccgacgggccuacaccggagcucgaagaggaaauguucaaaaagcgcaaccugaccauuauggaucuucaccccggcuccggaaaaacgagaaaguaccugccugcuaucguucgggaggccauuaagcgcagacuccggacacugauccucgcgcccaccagaguggucgccgcugaaauggaggaggcccugaaaggccuuccuauccgcuaucagaccacagcuaccaagagcgaacauacagggcgggagauuguggaccugaugugccacgccaccuuuacgaugagacugcucucucccguucgcgugccuaauuacaaccugaucauuauggaugaagcccauuucacagacccggcuagcaucgcggcccggggauacauuuccaccagagucggcaugggggaggcugccgccaucuuuaugacagcuacacccccuggaacggccgaugcguucccccagucuaaugcuccuauccaagacgaggaacgcgacauucccgagcggagcuggaacuccggcaaugaauggaucaccgauuuugccgggaaaacagugugguucgugccgucuauuaaggccggcaacgacaucgcuaacugucuucgcaaaaauggaaagaaggucauucagcugagcagaaaaaccuuugauacagaguaucagaagaccaaacucaacgacugggauuucguugugacaaccgacaucuccgaaaugggcgccaauuuuaaggcggaucgggugauugacccuagacggugccugaaacccgucauccugacggaugggcccgagcgcgugauccucgccggaccuaugcccguuacagcugccucugcugcccagagacggggccgcguggggagaaacccucaaaaggagaaugaccaguacauuuucaccggacagccgcuuaacaaugaugaagaccacgcucauuggaccgaggccaagaugcugcuggacaacaucaauacacccgaaggcauuaucccugcccucuucgagcccgaacgggagaaaagcgccgcuauugauggggaguauagacugaagggcgaaucccgcaaaaccuuugucgagcuuaugcggagaggagaccugccuguguggcucgcccacaagguugcuagcgaaggcaucaaauacacagaucgcaaguggugcuucgacgggcagcggaacaaucaaauccuggaggaaaacauggauguggagauuuggacgaaagagggagaaaagaagaaacugagaccccgcuggcucgacgcccggaccuauucugauccgcuugcccugaaggaguuuaaagacuucgcugcgggcagaaaguccaucgcccuggaucucgucacagaaauugggcgcgugccuagccaccuggcucauagaacccggaaugcccuugacaaccuggucaugcuccacacaucugagcauggaggccgcgccuacagacacgcuguggaggaacugcccgagaccauggaaacgcugcuccuucugggccugaugauccuccugaccgggggagccaugcuuuuucugauuuccggcaaagggaucggaaagacaagcaucggccucauuuguguuaucgcguccucugggaugcuguggauggccgagauuccucugcaguggaucgcuagcgccauugugcucgaguucuuuaugauggugcuucugauccccgagccugagaagcagcggacaccccaagauaaucagcuggcuuaugucguuauuggaauccucacacuggccgcgaucauugccgcuaacgaaaugggccuucuggagaccacgaaaaaggaccucggcauguccaaagaaccggggguggugagcucuacauccuaccuggaugucgaccugcacccugccagcgcuuggacccucuacgccguggcuacaaccguuaucacccccaugcuucgccauacaauugaaaauucuacggccaacgugagccuggcggccaucgcuaaccaggccgucgugcugaugggacucgacaagggcuggcccauuuccaaaauggaucugggggucccucuucuggcucucggaugcuauucucaggugaauccgcugacccugacagccgccguucuccuucugaucacccacuacgcgaucauuggccccgggcugcaagcuaaggccacaagagaagcucagaagcggaccgccgccggaaucaugaaaaacccuacgguggacggcauuaugacaaucgaucucgaccccgucauuuaugauagcaaguucgagaaacagcugggccaggugaugcuucugguucucugugcugugcaacugcugcucaugagaaccuccugggcccuuugcgaggcgcugacccuggccacagggccuaucaccacacucugggaaggaucucccggcaaguuuuggaauacgaccaucgcugucagcauggccaacauuuuccgcggguccuaccuggcuggagccggccuugcguuuagcaucaugaaaucuguggggacaggaaagcggggcaccggcucccagggggagacacugggagaaaaguggaaaaagaaacucaaucagcugagcagaaaggaguucgaccuguauaaaaaguccggcauuaccgaaguggaucgcacggaggccaaagaggggcucaagcggggagaaaucacccaucacgcuguuucuagaggcagcgccaaacuucagugguuugucgagcggaacauggugauuccugaagggcgcgugaucgaccugggauguggcagaggcgggugguccuacuauugcgcuggacugaaaaaggucacagagguucggggcuacaccaaagggggaccgggccaugaggaacccgugccuaugucuacauacggguggaauauugugaagcucaugaccggaaaagaugucuucuaucugcccccugagaagugugacacacuucugugcgauaucggcgaaagcucccccagcccgaccguggaggaaucucgcacgaucagaguucucaagaugguggagccuuggcugaaaaacaaucaauucuguauuaagguccugaaccccuacaugcccacagugaucgagcaccucgaacggcuucagcgcaaacacggcgggaugcugguuagaaauccucugucccggaacagcacccaugagauguauuggauuucuaauggaaccggcaacaucguggccuccgucaauauggugagccgccuccugcuuaacagauuuacaaugacgcaccggagacccaccauugaacgcgacguggaucugggggcuggaacacggcaugucaacgccgagccugaaaccccgaauauggacguuaucggcgagagaaucaagcgcauuaaagaggaacacaacucuacauggcacuacgacgaugagaaucccuauaagaccugggcguaccaugggagcuaugaagugaaggccacaggauccgcuucuagcaugaucaacggcguggucaaacuccugaccaagccuugggacgugguucccauggugacgcagauggccaugaccgauacaaccccuuucggccaacagcgggucuuuaaagagaagguggacacaagaacaccccgcuccaugccggggacgcggaaaguuaugggaauuacagcugaauggcuguggagaacccucggccgcaauaagaagccucggcugugcacaagagaggaguucaccaaaaaggugcgcacgaacgccgccaugggggcggucuuuaccgaagagaaucagugggauagcgcuaaagccgccguggaagacgaggauuucuggaaacuuguugaccgggaaagagagcugcacaaacucggaaaguguggcuccugcguguacaacaugauggggaaacgcgagaagaagcugggcgaauuuggaaaagcuaagggcucuagagccaucugguacauguggcuuggggcucgguaucuggaguucgaagcccucggauuucugaaugaggaucauugguucagccgcgagaacuccuacucuggcgucgaaggggagggacugcacaaacucggcuauauucugagagacaucagcacaauccccgggggcgcgauguacgccgaugacaccgcuggaugggacacacggauuaccgaagaugaccuucauaaugaggaaaagaucacacagcaaauggauccugagcacagacagcuggccaacgcuauuuuuaaacucaccuaucagaauaagguggucaaggugcagcggcccacgccuacaggcaccguuauggacaucauuucccgcaaagaucaaagagggucuggacaggugggcaccuacgggcugaacacauucaccaauauggaggcccagcuuauccggcagauggaaggagagggcguccugagcaaggcggaccucgaaaacccccaucugccggagaaaaagaucacacaauggcuggaaacgaaagggguggagcgccucaagagaauggccauuuccggcgaugacugcgugguuaagccuaucgaugaccgguuugcuaacgcccugcuugcucugaaugauaugggaaaagugcgcaaggacauuccccaguggcagcccagcaaaggcuggcaugauuggcagcaagucccuuucuguucucaccauuuccacgagcucaucaugaaggacgggagaaaacuggugguuccgugccggccccaggacgaacuuauuggacgcgccagaaucucccagggcgcuggguggagccugcgggagaccgccugucucggaaaggcguaugcccaaauguggucucugauguacuuucaccgcagagaucugcggcucgcuuccaacgccauuugcagcgccgugccuguccauugggugcccacaucucgcaccacaugguccauccacgcucaucaccaguggaugaccacggaagacaugcugaccgucuggaauagaguguggaucgaggauaacccuuggauggaagacaagacacccguuaccacaugggagaaugugccuuaccuuggcaaacgggaggaucaguggugugggagccugauuggccucaccuccagagccacgugggcgcagaacauccccacagcuauucaacagguccgcagccugaucggaaaugaagaguuccuugacuauaugccgucuaugaagcgguuuagaaaagaagaggagagcgaaggcgccauuugguga

SEQ ID NO: 20527 - RNA, 9873 nt, Artificial Sequence
  derived and/or modified CDS sequence (opt5) from DENV-3__FJ898442__SS-prME
accagccugugccucaugaugauccugcccgccgcucuugccuuccaccugaccucccgggacggcgaaccucggaugauuguggggaagaacgaacgcggaaaaucucuccuguuuaagacggcgagcggcaucaauauguguacccuuauugcuauggaucugggggaaaugugcgacgauaccgugaccuacaaauguccgcacaucaccgaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaaugguucaguaugaaaaucucaaguacacagugaucaucaccguccauacaggggaccagcaccaggugggaaacgagacgcaaggcguuaccgcugaaauuacaccucaggccucuaucaccgaggcuauucugcccgaauauggcacacuggggcucgagugcuccccucgcaccggacuggacuucaaugagaugauccuucugacgaugaaaaacaaggccuggauggugcauagacagugguuuuucgaucucccccugccguggaccagcggcgccacaaccgaaacaccuaccuggaaucggaaagagcuucuggucacguuuaagaacgcucacgcgaaaaagcaagaaguggucgugcucgggucucaggagggagccaugcacacagcucugaccggcgccacagaaauucagaauagcgggggcaccaccaucuucgccggacaucugaagugucgccucaaaauggacaagcuggagcuuaaaggcaugagcuacgcuaugugcacaaacacguuuguucugaagaaagaggugucugaaacccagcacgggacaauccucauuaaggucgaguacaagggagaagaugcccccuguaaaaucccuuucuccaccgaggacggccaagggaaggcgcauaacggaagacugauuacagcuaaucccgugguuaccaaaaaggaggaacccgugaacaucgaggccgaaccuccguucggcgagagcaauauugucaucgggaucggcgauaacgcccugaaaauuaauugguauaagaagggauccucuaucggcaaaauguuugaagcuacggccagaggggcuagacgcauggccauucuuggagacacagcgugggauuucggcagcgucgggggagugcucaacucccugggcaagaugguucaccaggucuuugggagcgccuacaccgcucuguucucuggcguguccugggugaugaaaaucggaauuggcguccuccugaccuggaucgggcuuaauagcaagaacacaucuaugagcuuuuccugcauugccaucggaaucauuacccuguaucucggcgcugugguucaggccgacacagggugugugaucaauuggaaaggaaaggagcugaagugcggcucugggauuuucgucacgaacgaggugcauaccuggacagaacaguacaaauuucaagcggauagccccaagcggcuggccaccgcuaucgccggcgcuugggagaauggaguuuguggcauuagauccacaacccgcauggaaaaccuucucuggaaacagaucgccaaugagcugaacuauauccugugggaaaauaacauuaagcucacgguggucgugggggacaucauuggaguucuggagcagggcaaacggacccuuacaccucagcccauggagcugaaguacagcuggaaaaccugggggaaggccaagaucgugacagcugaaacccaaaacucuuccuucauuaucgauggaccuaauacacccgagugcccgagcgcgucuagagccuggaacgucugggaaguggaggacuauggcuuuggcguguucaccacgaauaucuggcucaaacugcgcgaagucuacacacagcugugugaccaccggcuuauguccgcugccguuaaggaugagagagccgugcacgcugacaugggguacuggauugagagccagaaaaacggauccuggaagcucgaaaaagccucucugaucgaggugaagaccugcaccuggccuaagagccauacacugugguccaauggcguccucgaaucugauaugauuaucccccgcagccuggcggggccuauuucccagcacaacuaucggcccggauaccauacccaaacggcuggcccuuggcaccuugggaaacuggagcucgacuuuaauuauugcgagggaacaaccgugguuaucacagaaaacuguggcaccagaggccccagccugcgcacaaccacggugucugggaagcugauccacgaguggugcugucgguccugcacccuuccgccucucagauacaugggagaagauggcuguugguaugggauggagauucggcccaucagcgaaaaagaggagaauauggucaagucucugguguccgccggaagcggcaaaguugacaacuucacaaugggggugcugugccucgccauucuguuugaagaggucaugcgcggaaaguucggcaagaaacauaugaucgcuggcguguucuuuaccuucguucuucugcucucugggcagauuacauggagagauauggcccacacccugaucaugauuggaagcaaugcguccgaccggaugggcaugggggugacguaccuggcucuuaucgccacauuuaagauccagcccuuccuggcccucggauuuuuccugagaaaacucaccagccgcgaaaaccugcuucugggcgucgggcucgcuauggccacaacccugcaacugccugcugauauugagcagauggccaauggaaucgcgcuuggccugauggcccucaagcugauuacccaguuugaaacauaucagcucuggacggcucugaucucucuuaccuguuccaacacaauuuucacccugacaguggccuggcggaccgcuacgcucauccuggccggcgugagccugcuuccggucugccaauccucuagcaugagaaaaacagacuggcugcccaugaccguugccgcuaugggggugcagccucucccccuguuuaucuucucccucaaggauacccugaagcgcagaucuuggccucuuaaugagggagugauggcggucggccuggugagcauucuggccuccucucuccugcggaacgacguucccauggcugggccucuuguggccggaggccugcucaucgccuguuacgucauuacagggaccagcgcugaucugacaguggagaaagccgcggacguuacgugggaagaggaagcugagcagaccggagugucccauaaccucaugaucacagucgacgaugacggcaccaugcgcauuaaggaugacgaaacagagaauauccugaccgugcuucugaaaacggcccugcucaucgucagcggcauuuuucccuacucuaucccggccacccugcuuguguggcacacauggcagaagcaaacccagagauccgggguucugugggaugugccuucucccccugagacacagaaagcugaacucgaggaaggagucuaucggauuaagcagcaaggcaucuucgggaaaacccaggugggaguuggcgugcagaaggagggggucuuucauacaauguggcacgugacgcgcggagccgugcugaccuacaacggcaagagacucgagcccaauugggcguccguuaaaaaggaccugauuuccuauggcgggggauggcggcuuagcgcucaauggcagaaaggcgaagagguccaggugaucgccguggaaccggggaagaacccuaaaaauuuccagacaaugcccggaaccuuccaaaccacaacgggcgagauuggggccaucgcucuggauuuuaagccuggaaccucuggcucccccaucauuaaccgcgaaggcaaggucguggggcuguacggaaauggcguugugaccaagaacgggggauaugucagcggcaucgcccagaccaaugcugagcccgacgggccuacaccggagcucgaagaggaaauguucaagaaaagaaaccugaccauuauggaucuucaccccggcuccggaaagacgcggaaauaccugccugccaucgugcgcgaggcgauuaagagacggcucagaacacugauccucgcccccacccgcguuguggcugccgaaauggaggaggcucugaagggccuuccuauccgguaucagaccacagccaccaaaagcgaacauacagggagagagauugucgaccugaugugccacgccaccuuuacgaugcgccugcucucucccgugcggguuccuaauuacaaccugaucauuauggaugaagcucauuucacagacccggcgagcaucgccgcuagaggauacauuuccacccgcgugggcaugggggaggccgccgcuaucuuuaugacagccacacccccuggaacggcggaugcuuucccccagucuaaugccccuauccaagacgaggaacgggacauucccgagagaagcuggaacuccggcaaugaauggaucaccgauuuugccgggaagacagucugguucgugccgucuauuaaagcuggcaacgacaucgccaacugucuucgcaagaauggcaaaaaggugauucagcugagccggaagaccuuugauacagaguaucagaaaaccaagcucaacgacugggauuucgucguuacaaccgacaucuccgaaaugggagcgaauuuuaaagccgauagagugauugacccucggcgcugccugaagcccgugauccugacggaugggcccgagagagucauccucgcuggaccuaugcccgugacagccgcuucugccgcucagcggcgcggcagaguugggcggaacccucaaaaagagaaugaccaguacauuuucaccggacagccgcuuaacaaugaugaagaccacgcccauuggaccgaggcgaagaugcugcuggacaacaucaauacacccgaaggcauuaucccugcccucuucgagcccgaaagagaaaagagcgcugccauugauggggaguaucgccugaaaggcgaaucccggaagaccuuuguggagcuuaugagacgcggagaccugccugucuggcucgcucacaaaguggccagcgaaggcaucaaguacacagaucggaaauggugcuucgacgggcagagaaacaaucaaauccuggaggaaaacauggauguugagauuuggacgaaggagggagagaagaagaagcugcgcccccgguggcucgacgccagaaccuauucugauccgcuugcucugaaagaguuuaaggacuucgcggccggccgcaaauccaucgcucuggaucucgugacagaaauugggagagucccuagccaccuggcccaucggacccgcaaugcccuugacaaccuggugaugcuccacacaucugagcauggaggcagagcuuaccggcacgccgucgaagaacugcccgagaccauggaaacgcugcuccuucugggccugaugauccuccugaccgggggagcgaugcuuuuucugauuuccggcaaggggaucggaaaaacaagcaucggccucauuugugugaucgccuccucugggaugcuguggauggcugagauuccucugcaguggaucgccagcgcuauuguucucgaguucuuuaugauggugcuucugauccccgagccugagaagcagcgcacaccccaagauaaucagcuggccuauguggucauuggaauccucacacuggcggccaucauugcugccaacgaaaugggccuucuggagaccacgaagaaagaccucggcauguccaaggaaccggggguugugagcucuacauccuaccuggauguggaccugcacccugcuagcgccuggacccucuacgcugucgccacaaccgugaucacccccaugcuuagacauacaauugaaaauucuacggcgaacguuagccuggccgcuaucgccaaccaggcugugguccugaugggacucgacaaaggcuggcccauuuccaagauggaucugggggugccucuucuggcccucggaugcuauucucaggucaauccgcugacccugacagccgcggugcuccuucugaucacccacuacgcuaucauuggccccgggcugcaagccaaagcuacacgggaagcccagaagagaaccgccgcuggaaucaugaagaacccuacgguugacggcauuaugacaaucgaucucgaccccgugauuuaugauagcaaauucgagaagcagcugggccaggucaugcuucuggugcucugugccguucaacugcugcucaugcgcaccuccugggcgcuuugcgaggcccugacccuggcuacagggccuaucaccacacucugggaaggaucucccggcaaauuuuggaauacgaccaucgccgugagcauggcuaacauuuuccggggguccuaccuggccggagcgggccuugccuuuagcaucaugaagucugucgggacaggaaaaagaggcaccggcucccagggggagacacugggagaaaaguggaagaaaaagcucaaucagcugagccgcaaagaguucgaccuguauaagaaauccggcauuaccgaaguggaucggacggaggcuaaggaggggcucaaaagaggagaaaucacccaucacgccgugucucggggcagcgcuaaacuucagugguuuguugagcgcaacauggucauuccugaagggagagugaucgaccugggauguggccggggcgggugguccuacuauugcgccggacugaagaaagugacagagguccgcggcuacaccaaagggggaccgggccaugaagaacccguuccuaugucuacauacggguggaauauugugaaacucaugaccggaaaggauguguucuaucugcccccugagaaaugugacacacuucugugcgauaucggcgaaagcucccccagcccgaccgucgaggaaucuagaacgauccgggugcucaagaugguugagccuuggcugaagaacaaucaauucuguauuaaagugcugaaccccuacaugcccacagucaucgagcaccucgaacgccuucagagaaagcacggcgggaugcuggugcggaauccucugucccgcaacagcacccaugagauguauuggauuucuaauggaaccggcaacaucguugcuuccgugaauauggucagcagacuccugcuuaaccgguuuacaaugacgcacagacgccccaccauugaacgggacguggaucugggggccggaacaagacaugugaacgcggagccugaaaccccgaauauggacgucaucggcgagcgcaucaaacggauuaaggaggaacacaacucuacauggcacuacgacgaugagaaucccuauaaaaccugggccuaccaugggagcuaugaaguuaaggcuacaggauccgccucuagcaugaucaacggcguggugaagcuccugaccaaaccuugggacgucgugcccaugguuacgcagauggcuaugaccgauacaaccccuuucggccaacagagaguguuuaaggagaaagucgacacacgcacaccccgguccaugccggggacgagaaaggugaugggaauuacagccgaauggcuguggcgcacccucggccggaauaaaaagccuagacugugcacacgcgaggaguucaccaagaaaguucggacgaacgccgcgaugggggcuguguuuaccgaagagaaucagugggauagcgccaaggccgcugucgaagacgaggaguucuggaaacuuguggauagagagcgcgagcugcacaagcucggaaaauguggcuccugcguuuacaacaugauggggaagagagagaaaaagcugggcgaguuuggaaaggccaaaggcucucgggcuaucugguacauguggcuuggggcccgcuaucuggaguucgaggcgcucggauuucugaaugaggaccauugguucagcagagaaaacuccuacucuggcguggagggggaaggacugcacaagcucggcuauauucugcgggauaucagcacaauccccgggggcgccauguacgcugacgauaccgccggaugggacacaagaauuaccgaggacgaucuucauaaugaagagaaaaucacacagcaaauggacccugagcaccggcagcuggcuaacgccauuuuuaagcucaccuaucagaauaaagucgugaagguccagcgccccacgccuacaggcaccgugauggauaucauuuccagaaaggaccaacgggggucuggacagguuggcaccuacgggcugaacacauucaccaauauggaagcgcagcuuauccgccagauggagggagaaggcgugcugagcaaagccgaucucgagaacccccaucugccggaaaagaaaaucacacaauggcuggagacgaagggggucgagagacucaaacggauggcuauuuccggcgacgauugcguggugaagccuaucgacgaucgcuuugccaacgcucugcuugcccugaaugacaugggaaagguuagaaaagauauuccccaguggcagcccagcaagggcuggcaugacuggcagcaagugccuuucuguucucaccauuuccacgaacucaucaugaaagaugggcggaagcuggucgugccgugccgcccccaggacgagcuuauuggacgggcucggaucucccagggcgccggguggagccugcgcgaaaccgcgugucucggaaaagccuaugcucaaauguggucucugauguacuuucacagacgggaccugcgccucgccuccaacgccauuugcagcgcuguuccugugcauuggguccccacaucuagaaccacaugguccauccacgcccaucaccaguggaugaccacggagaauaugcugaccguguggaaccgggucuggaucgaagauaauccuuggauggaggacaagacacccgugaccacaugggagaacguuccuuaccuuggcaagagagaagaucaguggugugggagccugauuggccucaccucccgcgcgacgugggcucagaauauccccacagccauucaacaggugcggagccugaucggaaacgaggaguuccuugacuauaugccgucuaugaaaagauuucgcaaggaggaggaaagcgagggcgccauuugguga

SEQ ID NO: 20528 - RNA, 9873 nt, Artificial Sequence
  derived and/or modified CDS sequence (opt5) from DENV-3__FJ882575__SS-prME
accagccugugccucaugaugauccugcccgccacacuugcuuuccaccugacgucccgggacggagagccucggaugauuguggggaagaacgaacgcggaaagucucuccuguuuaagaccgccagcggcaucaauauguguacacuuauugcgauggaucugggggagaugugcgacgauaccgugacauacaaguguccgcauaucaccgaaguugagcccgaagacauugauugcugguguaaccucacauccaccugggugacguauggaaccugcaaucaggcuggcgagcacagacgggacaagcgcucuguggcccuggccccucaugucgggaugggacuggauacaagaacccagacauggaugagcgcugagggcgccuggagacagguggaaaaaguugagaccugggcucuccgccaccccggcuucacgauccuggcccuuuuucuggcgcauuacaucgggacaucccucacccagaagguggucauuuucauccugcuuaugcuggugacaccuucuaugaccaugagauguguuggagugggcaaccgggacuuugucgaagggcucagcggagccaccuggguggaugugguccuggagcacggcgggugcguuacaacgauggcuaagaauaaacccacccuggacauugagcuccagaagacagaagccacccagcuggcuacacuucgcaaacuguguaucgagggaaagauuaccaacaucacgacagauuccagaugcccuacccagggcgaagccgugcucccggaggaacaggaccagaauuauguguguaaacacaccuacgucgaucggggcugggggaacggaugcggccuguucgggaagggaagccuugugacaugcgcgaaguuucaaugucuggagcccauugagggcaaaguugugcaguaugaaaaucucaaguacaccgucaucaucacagugcauacgggggaccagcaccagguuggaaacgagacccaaggcgugacagccgaaauuaccccucaggcuucuacaaccgaggccauccugcccgaauauggcacgcuggggcucgagugcuccccucgcaccggacuggacuucaaugagaugauucuucugacaaugaaaaacaaggcuuggaugguccauagacagugguuuuucgaucucccccugccguggaccagcggcgccacaaccgaaacgccuacauggaaucggaaagagcuucuggugaccuuuaagaacgcccacgcuaaaaagcaagaagucgugguucucgggucucaggagggagcgaugcacacagcccugaccggcgcuaccgaaauccaaaauuccgggggcacaagcauuuucgccggacaucugaagugucgccucaaaauggacaagcuggagcuuaaaggcaugucuuacgccaugugcacgaacaccuuugugcugaagaaagaggucuccgaaacacagcacgggaccauccucaucaagguggaguacaagggagaagaugcucccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggcauucucaacagccugggcaagaugguucaccagaucuuugggucugcguacaccgcccuguucuccggcgucagcugggugaugaaaauuggaaucggcgugcuccugacauggauugggcuuaauucuaagaacaccagcauguccuuuucuugcaucgcuaucggaauuaucacacuguaucucggcgccgucgugcaggcugacaugggguguguuauuaauuggaaaggaaaggagcugaagugcggcagcgggaucuucgugacgaacgagguccauaccuggacagaacaguacaaauuucaagccgauucccccaagcggcuggcgaccgccauugcuggcgccugggagaauggaguguguggcaucagaagcacaacccgcauggaaaaccuucucuggaaacagaucgcuaaugagcugaacuauauucugugggaaaauaacaucaagcucacgguuguggucggggacaccauuggagugcuggagcagggcaaacggacacuuaccccucagcccauggagcugaaguacucuuggaaaacaugggggaaggccaagaucguuaccgccgaaacacaaaacuccagcuucauuaucgauggaccuaauacccccgagugcccgucugcuuccagagcguggaacgugugggaagucgaggacuauggcuuuggcguguucacgacaaauaucuggcucaaacugcgcgaaguguacacccagcugugugaccaccggcuuaugagcgccgcugucaaggaugagagagccguucacgccgacaugggguacuggauugagucccagaaaaacggaucuuggaagcucgaaaaagcuagccugaucgaggugaagaccugcacauggccuaagucccauacccuguggucuaauggcgugcucgaaagcgauaugauuauccccaaaucccuggccgggccuauuagccagcacaacuaucgccccggauaccauacgcaaacagcgggcccuuggcaccuugggaagcuggagcucgacuuuaauuauugcgagggaaccacagucgugaucaccgaaaacuguggcacacggggccccucucugagaaccacgaccguuuccgggaaacugauccacgaguggugcugucgcagcugcacacuuccgccucuccgguacaugggagaagauggcuguugguaugggauggagauuagacccaucucugaaaaggaggagaauauggugaaaucccuggucagcgcuggaucuggcaagguggacaacuucaccauggggguucugugccucgccauucuguuugaagaggugaugcggggaaaguucggcaaaaagcauaugaucgccggcgucuucuuuacauucgugcuucugcucagcgggcagauuaccuggcgcgauauggcucacacgcugaucaugauuggauccaaugccagcgacagaaugggcauggggguuacauaccuggcgcuuaucgcuaccuuuaaaauccagcccuuccuggcccucggauuuuuccugcggaagcucacaucuagagaaaaccugcuucugggcguggggcucgccauggcuaccacccugcaacugccugaggauauugaacagauggccaauggaaucgcucuuggccugauggcccucaaacugauuacacaguuugagacguaucagcucuggaccgcgcugaucucccuuacauguagcaacaccauuuucacacugaccgucgccuggcgcacggcuacacucauccuggccggcgugucccugcuuccggugugccaaucuagcuccaugcggaagaccgacuggcugcccaugaccgucgcugccauggggguuccuccccucccucuguuuaucuucucucucaaggauacacugaaaagacgcagcuggccccuuaaugagggagugauggccgugggccuggucuccauucuggcuucuagccuccugagaaacgacgugccuauggcggggccccuuguugccggaggccugcucaucgcuuguuacgugauuaccgggacauccgccgaucugacggucgaaaaggccgcugacgugaccugggaggaagaggccgaacagacaggaguuagccauaaccucaugaucaccguggacgaugacggcacaaugcggauuaaagaugacgagaccgagaauauccugacgguccuucugaagaccgcgcugcucaucgugucuggcauuuuuccguacuccaucccugcuacacugcuugucuggcacaccuggcagaaacagacacaacgcagcggggugcugugggauguucccucuccucccgaaacccagaaggccgagcucgaagagggaguguauagaauuaaacagcagggcauccuggggaagacacaagucggagugggcguucagaaggaggggguguuccauacgauguggcacgucacccggggagccgugcucacacacaacggcaaacgccuggaaccgaauugggcuuccgugaagaaagaccuuauuagcuacggcgggggauggagacugucugcccaguggcaaaagggcgaggaaguucaggucaucgcgguggagccugggaaaaaccccaagaauuuucagaccaugccuggaaccuuccagacaacgaccggcgaaauuggggcuaucgcccuggauuucaagcccggaacauccggcagccccaucauuaaccgggagggcaaaguggucgggcucuauggaaauggcgugguuaccaagaacgggggauacguguccggcaucgcccaaacaaaugcugagccugacgggccgacccccgaacuggaggaagagauguuuaaaaagcgcaaccuuacgauuauggaucugcauccuggcagcggaaaaacaagaaaguaucuccccgccaucguccgggaagcuauuaagcgcagacugcggacccucauccuggccccuaccagagugguugcggccgagauggaggaagcucuuaaaggccugcccauccgcuaccagacaaccgccacaaagucugagcacaccgggcgggaaauuguggaccugaugugccaugcuacguucacaaugagacuccugagcccuguccgcgugccgaauuauaaccuuaucauuauggaugaggcccacuuuaccgaccccgccuccaucgcugcgcggggauacauuucuacaagaguuggcaugggggaagccgcugccaucuucaugaccgccacgccucccggaaccgcugaugccuuuccucagagcaaugcgcccauccaggacgaggagcgcgacauuccggaacgguccuggaacucuggcaaugaguggaucacagauuucgcugggaaaaccgugugguuugucccuagcauuaaggccggcaacgacaucgccaacugucugcgcaaaaauggaaagaaggugauucaacucuccagaaaaacauucgauaccgaauaccagaagacaaaacugaacgacugggauuuuguggucaccacggacaucucugagaugggcgcuaauuucaaggccgaucggguuauugaccccagacggugccugaaacccgugauccucacagaugggccugagcgcgugauccuugcgggacccaugccugucaccgccgcuagcgccgcucagagacggggccgcguggggagaaacccgcagaaggaaaaugaccaauauauuuuuaccggacagccccugaacaaugaugaggaccaugcccacuggacagaagcuaagaugcugcucgacaacaucaauaccccugagggcauuauccccgcccuguucgaaccugagcgggagaaauccgcggccauugauggggaauacagacuuaagggcgagagccgcaaaacauucguugaacugaugcggagaggagaccuccccguguggcuggcucacaaggucgccucugagggcaucaaauauacggaucgcaaguggugcuuugacgggcagcggaacaaucagauccuggaagagaacauggauguggagauuuggaccaaagaaggagagaagaagaaacucagaccgcgcuggcuugacgcucggacauacuccgauccucuggcccugaaggaguucaaagacuuugccgcuggcagaaagagcaucgcgcucgaucugguuaccgagauugggcgcgugcccucucaucuugcccacagaacacggaaugcucuggacaaccucgucaugcugcauaccuccgaacacggaggccgcgccuauagacacgccguggaggagcugccugaaacgauggagacccuccuucugcugggccucaugauccugcuuacagggggagcuaugcuguuccucauuagcggcaaagggaucggaaagaccuccaucggccugauuugugucaucgccucuagcgggaugcuguggauggcggaaauuccccuccaauggaucgccuccgcuauugugcuugaguuuuucaugaugguucugcugaucccugagcccgaaaagcagcggacaccgcaggauaaucaacucgccuacguggugauuggaauccugacccuugcugccaucauugcggccaacgagaugggccugcucgaaacgacaaaacgcgaccugggcaugagcaaggagccuggggucguuucucccaccuccuaucuggauguggaccuccaucccgcuagcgccuggacacuuuacgcuguggccaccaccgucaucacaccuaugcugagacacacgauugaaaauucuaccgcuaacgugagccuggccgcgaucgccaaccaggcuguugugcucaugggacuggacaaaggcuggccgauuuccaagauggaucuuggggucccccugcucgcccugggaugcuacucucaggugaauccucugacacucaccgcugccguccuucugcugaucacacauuaugccaucauuggccccgggcuccaggcgaaagcuacccgggaggcccaaaagagaacggcugccggaaucaugaagaacccuacaguggacggcauuaugaccaucgaucuggaccccguuauuuacgauagcaaauuugagaagcagcuuggccaggugaugcugcucguccugugugccgugcagcugcuccuuaugcgcaccuccugggcucugugcgaagcccugacacucgcgaccgggccuaucacaacgcugugggagggaucuccgggcaaauucuggaauaccacaaucgccguuagcauggcuaacauuuuucggggguccuaucuugccggagcuggccuggccuucagcaucaugaagucuguggggaccggaaaaagaggcacaggcucccaaggggaaacccucggagagaaguggaagaaaaagcugaaucagcugagccgcaaagaauuugaccucuacaagaaauccggcauuacggaggucgaucggaccgaggcgaaggaagggcuuaaaagaggagagaucacacaccaugccgugucucggggcagcgcuaagcugcagugguucguggaacgcaacaugguuauucccgaggggagagucaucgaccugggauguggccggggcgggugguccuauuacugcgccggacucaagaaagugaccgaagugcgcggcuauacaaaagggggaccuggccacgaggagcccgucccuaugucuaccuacggguggaauauuguuaaacugaugagcggaaaggauguguuuuaccuucccccggaaaaaugugacacacugcucugcgauaucggcgaguccagcccuucucccaccguggaagaguccagaacgauccggguccugaagaugguggagcccuggcugaagaacaaucaguucuguauuaaaguucucaacccuuauaugcccacagugaucgaacaccuugagcgccugcaaagaaagcauggcgggaugcugguccggaauccucucagccgcaacucuacccacgaaauguacuggauuuccaauggaaccggcaacaucgugagcucuguuaauauggugagcagacugcuucugaaccgguucacaaugacgcauagacgcccgaccauugagaaagacgucgaucucggggcuggaacacggcacguggacgccgaacccgagaccccuaacauggacgugaucggcgagagaaucaagcgcauuaaagaagaacacaauuccacauggcauuaugaugacgaaaaccccuacaagaccugggcuuaucacgggucuuacgaggucaaggccacaggaagcgcguccagcaugaucaauggcguugugaaacugcugaccaagccuugggaugugguccccauggugacgcagauggccaugaccgacacaaccccguuuggccagcaacggguuuucaaagaaaagguggauacaagaaccccucgccccaugccugggacgcggaaagucaugggaauuacagcugaguggcucuggagaacccugggccgcaacaagcggcccagacuuugcacacgcgaggaauuuaccaagaaagugcggacgaaugccgcuaugggggccguuuucaccgaggaaaaccagugggacuccgccaaggcggcuguggaggaugaagaguuuuggaaacuggucgacagagagcgcgaacuccauaagcugggaaaauguggcucuugcguguauaauaugauggggaagagagagaagaaacuuggcgaguucggaaaagccaaaggcagccgggccaucugguacauguggcugggggcucgcuaccucgaguuugaggcccugggauuccugaacgaagaucacugguuuuccagagaaaauucuuauagcggcguugaaggggagggacuccauaagcugggcuacauucuucgggacaucuccaaaaucccugggggcgcuauguaugccgaugacacagcgggaugggacaccagaauuacagaagaugaccugcacaacgaggagaagaucacccagcagauggaucccgaacaccggcaacucgccaaugcuauuuucaaacugacauaccagaacaagguggucaaggugcagcgcccgaccccuacgggcacagucauggacaucauuucuagaaaagaucagcgggggagcggacaagugggcaccuaugggcuuaauaccuuuacaaacauggaggcccagcugguucgccagauggaaggagagggcgugcucuccaaggcugaccuggaaaauccccaucugcccgagaaaaagaucacccaguggcucgagacaaaaggggucgaaagacugaagcggauggccaucagcggcgaugacugcguggugaagccuauugaugaccgcuucgcgaacgcccuucuggcucucaacgauaugggaaaaguuagaaaggacaucccgcaauggcagcccucuaaaggcuggcacgauuggcaacaggugccuuuuuguucccaucacuuccacgagcugauuaugaaggacgggcggaaacuugucgugcccugccgcccucaagacgaacugaucggacgggcccggauuagccagggcgcuggguggucucuccgcgagacggccugucugggaaaggcuuacgcccagauguggucccugauguauuuccauagacgggaucuccgccuggcgagcaaugccaucugcucugcuguucccgugcacugggucccuaccuccagaacaaccuggagcauucaugcccaccaucaauggaugacaaccgaagacaugcuuacgguguggaaccgggucuggaucgaggauaaucccuggauggaggacaagaccccggugacaaccugggaaaacguuccuuaccugggcaaaagagaggaucaguggugugggucccucaucggccugacaagccgcgccaccugggcucagaauauucccacggccauccagcaagugcggucucuuauuggaaacgaagaguuucuggacuacaugccuagcaugaagagauuccgcaaagaggaagaguccgaaggcgcgaucugguga

SEQ ID NO: 20529 - RNA, 9873 nt, Artificial Sequence
  derived and/or modified CDS sequence (opt5) from DENV-3__GQ199886__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggauggggcuuaauucuaagaacacaagcauguccuuuucuugcaucgcuauuggaaucaucacccuguaucucggcgccguugugcaggcugacauggggugugucauuaauuggaaaggaaaggagcugaagugcggcagcgggaucuucgugacaaacgagguucauacguggaccgaacaguacaaauuucaagccgauucccccaagcggcuggcgacagccauugcuggcgccugggagaauggaguguguggcaucagaagcaccacacgcauggaaaaccuucucuggaaacagauugcuaaugagcugaacuauauccugugggaaaauaacaucaagcucaccgucgugguuggggacacgauuggagugcuggagcagggcaaacggacccuuacaccucagcccauggagcugaaguacucuuggaaaaccugggggaaggccaagaucgucacagccgaaacccaaaacuccagcuucauuaucgauggaccuaauacacccgagugcccgucugcuuccagagcguggaacgugugggaaguggaggacuauggcuuuggcgucuucaccacgaauauuuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugaucgaggucaagaccugcaccuggccuaagucccauacacuguggucuaauggcgugcucgaaagcgauaugauuauccccaaaucccuggccgggccuauuagccagcacaacuaucgccccggauaccauacccaaacggcgggcccuuggcaccuugggaagcuggagcucgacuuuaauuauugcgagggaacaaccguugugaucacagaaaacuguggcacccggggccccucucugagaacaaccacggucuccgggaaacugauucacgaguggugcugucgcagcugcacccuuccgccucuccgguacaugggagaagauggcuguugguaugggauggagaucagacccaucucugaaaaggaggagaauauggugaaaucccugguuagcgcuggaucuggcaagguggacaacuucacaauggggguccugugccucgccauucuguuugaagaggugaugcggggaaaguucggcaaaaagcauaugaucgccggcguuuucuuuaccuucgugcuucugcucagcgggcagauuacauggcgcgauauggcucacacccugaucaugauuggauccaaugccagcgacagaaugggcaugggggucacguaccuggcgcuuaucgcuacauuuaaaauucagcccuuccuggcccucggauuuuuccugcggaagcucaccucuagagaaaaccugcuucugggcguggggcucgccauggcuacaacccugcaacugccugaggauaucgaacagauggccaauggaaucgcucuuggccugauggcccucaaacugauuacccaguuugagacauaucagcucuggacggcgcugaucucccuuaccuguagcaacacaauuuucacccugacaguggccuggcgcaccgcuacgcucauccuggccggcgucucccugcuuccgguuugccaaucuagcuccaugcggaagacagacuggcugcccaugaccguggcugccaugggggugccuccccucccucuguuuauuuucucucucaaggauacccugaaaagacgcagcuggccccuuaaugagggagucauggccgugggccugguuuccauccuggcuucuagccuccugagaaacgacgugccuauggcggggccccuugucgccggaggccugcucaucgcuuguuacgugauuacagggaccuccgccgaucugacaguugaaaaggccgcugacgugacgugggaggaagaggccgaacagaccggagucagccauaaccucaugaucacaguggacgaugacggcaccaugcggauuaaagaugacgagacagagaauauccugaccguccuucugaagacggcgcugcucauugugucuggcaucuuuccguacuccaucccugcuacccugcuuguuuggcacacauggcagaaacagacccaacgcagcggggugcugugggauguccccucuccucccgaaacacagaaggccgagcucgaagagggaguguauagaauuaaacagcagggcaucuucgggaagacccaaguuggagugggcguccagaaggaggggguguuucauacaauguggcacgugacgcggggagccguucugaccuacaacggcaaacgccucgaaccgaauugggcuuccgucaagaaagaccugauuagcuauggcgggggauggagacuuucugcccaguggcaaaagggcgaggaagugcaggugaucgcggucgagccugggaaaaaccccaagaauuuccagacaaugccuggaaccuuccagaccacaacgggcgaaauuggggcuaucgcccuggauuuuaagcccggaaccuccggcagccccauuaucaaccgggagggcaaagugguugggcuguacggaaauggcguggucacaaagaacgggggauauguguccggcaucgcccaaaccaaugcugagccugacgggccgacacccgaacucgaggaagagauguucaaaaagcgcaaccugaccauuauggaucuucacccuggcagcggaaaaacgagaaaguaccugcccgccaucguucgggaagcuauuaagcgcagacuccggacacugauccucgccccuaccagaguggucgcggccgagauggaggaagcucugaaaggccuucccauucgcuaucagaccacagccaccaagucugagcauacagggcgggaaaucguggaccugaugugccacgcuaccuuuacgaugagacugcucagcccuguucgcgugccgaauuacaaccugaucauuauggaugaggcccauuucacagaccccgccuccaucgcugcgcggggauacauuucuaccagagucggcaugggggaagccgcugccaucuuuaugacagccaccccucccggaacggcugaugccuucccucagagcaaugcgcccauucaggacgaggagaaagacaucccggaacgcuccuggaacucuggcaaugaguggaucaccgauuuugcugggaagacagugugguucgugccuagcauuaaagccggcaacgacaucgccaacugucuucggaagaauggaaagaaagucauucaacuguccagaaagaccuuugauacagaauaucagaaaaccaagcucaacgacugggauuucguugugacaaccgacaucucugagaugggcgcuaauuuuaaagccgaucgcgugauugacccccggagaugccugaagcccgucauccugacggaugggccugagcgggugauucucgcgggacccaugccuguuacagccgcuagcgccgcucagcgcagaggccggguggggcgcaacccgcagaaggaaaaugaccaauacaucuucaccggacagccccuuaacaaugaugaggaccacgcccauuggaccgaagcuaaaaugcugcuggacaacaucaauacaccugagggcauuauccccgcccucuucgaaccugagagagagaaguccgcggccauugauggggaauaucggcugaaaggcgagagcagaaagaccuuugucgaacuuaugcgccggggagaccugcccguguggcucgcucacaaaguugccucugagggcaucaaguacacagauagaaaauggugcuucgacgggcagcgcaacaaucagauucuggaagagaacauggauguggagaucuggacgaaggaaggagagaagaaaaagcugcggccgagauggcucgacgcucgcaccuauuccgauccucuugcccugaaagaauuuaaggacuucgccgcuggccggaaaagcaucgcgcuggaucucgucacagagauugggagagugcccucucaccuggcccaucgcaccagaaaugcucuugacaaccuggucaugcuccacacauccgaacauggaggccgggccuaccgccacgccguggaggagcugccugaaaccauggagacgcugcuccuucugggccugaugauccuccugaccgggggagcuaugcuuuuucugauuagcggcaaggggaucggaaagacauccauuggccucaucuguguuaucgccucuagcgggaugcuguggauggcggaaauuccccugcaauggaucgccuccgcuauugugcucgaguucuuuaugauggugcuucugaucccugagcccgaaaaacagagaaccccgcaggauaaucaacuggccuaugucguuauuggaauccucacacuggcugccauuaucgcggccaacgagaugggccuucuggaaaccacgaagcgggaccucggcaugagcaaagagccugggguggugucucccacauccuaccuggaugucgaccugcaccccgcuagcgccuggacccucuacgcuguggccacaaccguuaucaccccuaugcuucgccauacaauugaaaauucuacggcuaacgugagccuggccgcgaucgccaaccaggcugucgugcugaugggacucgacaagggcuggccgauuuccaaaauggaucugggggucccccuucuggcccucggaugcuauucucaggugaauccucugacccugacagcugccguucuccuucugaucacccacuacgccauuaucggccccgggcugcaggcgaaggcuacaagagaggcccaaaagcggaccgcugccggaaucaugaaaaacccuacgguggacggcauuaugacaaucgaucucgaccccgucauuuaugauagcaaguucgagaaacagcugggccaggugaugcuucugguucucugugccgugcagcugcugcucaugagaaccuccugggcucuuugcgaagcccugacccuggcgacagggccuaucaccacacucugggagggaucuccgggcaaguuuuggaauacgaccauugccgucagcauggcuaacaucuuccgcggguccuaccuggccggagcuggccuugccuuuagcaucaugaaaucuguggggacaggaaagcggggcaccggcucccaaggggaaacacugggagagaaguggaaaaagaaacucaaucagcugagcagaaaggaauucgaccuguauaaaaaguccggcauuaccgagguggaucgcacggaggcgaaagaagggcucaagcggggagagaucacccaucacgccguuucuagaggcagcgcuaagcuucagugguuugucgaacggaacauggugauucccgaggggcgcgugaucgaccugggauguggcagaggcgggugguccuacuauugcgccggacugaaaaaggucacagaaguucggggcuacaccaaagggggaccuggccaugaggagcccgugccuaugucuacauacggguggaauauugugaagcucaugagcggaaaagaugucuucuaucugcccccggaaaagugugacacccuucugugcgauaucggcgaguccagcccuucucccacaguggaagagucccgcaccauuagaguucucaagaugguggagcccuggcugaaaaacaaucaguucuguaucaagguccugaacccuuacaugcccacggugaucgaacaccucgagcggcuucaacgcaaacacggcgggaugcugguuagaaauccucugagccggaacucuacacaugaaauguauuggauuuccaauggaaccggcaacaucguggcuagcgucaauauggugucucgccuccugcuuaacagauuuaccaugacacaccggagaccgacgauugagaaggacguggaucugggggccggaacccgccaugucaacgcugaacccgagacaccuaauauggacguuaucggcgagcggauuaaaagaaucaaggaagagcacaacagcaccuggcacuacgacgaugaaaaucccuauaagacaugggccuaccauggguccuaugaggugaaagcgaccggaucugccagcuccaugaucaacggcguggucaagcuccugacaaaaccuugggacgugguucccauggugacccagauggcuaugacggauaccacaccguucggccagcaacgcgucuuuaaggaaaaaguggacacccggacaccuagaagcaugcccgggacccgccggguuaugggaauuacggccgaguggcuguggagaacacucggccgcaauaagaagccucggcugugcaccagagaggaauucacaaaaaaggugcgcaccaacgcugccaugggggccgucuuuacggaggaaaaucagugggauuccgcgaaagcugccguggaggacgaagauuucuggaagcuuguugaccgggagagagagcugcacaaacucggaaaguguggcucuugcguguacaacaugauggggaaacgcgaaaagaagcugggcgaguuuggaaaagccaagggcagcagagcuaucugguacauguggcuuggggcccgguaucuggaauucgaggcucucggauuucugaaugaggaucauugguucucccgcgaaaacucuuacagcggcgucgagggggaaggacugcacaaacucggcuauauucugagagacaucuccaagauucccgggggcgccauguacgcggaugacaccgccggaugggacacacggaucaccgaggaugaccuucauaaugaagagaaaaucacacagcagauggauccugagcacagacaacuggcuaacgccauuuuuaagcucaccuaucagaauaagguggucaaagugcagcggcccacaccgaccggcacgguuauggacaucauuucucgcaaggaucagagagggagcggacaagugggcacauacgggcugaacaccuucaccaauauggaagcucagcuuauccggcagauggagggagaaggcguccuguccaaagccgaccucgagaacccucaccugcccgaaaagaaaauuacacaguggcuggagaccaaggggguggagcgccucaagagaauggcgaucagcggcgaugacugcgugguuaaacccaucgaugaccgguuugccaacgcucugcuugcccugaaugauaugggaaaggugcgcaaagacauuccucaauggcagccgucuaagggcuggcaugauuggcagcagguccccuucuguucccaccauuuccacgaacucaucaugaaagacgggagaaagcuggugguuccuugccggccccaagacgagcuuauuggacgcgcuagaaucagccagggcgccggguggucucugcgggaaacagcuugucucggaaaggccuaugcgcagauguggucccugauguacuuucaccgcagagaucugcggcucgccagcaacgcuauuugcucugccgugccuguccauugggugcccacgucccgcaccacauggagcauccacgcccaucaccaauggaugaccacagaggacaugcugaccgucuggaauagaguguggauugaagauaacccuuggauggaggacaaaacgcccguuaccacaugggagaaugugccguaccuuggcaagcgggaagaucaguggugugggucccugaucggccucaccagcagagcuacaugggcccagaacaucccuaccgcgauucagcaaguccgcucucugaucggaaaugaggaauuccuugacuauaugcccagcaugaaacgguuuagaaaggaggaggaauccgagggcgcuauuugguga

SEQ ID NO: 20530 - RNA, 9873 nt, Artificial Sequence
  derived and/or modified CDS sequence (opt5) from DENV-3__FJ882576__SS-prME
acaagccugugccucaugaugauccugcccgccgcucuugccuuccaccugacaucccgggacggcgagccucggaugauuguggggaagaacgagcgcggaaagucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuauggcuaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccaaaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucaccaagaaggaggaacccgugaacauugaggccgaaccuccguucggcgaguccaauaucgugauugggaucggcgauaacgcccugaaaaucaauugguauaagaagggaucuagcauuggcaaaauguuugaagcuaccgccagaggggcuagacgcauggccauccuuggagacacggcgugggauuucggcuccguugggggaguccucaacagccugggcaagauggugcaccagauuuuugggucugccuacacagcucuguucuccggcgugagcugggucaugaaaaucggaauuggcgugcuccugaccuggaucgggcuuaauucuaagaacaccagcauguccuuuucuugcauugccaucggaaucauuacacuguaucucggcgcuguugugcaggccgacauggggugugucaucaauuggaaaggaaaggagcugaagugcggcagcgggauuuucgugaccaacgagguucauacauggacggaacaguacaaauuucaagcggauucccccaagcggcuggccaccgcuaucgccggcgcuugggagaauggaguguguggcauuagaagcacaacccgcauggaaaaccuucucuggaaacagaucgccaaugagcugaacuauauccugugggaaaauaacauuaagcucacagucgugguuggggacaucauuggagugcuggagcagggcaaacggacccuuacgccucagcccauggagcugaaguacucuuggaaaaccugggggaaggccaagaucgucacagcugaaacccaaaacuccagcuucauuaucgauggaccuaauacacccgagugcccgucugcguccagagccuggaacgugugggaaguggaggacuauggcuuuggcgucuucaccacaaauaucuggcucaaacugcgcgaaguuuacacccagcugugugaccaccggcuuaugagcgcugccgugaaggaugagagagccgugcacgcugacaugggguacuggauugagucccagaaaaacggaucuuggaagcucgaaaaagccagccugaucgaggucaagacgugcacauggccuaagucccauacccuguggucuaauggcgugcucgaaagcgauaugauuauccccaaaucccuggcggggccuauuagccagcacaacuaucgccccggauaccauacccaaacagcuggcccuuggcaccuugggaagcuggagcucgacuuuaauuauugcgagggaaccacgguugugaucacagaaaacuguggcacccggggccccucucugagaacaaccacagucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgccggaucuggcaagguggacaacuucacgauggggguccugugccucgccauucuguuugaagaggugaugcggggaaaguucggcaaaaagcauaugaucgcuggcguuuucuuuaccuucgugcuucugcucagcgggcagauuacauggcgcgauauggcccacacccugaucaugauuggauccaaugcgagcgacagaaugggcaugggggucacauaccuggcucuuaucgccaccuuuaaaauccagcccuuccuggcccucggauuuuuccugcggaagcucacgucuagagaaaaccugcuucugggcguggggcucgcuauggccacaacccugcaacugccugaggauauugaacagauggcuaauggaaucgcccuuggccugauggcgcucaaacugauuacacaguuugagaccuaucagcucuggaccgcccugaucucccuuacauguagcaacacgauuuucacccugacaguggcuuggcgcaccgccacacucauccuggcuggcgucucccugcuuccgguuugccaaucuagcuccaugcggaagaccgacuggcugcccaugacgguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuugucgcuggaggccugcucaucgccuguuacgugauuaccgggaccuccgccgaucugacaguugaaaaggcugccgacgugaccugggaggaagaggcggaacagacaggagucagccauaaccucaugaucacgguggacgaugacggcaccaugcggauuaaagaugacgagacagagaauauccugaccguccuucugaagacagcucugcucaucgugucuggcauuuuuccguacuccaucccugccacccugcuuguuuggcacacguggcagaaacagacccaacgcagcggggugcugugggauguccccucuccucccgaaacacagaaggccgagcucgaagagggaguguauagaauuaaacagcagggcaucuucgggaagacccaaguuggagugggcguccagaaggaggggguguuucauacaauguggcacgugacccggggagcuguucuggccuacaacggcaaacgccucgaaccgaauugggcguccgucaagaaagaccugauuagcuauggcgggggauggagacuuucugcucaguggcaaaagggcgaggaaguccaggugaucgccgucgagccugggaaaaaccccaagaauuuccagacaaugccuggaacguuccagaccacaaccggcgaaauuggggccaucgcucuggauuuuaagcccggaaccuccggcagccccaucauuaaccgggagggcaaagugguugggcuguacggaaauggcguggucacaaagaacgggggauauguguccggcaucgcccaaacgaaugcugagccugacgggccgacccccgaacucgaggaagagauguucaaaaagcgcaaccugacaauuauggaucuucacccuggcagcggaaaaaccagaaaguaccugcccgccaucguucgggaagcgauuaagcgcagacuccggacacugauccucgccccuaccagaguggucgcugccgagauggaggaagcucugaaaggccuucccauccgcuaucagacgacagccaccaagucugagcauaccgggcgggaaauuguggaccugaugugccacgccacauuuaccaugagacugcucagcccuguucgcgugccgaauuacaaccugaucauuauggaugaggcucauuucacagaccccgcguccaucgccgcucggggauacauuucuaccagagucggcaugggggaagccgccgcuaucuuuaugacggccacaccucccggaaccgcggaugcuuucccucagagcaaugcccccauccaggacgaggagcgcgacauuccggaacgguccuggaacucuggcaaugaguggaucacagauuuugccgggaaaaccgugugguucgugccuagcauuaaggcuggcaacgacaucgccaacugucuucgcaaaaauggaaagaaggucauucaacuguccagaaaaacguuugauaccgaauaucagaagacaaaacucaacgacugggauuucguugugaccacagacaucucugagaugggcgcgaauuuuaaggccgaucgggugauugaccccagacggugccugaaacccgucauccugaccgaugggccugagcgcgugauccucgcuggacccaugccuguuacagccgcuagcgccgcucagagacggggccgcguggggagaaacccgcagaaggaaaaugaccaauacauuuucaccggacagccccuuaacaaugaugaggaccacgcccauuggacggaagcgaagaugcugcuggacaacaucaauacaccugagggcauuauccccgcccucuucgaaccugagcgggagaaauccgcugccauugauggggaauauagacugaagggcgagagccgcaaaaccuuugucgaacuuaugcggagaggagaccugcccguguggcucgcucacaagguugccucugagggcaucaaauacaccgaucgcaaguggugcuucgacggggaacggaacaaucagauccuggaggagaacauggauguggaaauuuggacaaaagagggagaaaagaagaaacugagaccgcgcuggcucgacgcccggaccuauuccgauccucuugcucugaaggaguuuaaagacuucgcggccggcagaaagagcaucgcucuggaucucgucacagaaauugggcgcgugcccucucaccuggcccauagaacgcggaaugcccuugacaaccuggucaugcuccacaccuccgagcauggaggccgcgcuuacagacacgccguggaggaacugccugagacaauggaaacccugcuccuucugggccugaugauccuccugacagggggagcgaugcuuuuucugauuagcggcaaagggaucggaaagaccuccaucggccucauuuguguuaucgccucuagcgggaugcuguggauggcugagauuccccugcaguggaucgccuccgcuauugugcucgaguucuuuaugauggugcuucugaucccugaacccgagaagcaacggacgccgcaggauaaucagcuggccuaugucguuauuggaauccucacccuggcggccaucauugcugccaacgaaaugggccuucuggagacaaccaaacgcgaccucggcaugagcaaggaaccugggguggugucucccacauccuaccuggaugucgaccugcaccccgcuagcgccuggacccucuacgcuguggccacgacaguuaucaccccuaugcuuagacauacaauugaaaauucuaccgcgaacgugagccuggccgcuaucgccaaccaagcugucgugcugaugggacucgacaaaggcuggccgauuuccaagauggaucugggggucccccuucuggcccucggaugcuauucucaggugaauccucugacccugacagccgcgguucuccuucugaucacgcacuacgcuaucauuggccccgggcugcaggccaaagcuacccgggaggcccagaagagaacagccgcuggaaucaugaagaacccuaccguggacggcauuaugacaaucgaucucgaccccgucauuuaugauagcaaauucgaaaagcaacugggccaggugaugcuucugguucucugugccgugcagcugcugcucaugcgcaccuccugggcgcuuugcgaggcccugacgcuggcuacagggccuaucaccacccucugggaaggaucuccgggcaaauuuuggaauacaaccaucgccgucagcauggcuaacauuuuccggggguccuaccuggccggagcgggccuugccuuuagcaucaugaagucuguggggacaggaaaaagaggcacgggcucccagggggagacccugggagaaaaguggaagaaaaagcucaaucaacugagccgcaaagaguucgaccuguauaagaaauccggcauuacagagguggaucggaccgaagcuaaggaggggcucaaaagaggagaaaucacacaucacgccguuucucggggcagcgcuaaacuucagugguuugucgagcgcaacauggugauucccgaagggagagugaucgaccugggauguggccggggcgggugguccuacuauugcgccggacugaagaaagucaccgagguucgcggcuacacgaaagggggaccuggccaugaggaacccgugccuaugucuaccuacggguggaauauugugaaacucaugagcggaaaggaugucuucuaucugcccccggagaaaugugacacacuucugugcgauaucggcgaauccagcccuucucccaccguggaggaguccagaacaauccggguucucaagaugguggaacccuggcugaagaacaaucaguucuguauuaaaguccugaacccuuacaugcccaccgugaucgagcaccucgaacgccuucagagaaagcacggcgggaugcugguucggaauccucugagccgcaacucuacacaugagauguauuggauuuccaauggaaccggcaacaucgugagcucugucaauauggugagcagacuccugcuuaaccgguuuacgaugacacacagacgcccgaccauugaaaaagacguggaucugggggcuggaacccggcaugucaacgccgagcccgagacaccuaauauggacguuaucggcgaaagaaucaagcgcauuaaagaggaacacaacuccacguggcacuacgacgaugagaaucccuauaagaccugggcguaccaugggucuuaugaagugaaggccacaggaagcgcuuccagcaugaucaacggcguggucaaacuccugaccaagccuugggacgugguucccauggugacacaaauggccaugaccgauacaaccccguucggccagcagcgggucuuuaaagagaagguggacacgagaaccccucgcuccaugcccgggacacggagaguuaugggaauuaccgcugaguggcuguggcgcacacucggccggaauaaaaagccuagacugugcacccgcgaagaguucacgaagaaagugcggacaaacgccgccaugggggcggucuuuaccgaagagaaucaaugggauucugcuaaggccgccguggaagacgaggauuucuggaaacuuguugacagagagcgcgaacugcacaagcucggaaaauguggcagcugcguguacaacaugauggggaagagagagaaaaagcugggcgaauuuggaaaggcuaaaggcucccgggccaucugguacauguggcuuggggcucgcuaucuggaguucgaggcccucggauuucugaaugaagaucauugguucucuagagagaacagcuacuccggcgucgaaggggagggacugcacaagcucggcuauauucugcgggacaucucuaaaauccccgggggcgcgauguacgccgaugacacagcuggaugggacaccagaauuacggaagaugaccuucauaaugaggagaagaucacccagcagauggauccugaacaccggcagcuggccaacgcuauuuuuaaacucacauaucaaaauaagguggucaaggugcagcgccccaccccgacaggcaccguuauggacaucauuagcagaaaagaucagcggggguccggacaggugggcacauacgggcugaacaccuucacgaauauggaggcccaacuuauccgccagauggaaggagagggcguccugagcaaggcggaccucgaaaacccucaucugcccgagaaaaagaucacacaguggcuggagaccaaagggguggaaagacucaagcggauggccauuucuggcgaugacugcgugguuaagcccaucgaugaccgcuuugcuaacgcccugcuugcucugaaugauaugggaaaagugagaaaggacauuccucaguggcaaccguccaaaggcuggcaugauuggcagcagguccccuucuguagccaccauuuccacgagcucaucaugaaggacgggcggaaacuggugguuccuugccgcccccaggacgaacuuauuggacgggcccggaucucucaaggcgcuggguggucccugcgcgagaccgccugucucggaaaggcguaugcccagauguggagccugauguacuuucacagacgggaucugcgccucgcuucuaacgccauuugcuccgccgugccuguccauugggugcccacaagcagaaccacaugguccauccacgcucaucaccaguggaugacgaccgaagacaugcugacagucuggaaucggguguggaucgaggauaacccuuggauggaggacaagacccccguuacaaccugggaaaaugugccguaccuuggcaaaagagaggaucaauggugugggagccugauuggccucacgucucgcgccaccugggcgcagaacaucccuacagcuauucagcagguccggagccugaucggaaaugaagaguuccuugacuauaugcccuccaugaagagauuucgcaaagaggaagagucugaaggcgccauuugguga

SEQ ID NO: 20531 - RNA, 9873 nt, Artificial Sequence
  derived and/or modified CDS sequence (opt5) from DENV-3__FJ850052__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcucggggggccagacgcauggcuauccuuggagacaccgccugggauuucggcuccguggggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaaaaggccgcugacaucacaugggaggaagaggccgaacagacgggcgugucccacaaccucaugauuaccgucgacgaugacggcacaaugcggaucaaagaugacgagaccgagaauauccugacagugcuucugaagaccgcgcugcucauugucagcgggaucuuuccguacucuauuccugcuacgcugcuuguguggcauaccuggcagaaacagacacaacgcuccggaguucugugggaugugcccagcccucccgaaacccagaaggccgagcucgaagagggcgucuacagaaucaaacagcaggggauuuucggaaagacacaagugggcguuggggugcagaaggagggagucuuucacaccauguggcacgugacacggggcgccgugcugacguauaacggcaaacgccucgaaccgaauugggcuucuguuaagaaagaccugaucuccuacgggggaggcuggagacuuagcgcccaguggcaaaagggggaggaaguccaggugauugcgguggagccuggaaaaaaccccaagaauuuccagaccaugccuggcacauuccagaccaccacaggggaaaucggagcuaucgcccuggauuuuaagcccggcacgucuggcucccccauuaucaaccgggaggggaaagucgugggacuguauggcaaugggguugugaccaagaacggaggcuacgucagcgggauugcccaaacaaaugcugagccugacggcccgacccccgaacucgaggaagagauguucaaaaagcgcaaccugacaaucauggaucuucauccuggauccggcaaaaccagaaaguaucugcccgccauugugcgggaagcuaucaagcgcagacuccggacgcugauccucgccccuacaagaguuguggcggccgagauggaggaagcucugaaagggcuucccauucgcuaccagaccaccgccacaaagagcgagcacaccggacgggaaaucgucgaccugaugugccaugcuacauuuaccaugagacugcucucuccugugcgcguuccgaauuauaaccugauuaucauggaugaggcccacuucacggaccccgccagcauugcugcgcggggcuacaucuccacaagaguggggaugggagaagccgcugccaucuuuaugaccgccacaccucccggcaccgcugaugccuucccucagucuaaugcgcccauucaggacaaagagcgcgacaucccggagcggagcuggaacuccgggaaugaauggauuacggauuuugcuggcaagaccgucugguucgugccuucuaucaaagccggaaacgacauugccaacugucuuagaaagaauggcaagaaagugauccaacugagccgcaagacauuugauaccgaguaccagaaaacaaagcucaacgacugggauuucgucguuaccacagacauuuccgaaaugggggcuaauuuuaaagccgaucgggugaucgaccccagacggugccugaagcccgugauccugaccgauggaccugagcgcgucauucucgcgggccccaugccugugacggccgcuucugccgcucagagacgggggcgcguuggaagaaacccgcagaaggagaaugaccaauauaucuucacaggccagccccuuaacaaugaugaagaccaugcccacuggaccgaggcuaaaaugcugcuggacaacauuaauaccccugaagggaucauucccgcccucuucgagccugaacgggagaagagcgcggccaucgauggcgaguacagacugaaaggagaaucccgcaagacauuuguggagcuuaugcggagaggcgaccugcccgucuggcucgcucacaaaguggccagcgaagggaucaaguauaccgaucgcaaauggugcuucgacggacagcggaacaaucagauucuggaggaaaacauggauguugagaucuggacaaaggagggcgaaaagaaaaagcugagaccgcgcuggcucgacgcucggacguacucugauccucuugcccugaaagaguuuaaggaauucgccgcugggagaaaauccauugcgcuggaccucgugaccgagaucggacgcguccccagccaucuggcccacagaacacggaaugcucuugauaaccuggugaugcuccauaccucugaacacggcggccgcgccuauagacacgccgucgaggagcugccugaaacaauggagacccugcuccuucuggggcugaugauucuccugacgggaggcgcuaugcuuuuucugaucuccgggaagggaaucggcaagaccagcauugggcucaucugugugauugccuccucuggaaugcuguggauggcggaaaucccccugcaauggauugccagcgcuaucguucucgaguucuuuaugauggugcuucugauuccugagcccgaaaaacagcggacaccgcaggacaaucaacuggccuacguggucaucggcauccucacccuggcugccauuaucgcggccaacgagaugggccuucuggaaacaaccaagcgcgaucucgggauguccaaagagccuggaguugugagccccacgucuuaucuggacguggaucugcaucccgcuuccgccuggacacucuacgcugucgccaccacagugauuaccccuaugcuuagacacaccaucgaaaauagcacagcuaacguuucucuggccgcgauugccaaccaggcugugguccugaugggccucgacaagggguggccgaucagcaaaauggaccugggagugccccuucuggcccucggcugcuacucccaggucaauccucugacgcugaccgcugccgugcuccuucugaucacacauuaugccauuaucgggcccggacugcaggcgaaggcuacccgggaggcccaaaagagaacagcugccggcauuaugaaaaacccuaccguugauggcaucaugacgauugaccucgaucccgugaucuacgacucuaaguucgagaaacagcuggggcaggucaugcuucuggugcucugugccguucagcugcugcucaugcgcacaagcugggcucuuugcgaagcccugacccuggcgaccggaccuaucacaacccucugggagggcuccccggggaaguuuuggaauacaacgauugccgugucuauggcuaacaucuuccggggaagcuaucuggccggcgcugggcuugccuuuuccauuaugaaaagcgucggaaccggcaagagaggcacagggucucaaggagaaacccugggcgagaaguggaaaaagaaacucaaucagcugucccgcaaggauuucgaccuguacaaaaagagcgggaucacagaaguggaucggaccgaggcgaaagagggacucaagagaggcgaaauuacgcaccaugccgugucccgggggucugcuaagcuucagugguuuguugagcgcaacauggucauccccgaaggaagagugauugaccugggcuguggccgggggggauggagcuauuacugcgccggccugaaaaaggugaccgagguccgcggguauacaaaaggaggcccugggcacgaagagcccguuccuauguccaccuacggauggaauaucgugaagcucaugucuggcaaagauguguucuaccugcccccggagaagugugacacacuucugugcgauaucggcgaaagcuccccuagccccaccgucgaggaaucuagaacaauucgggugcucaagaugguugagcccuggcugaaaaacaaucaguucuguaucaaggugcugaacccuuauaugcccaccgucauugagcaccucgaacgccuucaaagaaaacaugggggaaugcuggugcggaauccucugucccgcaacagcacgcacgagauguacuggaucucuaauggcacagggaacauuguugcuuccgugaauauggucagcagacuccugcuuaaccgguuuaccaugacccauagacgcccgacaaucgaaaaggacguggaucugggagccggcacgcggcacgugaacgcugagcccgaaaccccuaauauggacgucaucggggagagaauuaaacgcaucaaggaggaacacaacucuacauggcauuaugacgaugagaaucccuacaagaccugggccuaucacggaagcuacgaaguuaaagcgacaggcuccgccucuagcaugauuaacggcguggugaagcuccugaccaaaccuugggacgucgugcccaugguuacacagauggcuaugaccgauacgaccccguucgggcagcaacggguguuuaaggagaaagucgacacaagaaccccucgcuccaugcccggaacacggagagugaugggcaucaccgccgaauggcuguggcgcacgcucgggcggaauaagaagccuagacugugcacacgcgaggaguucaccaaaaagguucggacaaacgcugccaugggagccguguuuaccgaagagaaucagugggauagcgcgaaagcugccgucgaagacgaggauuucuggaagcuuguggacagagaacgcgagcugcauaaacucggcaaguguggguccugcguuuauaacaugaugggcaaaagagagaagaagcugggagaauuuggcaaagccaaggggucucgggcuauuugguacauguggcuuggagcccgcuaccuggaguucgaagcucucggcuuucugaaugaggaucacugguucagcagagagaacuccuauucugggguggaaggagagggccugcauaaacucggguacauccugcgggacaucagcaagauucccggcggagccauguaugcggaugacacggccggcugggacaccagaaucacagaagaugaccuucacaaugaggaaaaaauuacccagcagauggauccugagcaccggcaacuggcuaacgccaucuuuaagcucacauaccagaauaaggucgugaaaguccagcgccccaccccgacagggaccgugauggacauuaucuccagaaaggaucagcggggaucuggccaaguugggacguauggacugaacacauucaccaauauggaggcucagcuuauccgccagauggaaggcgagggggugcugagcaaagccgaccucgaaaacccucaucugcccgagaagaaaauuacccaguggcuggaaacaaagggcgucgagagacucaagcggauggcgaucuccggagaugacugcguggugaaacccauugaugaccgcuuugccaacgcucugcuugcccugaaugauaugggcaagguuagaaaagacaucccucaauggcagccgagcaagggguggcacgauuggcagcaggugcccuucuguucucaucacuuccacgagcucauuaugaaagacggacggaagcuggucgugccuugccgcccccaagacgaacuuaucggcagagcucggauuucccagggggccggauggagccugaaggagaccgcuugucucggcaaagccuacgcgcagauguggucucugauguauuuucaucgcagagaucugcggcucgccuccaacgcuaucugcagcgccguuccugugcacuggguccccacaucucgcacgaccugguccauccaugcccaccaucaauggaugacaaccgaagacaugcugacaguguggaauagagucuggauugaggauaacccuuggauggaagacaagacccccgugacgaccugggagaauguuccguaccuugggaaacgggaggaucagugguguggcagccugaucggacucacauccagagcuaccugggcccagaacauuccuacagcgauccagcaagugcgcagccugauuggcaaugaagaguuccuugacuacaugcccucuaugaagcgguuuagaaaagaagaggagagcgaaggggcuaucugguga

SEQ ID NO: 20532 - RNA, 9873 nt, Artificial Sequence
  derived and/or modified CDS sequence (opt5) from DENV-3__FJ873812__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucucuaaugagcugaacuauauccugugggaaaauaacauuaagcucacgguggucgugggggacaucauuggaguucuggagcagggcaaacggacccuuacaccucagcccauggagcugaaguacuccuggaaaaccugggggaaggcuaagaucgugacagccgaaacccaaaacagcucuuucauuaucgauggaccuaauacacccgagugcccguccgucagcagagccuggaacgugugggaaguggaggacuauggcuuuggcgucuucaccacgaauaucuggcucaaacugcgcgaaguuuacacacagcugugugaccaccggcuuauguccgcugcggugaaggaugagagagccgugcacgcugacaugggguacuggauugagucucagaaaaacggaagcuggaagcucgaaaaagccucccugaucgaggucaagaccugcaccuggccuaagucucauacacuguggagcaauggcgugcucgaauccgauaugauuauccccaaaagccuggccgggccuauuucucagcacaaccaucgccccggauaucacacccaaacggcuggcccuuggcaccuugggaagcuggagcucgacuuuaauuacugcgagggaacaaccguugugaucacagaaaacuguggcacccggggccccucccugagaacaaccacggucagcgggaaacugauccaugaguggugcugucgcucuugcacccuuccgccucuccgguauaugggagaagauggcuguugguacgggauggagauuagacccaucuccgaaaaggaggagaauauggugaaaagccugguuucugccggaagcggcaagguggacaacuucacaauggggguccugugccucgcgauucuguuugaagaggugaugcggggaaaguucggcaaaaagcacaugaucgcuggcguuuuccuuaccuuugugcugcuccuguccgggcagauuacauggcgcgauauggcccauacccugaucaugauuggaagcaaugccucugacagaaugggcaugggggucacguaucuugcucugaucgccacauucaaaauccagcccuuucucgcgcugggauucuuucuccggaagcugaccuccagagaaaaccuucugcucggcguggggcuggcuauggccacaacccugcaacuuccugaggauauugaacagauggccaauggaaucgcucugggccucauggcccugaaacucauuacccaguucgagacauaccagcuguggacggcucuuaucagccugaccuguuccaacacaauuuuuacccucacaguggccuggcgcaccgcgacgcugauccuggccggcgucucucuucugccgguuugccaaagcuccucuaugcggaagacagacuggcuccccauggcuguggccgcuaugggggugccuccccugccucucuucaucuuuagccugaaggauacccuuaaaagacgcuccuggccccugaaugagggagucauggccgugggccugguuucuauucucgccagcucccugcuuagaaacgacgugccuauggcugggccccuggucgcgggaggccuccugaucgccuguuaugugauuaccgggacaagcgcugaucucaccguugaaaaggccgccgacaucacaugggaggaagaggcugaacagacgggagugucucacaaccugaugauuaccgucgacgaugacggcacaaugcggaucaaagaugacgagaccgagaauauccuuacagugcugcugaagaccgcccuccugauugucuccggcaucuucccguacagcauuccugcgacgcuucugguguggcauaccuggcagaaacagacacaacgcucugggguucucugggaugugcccuccccucccgaaacccagaaggcugagcuggaagagggagucuacagaaucaaacagcagggcauuuuugggaagacacaagugggaguuggcgugcagaaggagggggucuuccacaccauguggcacgugacacggggagccgugcucacguauaacggcaaacgccuggaaccgaauugggccagcguuaagaaagaccuuaucucuuacggcgggggauggagacuguccgcucaguggcaaaagggcgaggaaguccaggugauugccguggagccugggaaaaaccccaagaauuuucagaccaugccuggaacauuccagaccaccacaggcgaaaucggggcgaucgcucuggauuucaagcccggaacgagcggcucccccauuaucaaccgggagggcaaagucguggggcucuauggaaauggcguugugaccaagaacgggggauacgucagcggcauugcccaaacaaaugccgagccugacgggccgacccccgaacuggaggaagagauguuuaaaaagcgcaaccuuacaaucauggaucugcauccuggcucuggaaaaaccagaaaguaucuccccgcuauugugcgggaagccaucaagcgcagacugcggacgcucauccuggcuccuacaagaguuguggccgcggagauggaggaagcccuuaaaggccugcccauucgcuaccagaccaccgcuacaaagagcgagcacaccgggcgggaaaucgucgaccugaugugccaugccacauucaccaugagacuccuguccccugugcgcguuccgaauuauaaccuuauuaucauggaugaggcucacuuuacggaccccgccucuauugccgcucggggauacaucagcacaagagugggcaugggggaagcggccgcuaucuucaugaccgccacaccucccggaaccgccgaugcuuuuccucaguccaaugcccccauucaggacgaggagcgcgacaucccggaacggucuuggaacagcggcaaugaguggauuacggauuucgcggggaaaaccgucugguuugugccuuccaucaaggcuggcaacgacauugccaacugucugcgcaaaaauggaaagaaggugauccaacucucuagaaaaacauucgauaccgaauaccagaagacaaaacugaacgacugggauuuugucguuaccacagacauuagcgagaugggcgccaauuucaaggcugaucgggugaucgaccccagacggugccugaaacccgugauccucaccgaugggccugagcgcgucauucuugccggacccaugccugugacggcggccuccgcugcccagagacggggccgcguugggagaaacccgcagaaggaaaaugaccaauauaucuuuacaggacagccccugaacaaugaugaggaccaugcucacuggaccgaagccaagaugcugcucgacaacauuaauaccccugagggcaucauucccgcucuguucgaaccugagcgggagaaaagcgccgcgaucgauggggaauacagacuuaagggcgagucucgcaaaacauucguggaacugaugcggagaggagaccuccccgucuggcuggcccacaagguggcuuccgagggcaucaaauauaccgaucgcaaguggugcuuugacgggcagcggaacaaucagauucuggaagagaacauggauguugagaucuggacaaaagaaggagagaagaagaaacucagaccgcgcuggcuugacgcccggacguacagcgauccucuggcucugaaggaguucaaagaguuugccgccggcagaaagucuauugcucucgaccuggugaccgaaaucgggcgcguccccucccaucuugcgcacagaacacggaaugcccuggauaaccucgugaugcugcauaccagcgagcacggaggccgcgcuuauagacacgccgucgaggaacugccugagacaauggaaacccuccuucugcugggccucaugauucugcuuacagggggagccaugcuguuccucaucuccggcaaagggaucggaaagaccucuauuggccugaucugugugauugcuagcuccgggaugcuguggauggccgagaucccccuccaauggauugcgagcgccaucguucuugaguuuuucaugauggugcugcugauuccugaacccgagaagcagcggacaccgcaggacaaucaacucgcuuacguggucaucggaauccugacccuugccgcuauuaucgccgcgaacgaaaugggccugcucgagacaaccaaacgcgaucugggcaugucuaaggaaccugggguugugucccccacgagcuaucuggacguggaucuccaucccgccucugcuuggacacuuuacgccgucgcuaccacagugauuaccccuaugcugagacacaccaucgagaauagcacagccaacguuucccuggcugccauugcgaaccaggccgugguccucaugggacuggacaaaggcuggccgaucucuaagauggaccuuggggugccccugcucgcucugggaugcuacagccaggucaauccucugacgcucaccgccgcugugcuucugcugaucacacauuaugccauuaucggccccgggcuccaggccaaagcgacccgggaggcucaaaagagaacagccgcuggaauuaugaagaacccuaccguugauggcaucaugacgauugaccuggaucccgugaucuacgacuccaaauuugaaaagcagcuuggccaggucaugcugcucgugcugugugccguucagcugcuccuuaugcgcacaucuugggcccugugcgaggcucugacccucgccaccgggccuaucacaacccugugggaaggaagcccgggcaaauucuggaauacaacgauugcgguguccauggccaacaucuuucgggggagcuaucuugcuggagccggccuggcuuucucuauuaugaaguccgucgggaccggaaaaagaggcacaggcagccaaggggagacccucggagaaaaguggaagaaaaagcugaaucagcugucccgcaaagauuuugaccucuacaagaaaucuggcaucacagagguggaucggaccgaggccaaggaagggcuuaaaagaggagagauuacgcaccaugcggugagccggggcuccgccaagcugcagugguucguugaacgcaacauggucauccccgaggggagagugauugaccugggauguggccggggcggguggucuuauuacugcgcuggacucaagaaagugaccgaaguccgcggcuauacaaaagggggaccuggccacgaggagcccguuccuaugagcaccuacggguggaauaucgugaaacugauguccggaaaggauguguuuuaccuucccccggaaaaaugugacacacugcucugcgauaucggcgagagcucuccuucccccaccgucgaagagagcagaacaauucgggugcugaagaugguugagcccuggcugaagaacaaucaguucuguaucaaagugcucaacccuuauaugcccaccgucauugaacaccuugagcgccugcaaagaaagcauggcgggaugcuggugcggaauccucucucucgcaacuccacgcacgaaauguacuggaucagcaauggaacaggcaacauuguugccucugugaauauggucagcagacugcuucugaaccgguucaccaugacccauagacgcccgacaaucgagaaagacguggaucucggggcuggaacgcggcacgugaacgccgaacccgagaccccuaauauggacgucaucggcgagagaauuaagcgcaucaaagaagaacacaacuccacauggcauuaugacgaugaaaaucccuacaagaccugggcuuaucacgggucuuacgagguuaaggccacaggaagcgcguccagcaugauuaacggcguggugaaacugcugaccaagccuugggacgucgugcccaugguuacacagauggccaugaccgauacgaccccguuuggccagcaacggguguucaaagaaaaggucgacacaagaaccccucgcuccaugcccgggacacggagagugaugggaaucaccgcugaguggcucuggcgcacgcugggccggaauaaaaagccuagacuuugcacacgcgaggaauuuaccaagaaaguucggacaaacgccgcuaugggggccguguucaccgaggaaaaucagugggauucugccaaggcggcugucgaggacgaagauuuuuggaaacugguggacagagagcgcgagcuccauaagcugggaaaauguggcagcugcguuuauaacaugauggggaagagagagaagaaacuuggcgaguucggaaaggccaaaggcucccgggccauuugguacauguggcugggggcucgcuaccucgaauuugaggcccugggauuccugaaugaggaucacugguuuucuagagaaaacagcuauuccggcguggagggggaaggacuccauaagcugggcuacauccuucgggacaucucuaaaauucccgggggcgcuauguaugccgaugacacggcgggaugggacaccagaaucacagaggaugaccugcacaaugaagagaagauuacccagcagauggauccugagcaccggcaacucgccaacgcuaucuucaaacugacauaccagaauaaggucgugaagguccagcgccccaccccgacaggcaccgugauggacauuaucagcagaaaagaucagcggggguccggacaaguuggcacguaugggcuuaacacauuuaccaauauggaagcccagcugauccgccagauggagggagaaggcgugcucagcaaggcugaccuggagaacccucaucugcccgagaagaagauuacccaguggcucgagacaaaaggggucgagagacugaagcggauggccaucucuggcgaugacugcguggugaagcccauugaugaccgcuucgcgaacgcccuucuggcucucaaugauaugggaaaaguuagaaaggacaucccucaauggcagccguccaaaggcuggcacgauuggcaacaggugcccuuuuguagccaucacuuccacgaacugauuaugaaggacgggcggaaacuugucgugccuugccgcccccaagacgagcugaucggacgggcccggauuucucagggcgcuggguggucccucaaggaaaccgccugucugggaaaggcuuacgcccagauguggagccugauguauuuccaucgcagagaucuccggcuggcgucuaacgccaucugcuccgcuguuccugugcacuggguccccacaagccgcacgaccugguccauccaugcccaccaucaauggaugacaaccgaggacaugcuuacaguguggaauagagucuggauugaagauaacccuuggauggaggacaaaacccccgugacgaccugggagaauguuccguaccugggcaagcgggaagaucaguggugugggagccucaucggccugacaucuagagccaccugggcucagaacauuccuacagccauccagcaagugcgcagccuuauuggaaaugaggaauuucuggacuacaugcccuccaugaaacgguucagaaaggaggaggaaucugagggcgcgaucugguga

SEQ ID NO: 20533 - RNA, 9873 nt, Artificial Sequence
  derived and/or modified CDS sequence (opt5) from DENV-3__FJ873813__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaccucagcccauggagcugaaguauucuuggaaaaccugggggaaggccaagaucgugacagccgaaacccaaaacuccagcuucauuaucgauggaccuaauacacccgagugcccgucugucuccagagcuuggaacgugugggaaguggaggacuacggcuuuggcgucuucaccacgaauaucuggcucaaacugcgcgaaguuuauacacagcugugugaccaccggcuuaugagcgcggccgugaaggaugagagagcugugcaugccgacaugggguacuggauugagucccagaaaaacggaucuuggaagcucgaaaaagccagccugaucgaggucaagaccugcaccuggccuaagucccacacacuguggucuaauggcgugcucgaaagcgauaugauuauccccaaaucccuggcugggccuauuagccagcauaaccaccgccccggauaccacacccaaacggccggcccuuggcaucuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcauaugaucgccggcguuuucuuuaccuucgugcuucugcucagcgggcagauuacauggcgcgauauggcccacacccugaucaugauuggauccaaugcuagcgacagaaugggcaugggggucacguaccuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaucagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucucucucaaggauacccugaaaagacgcagcuggccccuuaaugagggagucauggccgugggccugguuuccauucuggcuucuagccuccugagaaacgacgugccuauggcggggccccuugucgccggaggccugcucaucgcuuguuacgugauuaccgggacauccgccgaucugaccguugaaaaggccgcugacaucacaugggaggaagaggccgaacagacgggagugagccauaaccucaugauuaccgucgacgaugacggcacaaugcggaucaaagaugacgagaccgagaauauccugacagugcuucugaagaccgcgcugcucauugucucuggcaucuuuccguauuccauuccugcuacgcugcuuguguggcacaccuggcagaaacagacacaacgcagcgggguucugugggaugugcccucuccucccgaaacccagaaggccgagcucgaagagggagucuacagaaucaaacagcagggcauuuucgggaagacacaagugggaguuggcgugcagaaggagggggucuuucacaccauguggcaugugacacggggagccgugcugacguacaacggcaaacgccucgaaccgaauugggcuuccguuaagaaagaccugaucagcuauggcgggggauggagacuuucugcccaguggcaaaagggcgaggaaguccaggugauugcgguggagccugggaaaaaccccaagaauuuccagaccaugccuggaacauuccagaccaccacaggcgaaaucggggcuaucgcccuggauuuuaagcccggaacguccggcagccccauuaucaaccgggagggcaaagucguggggcuguacggaaauggcguugugaccaagaacgggggauaugucuccggcauugcccaaacaaaugcugagccugacgggccgacccccgaacucgaggaagagauguucaaaaagcgcaaccugacaaucauggaucuucacccuggcagcggaaaaaccagaaaguaccugcccgccauugugcgggaagcuaucaagcgcagacuccggacgcugauccucgccccuacaagaguuguggcggccgagauggaggaagcucugaaaggccuucccauucgcuaucagaccaccgccacaaagucugagcauaccgggcgggaaaucgucgaccugaugugccacgcuacauuuaccaugagacugcucagcccugugcgcguuccgaauuacaaccugauuaucauggaugaggcccauuucacggaccccgccuccauugcugcgcggggauauaucucuacaagagugggcaugggggaagccgcugccaucuuuaugaccgccacaccucccggaaccgcugaugccuucccucagagcaaugcgcccauucaggacgaggagcgcgacaucccggaacgguccuggaacucuggcaaugaguggauuacggauuuugcugggaaaaccgucugguucgugccuagcaucaaggccggcaacgacauugccaacugucuucgcaaaaauggaaagaaggugauccaacuguccagaaaaacauuugauaccgaauaccagaagacaaaacucaacgacugggauuucgucguuaccacagacauuucugagaugggcgcuaauuuuaaggccgaucgggugaucgaccccagacggugccugaaacccgugauccugaccgaugggccugagcgcgucauucucgcgggacccaugccugugacggccgcuagcgccgcucagagacggggccgcguugggagaaacccgcagaaggaaaaugaccaauacaucuucacaggacagccccuuaacaaugaugaggaccacgcccacuggaccgaagcuaagaugcugcuggacaacauuaauaccccugagggcaucauucccgcccucuucgaaccugagcgggagaaauccgcggccaucgauggggaauauagacugaagggcgagagccgcaaaacauuuguggaacuuaugcggagaggagaccugcccgucuggcucgcucauaagguggccucugagggcaucaaauacaccgaucgcaaguggugcuucgacgggcagcggaacaaucagauucuggaagagaacauggauguugagaucuggacaaaagaaggagagaagaagaaacugagaccgcgcuggcucgacgcucggacguauuccgauccucuugcccugaaggaauuuaaagaguucgccgcuggcagaaagagcauugcgcuggaccucgugaccgaaaucgggcgcguccccucucaccuggcccauagaacacggaaugcucuugauaaccuggugaugcuccacaccuccgagcacggaggccgcgccuacagacaugccgucgaggaacugccugagacaauggaaacccugcuccuucugggccugaugauucuccugacagggggagcuaugcuuuuucugaucagcggcaaagggaucggaaagaccuccauuggccucaucugugugauugccucuagcgggaugcuguggauggcggagaucccccugcaauggauugccuccgcuaucguucucgaguucuuuaugauggugcuucugauuccugaacccgagaagcagcggacaccgcaggacaaucaacuggccuauguggucaucggaauccucacccuggcugccauuaucgcggccaacgaaaugggccuucuggagacaaccaaacgcgaucucggcaugagcaaggaaccugggguugugucucccacguccuaccuggacguggaucugcaccccgcuagcgccuggacacucuaugcugucgccaccacagugauuaccccuaugcuuagacauaccaucgaaaauucuacagcuaacguuagccuggccgcgauugccaaccaggcugugguccugaugggacucgacaaaggcuggccgaucuccaagauggaccugggggugccccuucuggcccucggaugcuacucucaggucaauccucugacgcugaccgcugccgugcuccuucugaucacacacuacgccauuaucggccccgggcugcaggcgaaagcuacccgggaggcccaaaagagaacagcugccggaauuaugaagaacccuaccguugauggcaucaugacgauugaccucgaucccgugaucuaugacagcaaauucgaaaagcagcugggccaggucaugcuucuggugcucugugccguucagcugcugcucaugcgcacauccugggcucuuugcgaggcccugacccuggcgaccgggccuaucacaacccucugggaaggaucuccgggcaaauuuuggaauacaacgauugccgugagcauggcuaacaucuuccggggguccuaccuggccggagcuggccuugccuuuagcauuaugaagucugucgggaccggaaaaagaggcacaggcucccaaggggagacccugggagaaaaguggaagaaaaagcucaaucagcugagccgcaaagauuucgaccuguauaagaaauccggcaucacagagguggaucggaccgaggcgaaggaagggcucaaaagaggagagauuacgcaucacgccgugucucggggcagcgcuaaacuucagugguuuguugaacgcaacauggucauccccgaggggagagugauugaccugggauguggccggggcgggugguccuacuauugcgccggacugaagaaagugaccgaaguccgcggcuacacaaaagggggaccuggccacgaggagcccguuccuaugucuaccuauggguggaauaucgugaaacucaugagcggaaaggauguguucuaccugcccccggaaaaaugugacacacuucugugcgauaucggcgaguccagcccuucucccaccgucgaagaguccagaacaauucgggugcucaagaugguugagcccuggcugaagaacaaucaguucuguaucaaagugcugaacccuuacaugcccaccgucauugaacaucucgagcgccuucaaagaaagcacggcgggaugcuggugcgguauccucugagccgcaauucuacgcaugaaauguacuggaucuccaacggaacaggcaauauuguugcuagcgugaacauggucucuagacuccugcuuaaucgguuuaccaugacccacagacgcccgacaaucgagaaagacguggaucugggggccggaacgcggcacgugaacgcugaacccgagaccccuaacauggacgucaucggcgagagaauuaagcgcaucaaagaagaacacaauagcacauggcacuaugacgaugaaaaccccuacaagaccugggccuaucauggguccuacgagguuaaggcgacaggaucugccagcuccaugauuaauggcguggugaaacuccugaccaagccuugggacgucgugcccaugguuacacagauggcuaugaccgauacgaccccguucggccagcaacggguguuuaaagaaaaggucgacacaagaaccccucgcagcaugcccgggacacggagagugaugggaaucaccgccgaguggcuguggcgcacgcucggccggaacaaaaagccuagacugugcacacgcgaggaguucaccaagaaaguucggacaaaugcugccaugggggccguguuuaccgaggaaaaccagugggauuccgcgaaggcugccgucgaggacgaagauuucuggaaacuuguggacagagagcgcgagcugcacaagcucggaaaauguggcucuugcguuuauaauaugauggggaagagagagaagaagcugggcgaguuuggaaaggccaaaggcagccgggcuauuugguacauguggcuuggggcccgcuaccuggaguucgaggcucucggauuucugaacgaggaucauugguucuccagagaaaauucuuauagcggcguggagggggaaggacugcacaagcucggcuacauccugcgggacaucuccaaaauucccgggggcgccauguaugcggaugacacggccggaugggacaccagaaucacagaggaugaccuucacaacgaagagaagauuacccagcagauggauccugagcaucggcaacuggcuaaugccaucuuuaaacucacauaccagaacaaggucgugaagguccagcgccccaccccgacaggcaccgugauggacauuaucucuagaaaagaucagcgggggagcggacaaguuggcacguaugggcugaauacauucaccaacauggaagcucagcuuauccgccagauggagggagaaggcgugcuguccaaggccgaccucgagaauccucaucugcccgagaagaagauuacccaguggcuggagacaaaaggggucgagagacucaagcggauggcgaucagcggcgaugacugcguggugaagcccauugaugaccgcuuugccaacgcucugcuugcccugaacgauaugggaaaaguuagaaaggacaucccucaauggcagccgucuaaaggcuggcaugauuggcaacaggugcccuucuguucccaccacuuccaugaacucauuaugaaggacgggcggaaacuggucgugccuugccgcccccaagacgagcuuaucggacgggcucggauuagccagggcgccggguggucucugaaggaaaccgcuugucucggaaaggccuacgcgcagauguggucccugauguauuuucaccgcagagaucugcggcucgccagcaaugcuaucugcucugccguuccugugcauuggguccccacaucccgcacgaccuggagcauccacgcccaucaccaauggaugacaaccgaggacaugcugacaguguggaacagagucuggauugaagauaauccuuggauggaggacaaaacccccgugacgaccugggagaacguuccguaccuuggcaagcgggaagaucaguggugugggucccugaucggccucacaagcagagcuaccugggcccagaauauuccuacagcgauccagcaagugcgcucucugauuggaaacgaggaguuccuugacuacaugcccagcaugaaacgguuuagaaaggaggaggaauccgagggcgcuaucugguga

SEQ ID NO: 20534 - RNA, 9873 nt, Artificial Sequence
  derived and/or modified CDS sequence (opt5) from DENV-3__FJ850048__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucucucucaaggauacccugaaaagacgcagcuggccccuuaaugagggagucauggccgugggccugguuuccauucuggcuucuagccuccugagaaacgacgugccuauggcggggccccuugucgccggaggccugcucaucgcuuguuaugugauuaccgggacauccgccgaucugaccguugaaaaggccgcugacaucacaugggaggaagaggccgaacagacgggagugagccacaaccucaugauuaccgucgacgaugacggcacaaugcggaucaaagaugacgagaccgagaauauccugacagugcuucugaagaccgcgcugcucauugucucuggcaucuuuccguacuccauuccugcuacgcugcuuguguggcauaccuggcagaaacagacacaacgcagcgggguucugugggaugugcccucuccucccgaaacccagaaggccgagcucgaagagggagucuacagaaucaaacagcagggcauuuucgggaagacacaagugggaguuggcgugcagaaggagggggucuuucacaccauguggcacgugacacggggagccgugcugacguauaacggcaaacgccucgaaccgaauugggcuuccguuaagaaagaccugaucagcuacggcgggggauggagacuuucugcccaguggcaaaagggcgaggaaguccaggugauugcgguggagccugggaaaaaccccaagaauuuccagaccaugccuggaacauuccagaccaccacaggcgaaaucggggcuaucgcccuggauuuuaagcccggaacguccggcagccccauuaucaaccgggagggcaaagucguggggcuguauggaaauggcguugugaccaagaacgggggauacgucuccggcauugcccaaacaaaugcugagccugacgggccgacccccgaacucgaggaagagauguucaaaaagcgcaaccugacaaucauggaucuucauccuggcagcggaaaaaccagaaaguaucugcccgccauugugcgggaagcuaucaagcgcagacuccggacgcugauccucgccccuacaagaguuguggcggccgagauggaggaagcucugaaaggccuucccauucgcuaccagaccaccgccacaaagucugagcacaccgggcgggaaaucgucgaccugaugugccaugcuacauuuaccaugagacugcucagcccugugcgcguuccgaauuauaaccugauuaucauggaugaggcccacuucacggaccccgccuccauugcugcgcggggauacaucucuacaagagugggcaugggggaagccgcugccaucuuuaugaccgccacaccucccggaaccgcugaugccuucccucagagcaaugcgcccauucaggacgaggagcgcgacaucccggaacgguccuggaacucuggcaaugaguggauuacggauuuugcugggaaaaccgucugguucgugccuagcaucaaggccggcaacgacauugccaacugucuucgcaaaaauggaaagaaggugauccaacuguccagaaaaacauuugauaccgaauaccagaagacaaaacucaacgacugggauuucgucguuaccacagacauuucugagaugggcgcuaauuuuaaggccgaucgggugaucgaccccagacggugccugaaacccgugauccugaccgaugggccugagcgcgucauucucgcgggacccaugccugugacggccgcuagcgccgcucagagacggggccgcguugggagaaacccgcagaaggaaaaugaccaauauaucuucacaggacagccccuuaacaaugaugaggaccaugcccacuggaccgaagcuaagaugcugcuggacaacauuaauaccccugagggcaucauucccgcccucuucgaaccugagcgggagaaauccgcggccaucgauggggaauacagacugaagggcgagagccgcaaaacauuuguggaacuuaugcggagaggagaccugcccgucuggcucgcucacaagguggccucugagggcaucaaauauaccgaucgcaaguggugcuucgacgggcagcggaacaaucagauucuggaagagaacauggauguugagaucuggacaaaagaaggagagaagaagaaacugagaccgcgcuggcucgacgcucggacguacuccgauccucuugcccugaaggaauuuaaagaguucgccgcuggcagaaagagcauugcgcuggaccucgugaccgaaaucgggcgcguccccucucaucuggcccacagaacacggaaugcucuugauaaccuggugaugcuccauaccuccgagcacggaggccgcgccuauagacacgccgucgaggaacugccugagacaauggaaacccugcuccuucugggccugaugauucuccugacagggggagcuaugcuuuuucugaucagcggcaaagggaucggaaagaccuccauuggccucaucugugugauugccucuagcgggaugcuguggauggcggagaucccccugcaauggauugccuccgcuaucguucucgaguucuuuaugauggugcuucugauuccugaacccgagaagcagcggacaccgcaggacaaucaacuggccuacguggucaucggaauccucacccuggcugccauuaucgcggccaacgaaaugggccuucuggagacaaccaaacgcgaucucggcaugagcaaggaaccugggguugugucucccacguccuaucuggacguggaucugcaucccgcuagcgccuggacacucuacgcugucgccaccacagugauuaccccuaugcuuagacacaccaucgaaaauucuacagcuaacguuagccuggccgcgauugccaaccaggcugugguccugaugggacucgacaaaggcuggccgaucuccaagauggaccugggggugccccuucuggcccucggaugcuacucucaggucaauccucugacgcugaccgcugccgugcuccuucugaucacacauuaugccauuaucggccccgggcugcaggcgaaagcuacccgggaggcccaaaagagaacagcugccggaauuaugaagaacccuaccguugauggcaucaugacgauugaccucgaucccgugaucuacgacagcaaauucgaaaagcagcugggccaggucaugcuucuggugcucugugccguucagcugcugcucaugcgcacauccugggcucuuugcgaggcccugacccuggcgaccgggccuaucacaacccucugggaaggaucuccgggcaaauuuuggaauacaacgauugccgugagcauggcuaacaucuuccggggguccuaucuggccggagcuggccuugccuuuagcauuaugaagucugucgggaccggaaaaagaggcacaggcucccaaggggagacccugggagaaaaguggaagaaaaagcucaaucagcugagccgcaaagauuucgaccuguacaagaaauccggcaucacagagguggaucggaccgaggcgaaggaagggcucaaaagaggagagauuacgcaccaugccgugucucggggcagcgcuaaacuucagugguuuguugaacgcaacauggucauccccgaggggagagugauugaccugggauguggccggggcgggugguccuauuacugcgccggacugaagaaagugaccgaaguccgcggcuauacaaaagggggaccuggccacgaggagcccguuccuaugucuaccuacggguggaauaucgugaaacucaugagcggaaaggauguguucuaccugcccccggaaaaaugugacacacuucugugcgauaucggcgaguccagcccuucucccaccgucgaagaguccagaacaauucgggugcucaagaugguugagcccuggcugaagaacaaucaguucuguaucaaagugcugaacccuuauaugcccaccgucauugaacaccucgagcgccuucaaagaaagcauggcgggaugcuggugcggaauccucugagccgcaacucuacgcacgaaauguacuggaucuccaauggaacaggcaacauuguugcuagcgugaauauggucucuagacuccugcuuaaccgguuuaccaugacccauagacgcccgacaaucgagaaagacguggaucugggggccggaacgcggcacgugaacgcugaacccgagaccccuaauauggacgucaucggcgagagaauuaagcgcaucaaagaagaacacaacagcacauggcauuaugacgaugaaaaucccuacaagaccugggccuaucacggguccuacgagguuaaggcgacaggaucugccagcuccaugauuaacggcguggugaaacuccugaccaagccuugggacgucgugcccaugguuacacagauggcuaugaccgauacgaccccguucggccagcaacggguguuuaaagaaaaggucgacacaagaaccccucgcagcaugcccgggacacggagagugaugggaaucaccgccgaguggcuguggcgcacgcucggccggaauaaaaagccuagacugugcacacgcgaggaguucaccaagaaaguucggacaaacgcugccaugggggccguguuuaccgaggaaaaucagugggauuccgcgaaggcugccgucgaggacgaagauuucuggaaacuuguggacagagagcgcgagcugcauaagcucggaaaauguggcucuugcguuuauaacaugauggggaagagagagaagaagcugggcgaguuuggaaaggccaaaggcagccgggcuauuugguacauguggcuuggggcccgcuaccuggaguucgaggcucucggauuucugaaugaggaucacugguucuccagagaaaacucuuauagcggcguggagggggaaggacugcauaagcucggcuacauccugcgggacaucuccaaaauucccgggggcgccauguaugcggaugacacggccggaugggacaccagaaucacagaggaugaccuucacaaugaagagaagauuacccagcagauggauccugagcaccggcaacuggcuaacgccaucuuuaaacucacauaccagaauaaggucgugaagguccagcgccccaccccgacaggcaccgugauggacauuaucucuagaaaagaucagcgggggagcggacaaguuggcacguaugggcugaacacauucaccaauauggaagcucagcuuauccgccagauggagggagaaggcgugcuguccaaggccgaccucgagaacccucaucugcccgagaagaagauuacccaguggcuggagacaaaaggggucgagagacucaagcggauggcgaucagcggcgaugacugcguggugaagcccauugaugaccgcuuugccaacgcucugcuugcccugaaugauaugggaaaaguuagaaaggacaucccucaauggcagccgucuaaaggcuggcacgauuggcaacaggugcccuucuguucccaucacuuccacgaacucauuaugaaggacgggcggaaacuggucgugccuugccgcccccaagacgagcuuaucggacgggcucggauuagccagggcgccggguggucucugaaggaaaccgcuugucucggaaaggccuacgcgcagauguggucccugauguauuuucaucgcagagaucugcggcucgccagcaacgcuaucugcucugccguuccugugcacuggguccccacaucccgcacgaccuggagcauccaugcccaccaucaauggaugacaaccgaggacaugcugacaguguggaauagagucuggauugaagauaacccuuggauggaggacaaaacccccgugacgaccugggagaauguuccguaccuuggcaagcgggaagaucaguggugugggucccugaucggccucacaagcagagcuaccugggcccagaacauuccuacagcgauccagcaagugcgcucucugauuggaaaugaggaguuccuugacuacaugcccagcaugaaacgguuuagaaaggaggaggaauccgagggcgcuaucugguga

SEQ ID NO: 20535 - RNA, 9873 nt, Artificial Sequence
  derived and/or modified CDS sequence (opt5) from DENV-3__FJ850049__SS-prME
accagccugugccucaugaugauccugcccgccgcucuugccuuccaccugacgucccgggacggcgaaccucggaugauuguggggaagaaugaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaccucagcccauggagcugaaguauucuuggaaaaccugggggaaggccaagaucgugacagccgaaacccaaaacuccagcuucauuaucgauggaccuaauacacccgagugcccgucugucuccagagcuuggaacgugugggaaguggaggacuacggcuuuggcgucuucaccacgaauaucuggcucaaacugcgcgaaguuuauacacagcugugugaccaccggcuuaugagcgcggccgugaaggaugagagagcugugcaugccgacaugggguacuggauugagucccagaaaaacggaucuuggaagcucgaaaaagccagccugaucgaggucaagaccugcaccuggccuaagucccacacacuguggucuaauggcgugcucgaaagcgauaugauuauccccaaaucccuggcugggccuauuagccagcauaaccaccgccccggauaccacacccaaacggccggcccuuggcaucuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcauaugaucgccggcguuuucuuuaccuucgugcuucugcucagcgggcagauuacauggcgcgauauggcccacacccugaucaugauuggauccaaugcuagcgacagaaugggcaugggggucacguaccuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaucagcucuggacggcccugaucucccuuaccuguagcaacacaauuuucacccugacaguggcguggcgcaccgccacgcucauccuggcuggcgucucccugcuuccgaugugccaaucuagcuccaugcggaagacagacuggcugcccauggccguugcugccaugggggugccuccccucccucuguuuaucuucucucucaaggauacccugaaaagacgcagcuggccccuuaaugagggagugauggccgucggccugguguccauucuggcuucuagccuccugagaaacgacguuccuauggcggggccccuuguggccggaggccugcucaucgcuuguuacgucauuaccgggacauccgccgaucugaccguggaaaaggccgcuaacaucacaugggaggaagaggccgaacagacgggaguuagccauaaucucaugauuaccguggacgacgauggcacaaugcggaucaaagacgaugagaccgagaacauccugacaguccuucugaagaccgcgcugcucauugugucuggcaucuuuccguauuccauuccugcuacgcugcuugucuggcacaccuggcagaaacagacacaacgcagcggggugcugugggacguucccucuccucccgaaacccagaaggccgagcucgaagagggaguguacagaaucaaacagcagggcauuuucgggaagacacaagucggagugggcguucagaaggaggggguguuucacaccauguggcaugucacacggggagccgugcugacguacaauggcaaacgccucgaaccgaacugggcuuccgugaagaaagaucugaucagcuauggcgggggauggagacuuucugcccaguggcaaaagggcgaggaaguucaggucauugcgguggagccugggaaaaaucccaagaacuuccagaccaugccuggaacauuccagaccaccacaggcgaaaucggggcuaucgcccuggacuuuaagcccggaacguccggcagccccauuaucaaucgggagggcaaaguggucgggcuguacggaaacggcgugguuaccaagaaugggggauauguguccggcauugcccaaacaaacgcugagccugaugggccgacccccgaacucgaggaagagauguucaaaaagcgcaaucugacaaucauggaccuucacccuggcagcggaaaaaccagaaaguaccugcccgccauuguccgggaagcuaucaagcgcagacuccggacgcugauccucgccccuacaagagugguugcggccgagauggaggaagcucugaaaggccuucccauucgcuaucagaccaccgccacaaagucugagcauaccgggcgggaaaucguggaucugaugugccacgcuacauuuaccaugagacugcucagcccuguccgcgugccgaacuacaaucugauuaucauggacgaggcccauuucacggaucccgccuccauugcugcgcggggauauaucucuacaagaguuggcaugggggaagccgcugccaucuuuaugaccgccacaccucccggaaccgcugacgccuucccucagagcaacgcgcccauucaggaugaggagcgcgacaucccggaacgguccuggaacucuggcaacgaguggauuacggacuuugcugggaaaaccgugugguucgucccuagcaucaaggccggcaacgauauugccaauugucuucgcaaaaacggaaagaaggugauccaacuguccagaaaaacauuugacaccgaauaccagaagacaaaacucaaugauugggacuucguggucaccacagauauuucugagaugggcgcuaacuuuaaggccgaccggguuaucgaucccagacggugccugaaacccgugauccugaccgacgggccugagcgcgugauucucgcgggacccaugccugucacggccgcuagcgccgcucagagacggggccgcguggggagaaauccgcagaaggaaaacgaucaauacaucuucacaggacagccccuuaauaacgacgaggaucacgcccacuggaccgaagcuaagaugcugcuggacaauauuaacaccccugagggcaucauucccgcccucuucgaaccugagcgggagaaauccgcggccaucgacggggaauauagacugaagggcgagagccgcaaaacauuuguugaacuuaugcggagaggagaucugcccguguggcucgcucauaaggucgccucugagggcaucaaauacaccgaccgcaaguggugcuucgaugggcagcggaauaaccagauucuggaagagaauauggacguggagaucuggacaaaagaaggagagaagaagaaacugagaccgcgcuggcucgaugcucggacguauuccgacccucuugcccugaaggaauuuaaagaguucgccgcuggcagaaagagcauugcgcuggaucucguuaccgaaaucgggcgcgugcccucucaccuggcccauagaacacggaacgcucuugacaaucuggucaugcuccacaccuccgagcacggaggccgcgccuacagacaugccguggaggaacugccugagacaauggaaacccugcuccuucugggccugaugauucuccugacagggggagcuaugcuuuuucugaucagcggcaaagggaucggaaagaccuccauuggccucaucugugucauugccucuagcgggaugcuguggauggcggagaucccccugcaauggauugccuccgcuaucgugcucgaguucuuuaugaugguucuucugauuccugaacccgagaagcagcggacaccgcaggauaaccaacuggccuauguggugaucggaauccucacccuggcugccauuaucgcggccaaugaaaugggccuucuggagacaaccaaacgcgaccucggcaugagcaaggaaccuggggucguuucucccacguccuaccuggauguggaccugcaccccgcuagcgccuggacacucuaugcuguggccaccacagucauuaccccuaugcuuagacauaccaucgagaacucuacagcuaacgugagccuggccgcgauugccaaucaggcuguugugcugaugggacucgauaaaggcuggccgaucuccaagauggaccugggggucccccuucuggcccucggaugcuacucucaggugaacccucugacgcugaccgcugccguccuccuucugaucacacacuacgccauuaucggccccgggcugcaggcgaaagcuacccgggaggcccaaaagagaacagcugccggaauuaugaagaauccuaccguggacggcaucaugacgauugaucucgaccccguuaucuaugauagcaaauucgaaaagcagcugggccaggugaugcuucugguccucugugccgugcagcugcugcucaugcgcacauccugggcucuuugcgaggcccugacccuggcgaccgggccuaucacaacccucugggaaggaucuccgggcaaauuuuggaacacaacgauugccguuagcauggcuaauaucuuccggggguccuaccuggccggagcuggccuugccuuuagcauuaugaagucuguggggaccggaaaaagaggcacaggcucccaaggggagacccugggagaaaaguggaagaaaaagcucaaccagcugagccgcaaagacuucgaucuguauaagaaauccggcaucacagaggucgaccggaccgaggcgaaggaagggcucaaaagaggagagauuacgcaucacgccgugucucggggcagcgcuaaacuucagugguuuguggaacgcaauaugguuauccccgaggggagagucauugaucugggauguggccggggcgggugguccuacuauugcgccggacugaagaaagugaccgaagugcgcggcuacacaaaagggggaccuggccacgaggagcccgucccuaugucuaccuauggguggaacaucguuaaacucaugagcggaaaggacguguucuaccugcccccggaaaaaugugauacacuucugugcgacaucggcgaguccagcccuucucccaccguggaagaguccagaacaauucggguccucaagaugguggagcccuggcugaagaauaaccaguucuguaucaaaguucugaauccuuacaugcccaccgugauugaacaucucgagcgccuucaaagaaagcacggcgggaugcugguccggaacccucugagccgcaauucuacgcaugaaauguauuggaucuccaacggaacaggcaauauuguggcuagcguuaacauggugucuagacuccugcuuaaccgguuuaccaugacccacagacgcccgacaaucgagaaagaugucgaccugggggccggaacgcggcacgugaaugcugaacccgagaccccuaacauggaugugaucggcgagagaauuaagcgcaucaaagaagaacacaauagcacauggcacuacgacgacgaaaaccccuauaagaccugggccuaccauggguccuaugaggucaaggcgacaggaucugccagcuccaugauuaauggcguugugaaacuccugaccaagccuugggaugugguccccauggugacacagauggcuaugaccgacacgaccccguucggccagcaacggguuuuuaaagaaaagguggauacaagaaccccucgcagcaugcccgggacacggagagucaugggaaucaccgccgaguggcuguggcgcacgcucggccggaacaaaaagccuagacugugcacacgcgaggaguucaccaagaaagugcggacaaaugcugccaugggggccguuuuuaccgaggaaaaccagugggacuccgcgaaggcugccguggaggaugaagacuucuggaaacuugucgauagagagcgcgagcugcacaagcucggaaaauguggcucuugcguguacaauaugauggggaagagagagaagaagcugggcgaguuuggaaaggccaaaggcagccgggcuauuugguauauguggcuuggggcccgcuaccuggaguucgaggcucucggauuucugaacgaggaccauugguucuccagagaaaauucuuacagcggcguugagggggaaggacugcacaagcucggcuauauccugcgggauaucuccaaaauucccgggggcgccauguacgcggacgauacggccggaugggacaccagaaucacagaggacgaucuucacaacgaagagaagauuacccagcagauggacccugagcaucggcaacuggcuaaugccaucuuuaaacucacauaucagaacaagguggucaaggugcagcgccccaccccgacaggcaccgucauggauauuaucucuagaaaagaccagcgggggagcggacaagugggcacguacgggcugaauacauucaccaacauggaagcucagcuuauccgccagauggagggagaaggcguucuguccaaggccgaucucgagaacccucaucugcccgagaagaagauuacccaguggcuggagacaaaagggguggagagacucaagcggauggcgaucagcggcgacgauugcgucgugaagcccauugacgaucgcuuugccaaugcucugcuugcccugaacgacaugggaaaagugagaaaggauaucccucaauggcagccgucuaaaggcuggcaugacuggcagcagguucccuucuguucccaccacuuccaugaacucauuaugaaggaugggcggaaacugguggucccuugccgcccccaagacgagcuuaucggacgggcucggauuagccagggcgccggguggucucugaaggaaaccgcuugucucggaaaggccuaugcgcagauguggucccugauguacuuucaccgcagagaccugcggcucgccagcaaugcuaucugcucugccgugccuguucauugggugcccacaucccgcacgaccuggagcauccacgcccaucaccaauggaugacaaccgaggauaugcugacagucuggaacagaguguggauugaagacaauccuuggauggaggauaaaacccccgucacgaccugggagaacgugccguaucuuggcaagcgggaagaccaguggugugggucccugaucggccucacaagcagagcuaccugggcccagaauauuccuacagcgauccagcaaguucgcucucugauuggaaacgaggaguuccuugauuacaugcccagcaugaaacgguuuagaaaggaggaggaauccgagggcgcuaucugguga

SEQ ID NO: 20536 - RNA, 9873 nt, Artificial Sequence
  derived and/or modified CDS sequence (opt5) from DENV-3__FJ898476__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaaaaggccgcugacaucacaugggaggaagaggccgaacagacgggcgugucccacaaccucaugauuaccgucgacgaugacggcacaaugcggaucaaagaugacgagaccgagaauauccugacagugcuucugaagaccgcgcugcucauugucagcgggaucuuuccguacucuauuccugcuacgcugcuuguguggcauaccuggcagaaacagacacaacgcuccggaguucugugggaugugcccagcccucccgaaacccagaaggccgagcucgaagagggcgucuacagaaucaaacagcaggggauuuucggaaagacacaagugggcguuggggugcagaaggagggagucuuucacaccauguggcacgugacacggggcgccgugcugacguauaacggcaaacgccucgaaccgaauugggcuucuguuaagaaagaccugaucuccuacgggggaggcuggagacuuagcgcccaguggcaaaagggggaggaaguccaggugauugcgguggagccuggcaagaaccccaagaauuuccagaccaugccuggcacauuccagaccaccacaggggaaaucggagcuaucgcccuggauuuuaagcccggcacgucuggcucccccauuaucaaccgggaggggaaagucgugggacuguauggcaaugggguugugaccaagaacggaggcuacgucagcgggauugcccaaacaaaugcugagccugacggcccgacccccgaacucgaggaagagauguucaaaaagcgcaaccugacaaucauggaucuucauccuggauccggcaaaaccagaaaguaucugcccgccauugugcgggaagcuaucaagcgcagacuccggacgcugauccucgccccuacaagaguuguggcggccgagauggaggaagcucugaaagggcuucccauucgcuaccagaccaccgccacaaagagcgagcacaccggacgggaaaucgucgaccugaugugccaugcuacauuuaccaugagacugcucucuccugugcgcguuccgaauuauaaccugauuaucauggaugaggcccacuucacggaccccgccagcauugcugcgcggggcuacaucuccacaagaguggggaugggagaagccgcugccaucuuuaugaccgccacaccucccggcaccgcugaugccuucccucagucuaaugcgcccauucaggacgaggagcgcgacaucccggaacggagcuggaacuccgggaaugaguggauuacggauuuugcuggcaaaaccgucugguucgugccuucuaucaaggccggaaacgacauugccaacugucuucgcaaaaauggcaagaaggugauccaacugagcagaaaaacauuugauaccgaauaccagaagacaaaacucaacgacugggauuucgucguuaccacagacauuuccgagaugggggcuaauuuuaaggccgaucgggugaucgaccccagacggugccugaaacccgugauccugaccgauggaccugagcgcgucauucucgcgggccccaugccugugacggccgcuucugccgcucagagacgggggcgcguuggaagaaacccgcagaaggaaaaugaccaauauaucuucacaggccagccccuuaacaaugaugaggaccaugcccacuggaccgaagcuaagaugcugcuggacaacauuaauaccccugaggggaucauucccgcccucuucgaaccugagcgggagaaaagcgcggccaucgauggcgaauacagacugaagggagagucccgcaaaacauuuguggaacuuaugcggagaggcgaccugcccgucuggcucgcucacaagguggccagcgaggggaucaaauauaccgaucgcaaguggugcuucgacggacagcggaacaaucagauucuggaagagaacauggauguugagaucuggacaaaagaaggcgagaagaagaaacugagaccgcgcuggcucgacgcucggacguacucugauccucuugcccugaaggaauuuaaagaguucgccgcugggagaaaguccauugcgcuggaccucgugaccgaaaucggacgcguccccagccaucuggcccacagaacacggaaugcucuugauaaccuggugaugcuccauaccucugagcacggcggccgcgccuauagacacgccgucgaggaacugccugagacaauggaaacccugcuccuucuggggcugaugauucuccugacgggaggcgcuaugcuuuuucugaucuccgggaaaggaaucggcaagaccagcauugggcucaucugugugauugccuccucuggaaugcuguggauggcggagaucccccugcaauggauugccagcgcuaucguucucgaguucuuuaugauggugcuucugauuccugaacccgagaagcagcggacaccgcaggacaaucaacuggccuacguggucaucggcauccucacccuggcugccauuaucgcggccaacgaaaugggccuucuggagacaaccaaacgcgaucucgggauguccaaggaaccuggaguugugagccccacgucuuaucuggacguggaucugcaucccgcuuccgccuggacacucuacgcugucgccaccacagugauuaccccuaugcuuagacacaccaucgagaauagcacagcuaacguuucucuggccgcgauugccaaccaggcugugguccugaugggccucgacaaaggguggccgaucagcaagauggaccugggagugccccuucuggcccucggcugcuacucccaggucaauccucugacgcugaccgcugccgugcuccuucugaucacacauuaugccauuaucgggcccggacugcaggcgaaagcuacccgggaggcccaaaagagaacagcugccggcauuaugaagaacccuaccguugauggcaucaugacgauugaccucgaucccgugaucuacgacucuaaauucgaaaagcagcuggggcaggucaugcuucuggugcucugugccguucagcugcugcucaugcgcacaagcugggcucuuugcgaggcccugacccuggcgaccggaccuaucacaacccucugggaaggcuccccggggaaauuuuggaauacaacgauugccgugucuauggcuaacaucuuccggggaagcuaucuggccggcgcugggcuugccuuuuccauuaugaaaagcgucggaaccggcaaaagaggcacagggucucaaggagagacccugggcgaaaaguggaagaaaaagcucaaucagcugucccgcaaagauuucgaccuguacaagaaaagcgggaucacagagguggaucggaccgaggcgaaggaaggacucaaaagaggcgagauuacgcaccaugccgugucccgggggucugcuaaacuucagugguuuguugaacgcaacauggucauccccgagggaagagugauugaccugggcuguggcagagggggauggagcuauuacugcgccggccugaagaaagugaccgaaguccgcggguauacaaagggaggcccugggcacgaggagcccguuccuauguccaccuacggauggaauaucgugaaacucaugucuggcaaggauguguucuaccugcccccggaaaaaugugacacacuucugugcgauaucggcgagagcuccccuagccccaccgucgaagagucuagaacaauucgggugcucaagaugguugagcccuggcugaagaacaaucaguucuguaucaaagugcugaacccuuauaugcccaccgucauugaacaccucgagcgccuucaaagaaagcaugggggaaugcuggugcggaauccucugucccgcaacagcacgcacgaaauguacuggaucucuaauggcacagggaacauuguugcuuccgugaauauggucagcagacuccugcuuaaccgguuuaccaugacccauagacgcccgacaaucgagaaagacguggaucugggagccggcacgcggcacgugaacgcugaacccgagaccccuaauauggacgucaucggggagagaauuaagcgcaucaaagaagaacacaacucuacauggcauuaugacgaugaaaaucccuacaagaccugggccuaucacggaagcuacgagguuaaggcgacaggcuccgccucuagcaugauuaacggcguggugaaacuccugaccaagccuugggacgucgugcccaugguuacacagauggcuaugaccgauacgaccccguucgggcagcaacggguguuuaaagaaaaggucgacacaagaaccccucgcuccaugcccggaacacggagagugaugggcaucaccgccgaguggcuguggcgcacgcucgggcggaauaaaaagccuagacugugcacacgcgaggaguucaccaagaaaguucggacaaacgcugccaugggagccguguuuaccgaggaaaaucagugggauagcgcgaaggcugccgucgaggacgaagauuucuggaaacuuguggacagagagcgcgagcugcauaagcucggcaaauguggguccugcguuuauaacaugaugggcaagagagagaagaagcugggagaguuuggcaaggccaaagggucucgggcuauuugguacauguggcuuggagcccgcuaccuggaguucgaggcucucggcuuucugaaugaggaucacugguucagcagagaaaacuccuauucugggguggagggagaaggccugcauaagcucggguacauccugcgggacaucagcaaaauucccggcggagccauguaugcggaugacacggccggcugggacaccagaaucacagaggaugaccuucacaaugaagagaagauuacccagcagauggauccugagcaccggcaacuggcuaacgccaucuuuaaacucacauaccagaauaaggucgugaagguccagcgccccaccccgacagggaccgugauggacauuaucuccagaaaagaucagcggggaucuggccaaguugggacguauggacugaacacauucaccaauauggaagcucagcuuauccgccagauggagggcgaaggggugcugagcaaggccgaccucgagaacccucaucugcccgagaaaaagauuacccaguggcuggagacaaaaggcgucgagagacucaagcggauggcgaucuccggagaugacugcguggugaagcccauugaugaccgcuuugccaacgcucugcuugcccugaaugauaugggcaaaguuagaaaggacaucccucaauggcagccgagcaaaggguggcacgauuggcaacaggugcccuucuguucucaucacuuccacgaacucauuaugaaggacggacggaaacuggucgugccuugccgcccccaagacgagcuuaucggcagagcucggauuucccagggggccggauggagccugaaggaaaccgcuugucucggcaaggccuacgcgcagauguggucucugauguauuuucaucgcagagaucugcggcucgccuccaacgcuaucugcagcgccguuccugugcacuggguccccacaucucgcacgaccugguccauccaugcccaccaucaauggaugacaaccgaggacaugcugacaguguggaauagagucuggauugaagauaacccuuggauggaggacaaaacccccgugacgaccugggagaauguuccguaccuugggaagcgggaagaucagugguguggcagccugaucggacucacauccagagcuaccugggcccagaacauuccuacagcgauccagcaagugcgcagccugauuggcaaugaggaguuccuugacuacaugcccucuaugaaacgguuuagaaaggaggaggaaagcgagggggcuaucugguga

SEQ ID NO: 20537 - RNA, 9873 nt, Artificial Sequence
  derived and/or modified CDS sequence (opt5) from DENV-3__FJ898475__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggcuagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuuccuuaccuuugugcugcuccugagcgggcagauuacauggcgcgauauggcccauacccugaucaugauuggauccaaugcuagcgacagaaugggcaugggggucacguaucuugcccugaucgcgacauucaaaauccagcccuuucucgcucugggauucuuucuccggaagcugaccucuagagaaaaccuucugcucggcguggggcuggccauggccacaacccugcaacuuccugaggauauugaacagauggcuaauggaaucgcccugggccucauggcucugaaacucauuacccaguucgagacauaccagcuguggacggcccuuaucucccugaccuguagcaacacaauuuuuacccucacaguggcguggcgcaccgccacgcugauccuggcuggcgucucccuucugccgguuugccaaucuagcuccaugcggaagacagacuggcuccccauggccguggcugccaugggggugccuccccugccucucuucaucuuuucucugaaggauacccuuaaaagacgcagcuggccccugaaugagggagucauggccgugggccugguuuccauucucgcuucuagccugcuuagaaacgacgugccuauggcggggccccuggucgccggaggccuccugaucgcuuguuaugugauuaccgggacauccgccgaucucaccguugaaaaggccgcugacaucacaugggaggaagaggccgaacagacgggagugagccacaaccugaugauuaccgucgacgaugacggcacaaugcggaucaaagaugacgagaccgagaauauccuuacagugcugcugaagaccgcgcuccugauugucucuggcaucuucccguacuccauuccugcuacgcuucugguguggcauaccuggcagaaacagacacaacgcagcgggguucucugggaugugcccucuccucccgaaacccagaaggccgagcuggaagagggagucuacagaaucaaacagcagggcauuuuugggaagacacaagugggaguuggcgugcagaaggagggggucuuccacaccauguggcacgugacacggggagccgugcucacguauaacggcaaacgccuggaaccgaauugggcuuccguuaagaaagaccuuaucagcuacggcgggggauggagacugucugcccaguggcaaaagggcgaggaaguccaggugauugcgguggagccugggaaaaaccccaagaauuuucagaccaugccuggaacauuccagaccaccacaggcgaaaucggggcuaucgcccuggauuucaagcccggaacguccggcagccccauuaucaaccgggagggcaaagucguggggcucuauggaaauggcguugugaccaagaacgggggauacgucuccggcauugcccaaacaaaugcugagccugacgggccgacccccgaacuggaggaagagauguuuaaaaagcgcaaccuuacaaucauggaucugcauccuggcagcggaaaaaccagaaaguaucuccccgccauugugcgggaagcuaucaagcgcagacugcggacgcucauccuggccccuacaagaguuguggcggccgagauggaggaagcucuuaaaggccugcccauucgcuaccagaccaccgccacaaagucugagcacaccgggcgggaaaucgucgaccugaugugccaugcuacauucaccaugagacuccugagcccugugcgcguuccgaauuauaaccuuauuaucauggaugaggcccacuuuacggaccccgccuccauugcugcgcggggauacaucucuacaagagugggcaugggggaagccgcugccaucuucaugaccgccacaccucccggaaccgcugaugccuuuccucagagcaaugcgcccauucaggacgaggagcgcgacaucccggaacgguccuggaacucuggcaaugaguggauuacggauuucgcugggaaaaccgucugguuugugccuagcaucaaggccggcaacgacauugccaacugucugcgcaaaaauggaaagaaggugauccaacucuccagaaaaacauucgauaccgaauaccagaagacaaaacugaacgacugggauuuugucguuaccacagacauuucugagaugggcgcuaauuucaaggccgaucgggugaucgaccccagacggugccugaaacccgugauccucaccgaugggccugagcgcgucauucuugcgggacccaugccugugacggccgcuagcgccgcucagagacggggccgcguugggagaaacccgcagaaggaaaaugaccaauauaucuuuacaggacagccccugaacaaugaugaggaccaugcccacuggaccgaagcuaagaugcugcucgacaacauuaauaccccugagggcaucauucccgcccuguucgaaccugagcgggagaaauccgcggccaucgauggggaauacagacuuaagggcgagagccgcaaaacauucguggaacugaugcggagaggagaccuccccgucuggcuggcucacaagguggccucugagggcaucaaauauaccgaucgcaaguggugcuuugacgggcagcggaacaaucagauucuggaagagaacauggauguugagaucuggacaaaagaaggagagaagaagaaacucagaccgcgcuggcuugacgcucggacguacuccgauccucuggcccugaaggaguucaaagaguuugccgcuggcagaaagagcauugcgcucgaccuggugaccgaaaucgggcgcguccccucucaucuugcccacagaacacggaaugcucuggauaaccucgugaugcugcauaccuccgagcacggaggccgcgccuauagacacgccgucgaggaacugccugagacaauggaaacccuccuucugcugggccucaugauucugcuuacagggggagcuaugcuguuccucaucagcggcaaagggaucggaaagaccuccauuggccugaucugugugauugccucuagcgggaugcuguggauggcggagaucccccuccaauggauugccuccgcuaucguucuugaguuuuucaugauggugcugcugauuccugaacccgagaagcagcggacaccgcaggacaaucaacucgccuacguggucaucggaauccugacccuugcugccauuaucgcggccaacgaaaugggccugcucgagacaaccaaacgcgaucugggcaugagcaaggaaccugggguugugucucccacguccuaucuggacguggaucuccaucccgcuagcgccuggacacuuuacgcugucgccaccacagugauuaccccuaugcugagacacaccaucgaaaauucuacagcuaacguuagccuggccgcgauugccaaccaggcugugguccucaugggacuggacaaaggcuggccgaucuccaagauggaccuuggggugccccugcucgcccugggaugcuacucucaggucaauccucugacgcucaccgcugccgugcuucugcugaucacacauuaugccauuaucggccccgggcuccaggcgaaagcuacccgggaggcccaaaagagaacagcugccggaauuaugaagaacccuaccguugauggcaucaugacgauugaccuggaucccgugaucuacgacagcaaauuugaaaagcagcuuggccaggucaugcugcucgugcugugugccguucagcugcuccuuaugcgcacauccugggcucugugcgaggcccugacccucgcgaccgggccuaucacaacccugugggaaggaucuccgggcaaauucuggaauacaacgauugccgugagcauggcuaacaucuuucggggguccuaucuugccggagcuggccuggccuucagcauuaugaagucugucgggaccggaaaaagaggcacaggcucccaaggggagacccucggagaaaaguggaagaaaaagcugaaucagcugagccgcaaagauuuugaccucuacaagaaauccggcaucacagagguggaucggaccgaggcgaaggaagggcuuaaaagaggagagauuacgcaccaugccgugucucggggcagcgcuaagcugcagugguucguugaacgcaacauggucauccccgaggggagagugauugaccugggauguggccggggcgggugguccuauuacugcgccggacucaagaaagugaccgaaguccgcggcuauacaaaagggggaccuggccacgaggagcccguuccuaugucuaccuacggguggaauaucgugaaacugaugagcggaaaggauguguuuuaccuucccccggaaaaaugugacacacugcucugcgauaucggcgaguccagcccuucucccaccgucgaagaguccagaacaauucgggugcugaagaugguugagcccuggcugaagaacaaucaguucuguaucaaagugcucaacccuuauaugcccaccgucauugaacaccuugagcgccugcaaagaaagcauggcgggaugcuggugcggaauccucucagccgcaacucuacgcacgaaauguacuggaucuccaauggaacaggcaacauuguugcuagcgugaauauggucucuagacugcuucugaaccgguucaccaugacccauagacgcccgacaaucgagaaagacguggaucucggggccggaacgcggcacgugaacgcugaacccgagaccccuaauauggacgucaucggcgagagaauuaagcgcaucaaagaagaacacaacagcacauggcauuaugacgaugaaaaucccuacaagaccugggccuaucacggguccuacgagguuaaggcgacaggaucugccagcuccaugauuaacggcguggugaaacugcugaccaagccuugggacgucgugcccaugguuacacagauggcuaugaccgauacgaccccguuuggccagcaacggguguucaaagaaaaggucgacacaagaaccccucgcagcaugcccgggacacggagagugaugggaaucaccgccgaguggcucuggcgcacgcugggccggaauaaaaagccuagacuuugcacacgcgaggaauuuaccaagaaaguucggacaaacgcugccaugggggccguguucaccgaggaaaaucagugggauuccgcgaaggcugccgucgaggacgaagauuuuuggaaacugguggacagagagcgcgagcuccauaagcugggaaaauguggcucuugcguuuauaacaugauggggaagagagagaagaaacuuggcgaguucggaaaggccaaaggcagccgggcuauuugguacauguggcugggggcccgcuaccucgaauuugaggcucugggauuccugaaugaggaucacugguuuuccagagaaaacucuuauagcggcguggagggggaaggacuccauaagcugggcuacauccuucgggacaucuccaaaauucccgggggcgccauguaugcggaugacacggccggaugggacaccagaaucacagaggaugaccugcacaaugaagagaagauuacccagcagauggauccugagcaccggcaacucgcuaacgccaucuucaaacugacauaccagaauaaggucgugaagguccagcgccccaccccgacaggcaccgugauggacauuaucucuagaaaagaucagcgggggagcggacaaguuggcacguaugggcuuaacacauuuaccaauauggaagcucagcugauccgccagauggagggagaaggcgugcucuccaaggccgaccuggagaacccucaucugcccgagaagaagauuacccaguggcucgagacaaaaggggucgagagacugaagcggauggcgaucagcggcgaugacugcguggugaagcccauugaugaccgcuucgccaacgcccuucuggcccucaaugauaugggaaaaguuagaaaggacaucccucaauggcagccgucuaaaggcuggcacgauuggcaacaggugcccuuuuguucccaucacuuccacgaacugauuaugaaggacgggcggaaacuugucgugccuugccgcccccaagacgagcugaucggacgggcucggauuagccagggcgccggguggucucucaaggaaaccgcuugucugggaaaggccuacgcgcagauguggucccugauguauuuccaucgcagagaucuccggcuggccagcaacgcuaucugcucugccguuccugugcacuggguccccacaucccgcacgaccuggagcauccaugcccaccaucaauggaugacaaccgaggacaugcuuacaguguggaauagagucuggauugaagauaacccuuggauggaggacaaaacccccgugacgaccugggagaauguuccguaccugggcaagcgggaagaucaguggugugggucccucaucggccugacaagcagagcuaccugggcccagaacauuccuacagcgauccagcaagugcgcucucuuauuggaaaugaggaauuucuggacuacaugcccagcaugaaacgguucagaaaggaggaggaauccgagggcgcuaucugguga

SEQ ID NO: 20538 - RNA, 9873 nt, Artificial Sequence
  derived and/or modified CDS sequence (opt5) from DENV-3__GQ199861__SS-prME
accagccugugccucaugaugauccugcccgccgcucuugccuuccaccugacgucccgggacggcgaaccucggaugauuguggggaagaaugaacgcggaaagucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaccucagcccauggagcugaaguauucuuggaaaaccugggggaaggccaagaucgugacagccgaaacccaaaacuccagcuucauuaucgauggaccuaauacacccgagugcccgucugucuccagagcuuggaacgugugggaaguggaggacuacggcuuuggcgucuucaccacgaauaucuggcucaaacugcgcgaaguuuauacacagcugugugaccaccggcuuaugagcgcggccgugaaggaugagagagcugugcaugccgacaugggguacuggauugagucccagaaaaacggaucuuggaagcucgaaaaagccagccugaucgaggucaagaccugcaccuggccuaagucccacacacuguggucuaauggcgugcucgaaagcgauaugauuauccccaaaucccuggcugggccuauuagccagcauaaccaccgccccggauaccacacccaaacggccggcccuuggcaucuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcauaugaucgccggcguuuucuuuaccuucgugcuucugcucagcgggcagauuacauggcgcgauauggcccacacccugaucaugauuggauccaaugcuagcgacagaaugggcaugggggucacguaccuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaucagcucuggacggcccugaucucccuuaccuguagcaacacaauuuucacccugacaguggcguggcgcaccgccacgcucauccuggcuggcgucucccugcuuccgaugugccaaucuagcuccaugcggaagacagacuggcugcccauggccguugcugccaugggggugccuccccucccucuguuuaucuucucucucaaggauacccugaaaagacgcagcuggccccuuaaugagggagugauggccgucggccugguguccauucuggcuucuagccuccugagaaacgacguuccuauggcggggccccuuguggccggaggccugcucaucgcuuguuacgucauuaccgggacauccgccgaucugaccguggaaaaggccgcugacaucacaugggaggaagaggccgaacagacgggaguuagccauaaccucaugauuaccguggacgaugacggcacaaugcggaucaaagaugacgagaccgagaauauccugacaguccuucugaagaccgcgcugcucauugugucuggcaucuuuccguauuccauuccugcuacgcugcuugucuggcacaccuggcagaaacagacacaacgcagcggggugcugugggauguucccucuccucccgaaacccagaaggccgagcucgaagagggaguguacagaaucaaacagcagggcauuuucgggaagacacaagucggagugggcguucagaaggaggggguguuucacaccauguggcaugucacacggggagccgugcugacguacaacggcaaacgccucgaaccgaauugggcuaacgugaagaaagaccugaucuccuauggcgggggauggagacuuagcgcccaguggcaaaagggcgaggaaguucaggucauugcgguggagccugggaaaaaucccaagaacuuccagaccaugccuggaacauuccagaccaccacaggcgaaaucggggcuaucgcccuggauuuuaagcccggaacgucuggcucccccauuaucaaucgggagggcaaaguggucgggcuguacggaaacggcgugguuaccaagaaugggggauaugugagcggcauugcccaaacaaacgcugagccugacgggccgacccccgaacucgaggaagagauguucaaaaagcgcaaucugacaaucauggaucuucacccuggcuccggaaaaaccagaaaguaccugcccgccauuguccgggaagcuaucaagcgcagacuccggacgcugauccucgccccuacaagagugguugcggccgagauggaggaagcucugaaaggccuucccauucgcuaucagaccaccgccacaaagagcgagcauaccgggcgggaaaucguggaccugaugugccacgcuacauuuaccaugagacugcucucuccuguccgcgugccgaacuacaaucugauuaucauggaugaggcccauuucacggaccccgccagcauugcugcgcggggauauaucuccacaagaguuggcaugggggaagccgcugccaucuuuaugaccgccacaccucccggaaccgcugaugccuucccucagucuaacgcgcccauucaggacgaggagcgcgacaucccggaacggagcuggaacuccggcaacgaguggauuacggauuuugcugggaaaaccgugugguucgucccuucuaucaaggccggcaacgacauugccaauugucuucgcaaaaacggaaagaaggugauccaacugagcagaaaaacauuugauaccgaauaccagaagacaaaacucaaugacugggauuucguggucaccacagacauuuccgagaugggcgcuaacuuuaaggccgaucggguuaucgaccccagacggugccugaaacccgugauccugaccgaugggccugagcgcgugauucucgcgggacccaugccugucacggccgcuucugccgcucagagacggggccgcguggggagaaauccgcagaaggaaaacgaccaauacaucuucacaggacagccccuuaauaacgaugaggaccacgcccacuggaccgaagcuaagaugcugcuggacaauauuaacaccccugagggcaucauucccgcccucuucgaaccugagcgggagaaaagcgcggccaucgauggggaauauagacugaagggcgagucccgcaaaacauuuguugaacuuaugcggagaggagaccugcccguguggcucgcucauaaggucgccagcgagggcaucaaauacaccgaucgcaaguggugcuucgacgggcagcggaauaaccagauucuggaagagaauauggauguggagaucuggacaaaagaaggagagaagaagaaacugagaccgcgcuggcucgacgcucggacguauucugauccucuugcccugaaggaauuuaaagaguucgccgcuggcagaaaguccauugcgcuggaccucguuaccgaaaucgggcgcgugcccagccaccuggcccauagaacacggaacgcucuugauaaucuggucaugcuccacaccucugagcacggaggccgcgccuacagacaugccguggaggaacugccugagacaauggaaacccugcuccuucugggccugaugauucuccugacagggggagcuaugcuuuuucugaucuccggcaaagggaucggaaagaccagcauuggccucaucugugucauugccuccucugggaugcuguggauggcggagaucccccugcaauggauugccagcgcuaucgugcucgaguucuuuaugaugguucuucugauuccugaacccgagaagcagcggacaccgcaggacaaccaacuggccuauguggugaucggaauccucacccuggcugccauuaucgcggccaaugaaaugggccuucuggagacaaccaaacgcgaucucggcauguccaaggaaccuggggucguuagccccacgucuuaccuggacguggaucugcaccccgcuuccgccuggacacucuaugcuguggccaccacagucauuaccccuaugcuuagacauaccaucgagaacagcacagcuaacgugucucuggccgcgauugccaaucaggcuguugugcugaugggacucgacaaaggcuggccgaucagcaagauggaccugggggucccccuucuggcccucggaugcuacucccaggugaacccucugacgcugaccgcugccguccuccuucugaucacacacuacgccauuaucggccccgggcugcaggcgaaagcuacccgggaggcccaaaagagaacagcugccggaauuaugaagaauccuaccguggauggcaucaugacgauugaccucgaucccguuaucuaugacucuaaauucgaaaagcagcugggccaggugaugcuucugguccucugugccgugcagcugcugcucaugcgcacaagcugggcucuuugcgaggcccugacccuggcgaccgggccuaucacaacccucugggaaggauccccgggcaaauuuuggaacacaacgauugccguuucuauggcuaauaucuuccgggggagcuaccuggccggagcuggccuugccuuuuccauuaugaaaagcguggggaccggaaaaagaggcacaggcucucaaggggagacccugggagaaaaguggaagaaaaagcucaaccagcugucccgcaaagauuucgaccuguauaagaaaagcggcaucacagaggucgaucggaccgaggcgaaggaagggcucaaaagaggagagauuacgcaucacgccgugucccggggcucugcuaaacuucagugguuuguggaacgcaauaugguuauccccgaggggagagucauugaccugggauguggccggggcggguggagcuacuauugcgccggacugaagaaagugaccgaagugcgcggcuacacaaaagggggaccuggccacgaggagcccgucccuauguccaccuauggguggaacaucguuaaacucaugucuggaaaggauguguucuaccugcccccggaaaaaugugacacacuucugugcgauaucggcgagagcuccccuagccccaccguggaagagucuagaacaauucggguccucaagaugguggagcccuggcugaagaauaaccaguucuguaucaaaguucugaauccuuacaugcccaccgugauugaacaucucgagcgccuucaaagaaagcacggcgggaugcugguccggaacccucugucccgcaauagcacgcaugaaauguauuggaucucuaacggaacaggcaauauuguggcuuccguuaacauggugagcagacuccugcuuaaccgguuuaccaugacccacagacgcccgacaaucgagaaagacgucgaucugggggccggaacgcggcacgugaaugcugaacccgagaccccuaacauggacgugaucggcgagagaauuaagcgcaucaaagaagaacacaauucuacauggcacuacgacgaugaaaaccccuauaagaccugggccuaccaugggagcuaugaggucaaggcgacaggauccgccucuagcaugauuaauggcguugugaaacuccugaccaagccuugggacgugguccccauggugacacagauggcuaugaccgauacgaccccguucggccagcaacggguuuuuaaagaaaagguggacacaagaaccccucgcuccaugcccgggacacggagagucaugggaaucaccgccgaguggcuguggcgcacgcucggccggaacaaaaagccuagacugugcacacgcgaggaguucaccaagaaagugcggacaaaugcugccaugggggccguuuuuaccgaggaaaaccagugggauagcgcgaaggcugccguggaggacgaagauuucuggaaacuugucgacagagagcgcgagcugcacaagcucggaaaauguggcuccugcguguacaauaugauggggaagagagagaagaagcugggcgaguuuggaaaggccaaaggcucucgggcuauuugguauauguggcuuggggcccgcuaccuggaguucgaggcucucggauuucugaacgaggaucauugguucagcagagaaaauuccuacucuggcguugagggggaaggacugcacaagcucggcuauauccugcgggacaucagcaaaauucccgggggcgccauguacgcggaugacacggccggaugggacaccagaaucacagaggaugaccuucacaacgaagagaagauuacccagcagauggauccugagcaucggcaacuggcuaaugccaucuuuaaacucacauaucagaacaagguggucaaggugcagcgccccaccccgacaggcaccgucauggacauuaucuccagaaaagaucagcgggggucuggacaagugggcacguacgggcugaauacauucaccaacauggaagcucagcuuauccgccagauggagggagaaggcguucugagcaaggccgaccucgagaacccucaucugcccgagaagaagauuacccaguggcuggagacaaaagggguggagagacucaagcggauggcgaucuccggcgaugacugcgucgugaagcccauugaugaccgcuuugccaaugcucugcuugcccugaacgauaugggaaaagugagaaaggacaucccucaauggcagccgagcaaaggcuggcaugauuggcagcagguucccuucuguucucaccacuuccaugaacucauuaugaaggacgggcggaaacugguggucccuugccgcccccaagacgagcuuaucggacgggcucggauuucccagggcgccggguggagccugaaggaaaccgcuugucucggaaaggccuaugcgcagauguggucucugauguacuuucaccgcagagaucugcggcucgccuccaaugcuaucugcagcgccgugccuguucauugggugcccacaucucgcacgaccugguccauccacgcccaucaccaauggaugacaaccgaggacaugcugacagucuggaacagaguguggauugaagauaauccuuggauggaggacaaaacccccgucacgaccugggagaacgugccguaucuuggcaagcgggaagaucaguggugugggagccugaucggccucacauccagagcuaccugggcccagaauauuccuacagcgauccagcaaguucgcagccugauuggaaacgaggaguuccuugacuacaugcccucuaugaaacgguuuagaaaggaggaggaaagcgagggcgcuaucugguga

SEQ ID NO: 20539 - RNA, 9873 nt, Artificial Sequence
  derived and/or modified CDS sequence (opt5) from DENV-3__GQ199862__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggcuagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucucucucaaggauacccugaaaagacgcagcuggccccuuaaugagggagucauggccgugggccugguuuccauucuggcuucuagccuccugagaaacgacgugccuauggcggggccccuugucgccggaggccugcucaucgcuuguuaugugauuaccgggacauccgccgaucugaccguugaaaaggccgcugacaucacaugggaggaagaggccgaacagacgggagugagccacaaccucaugauuaccgucgacgaugacggcacaaugcggaucaaagaugacgagaccgagaauauccugacagugcuucugaagaccgcgcugcucauugucucuggcaucuuuccguacuccauuccugcuacgcugcuuguguggcauaccuggcagaaacagacacaacgcagcgggguucugugggaugugcccucuccucccgaaacccagaaggccgagcucgaagagggagucuacagaaucaaacagcagggcauucuggggaagacacaagugggaguuggcgugcagaaggagggggucuuccacaccauguggcacgugacacggggagccgugcucacguauaacggcaaacgccuggaaccgaauugggcuuccguuaagaaagaccuuaucagcuacggcgggggauggagacugucugcccaguggcaaaagggcgaggaaguccaggugauugcgguggagccugggaaaaaccccaagaauuuucagaccaugccuggaacauuccagaccaccacaggcgaaaucggggcuaucgcccuggauuucaagcccggaacguccggcagccccauuaucaaccgggagggcaaagucguggggcucuauggaaauggcguugugaccaagaacgggggauacgucuccggcauugcccaaacaaaugcugagccugacgggccgacccccgaacuggaggaagagauguuuaaaaagcgcaaccuuacaaucauggaucugcauccuggcagcggaaaaaccagaaaguaucuccccgccauugugcgggaagcuaucaagcgcagacugcggacgcucauccuggccccuacaagaguuguggcggccgagauggaggaagcucuuaaaggccugcccauucgcuaccagaccaccgccacaaagucugagcacaccgggcgggaaaucgucgaccugaugugccaugcuacauucaccaugagacuccugagcccugugcgcguuccgaauuauaaccuuauuaucauggaugaggcccacuuuacggaccccgccuccauugcugcgcggggauacaucucuacaagagugggcaugggggaagccgcugccaucuucaugaccgccacaccucccggaaccgcugaugccuuuccucagagcaaugcgcccauucaggacgaggagcgcgacaucccggaacgguccuggaacucuggcaaugaguggauuacggauuucgcugggaaaaccgucugguuugugccuagcaucaaggccggcaacgacauugccaacugucugcgcaaaaauggaaagaaggugauccaacucuccagaaaaacauucgauaccgaauaccagaagacaaaacugaacgacugggauuuugucguuaccacagacauuucugagaugggcgcuaauuucaaggccgaucgggugaucgaccccagacggugccugaaacccgugauccucaccgaugggccugagcgcgucauucuugcgggacccaugccugugacggccgcuagcgccgcucagagacggggccgcguugggagaaacccgcagaaggaaaaugaccaauauaucuuuacaggacagccccugaacaaugaugaggaccaugcccacuggaccgaagcuaagaugcugcucgacaacauuaauaccccugagggcaucauucccgcccuguucgaaccugagcgggagaaauccgcggccaucgauggggaauacagacuuaagggcgagagccgcaaaacauucguggaacugaugcggagaggagaccuccccgucuggcuggcucacaagguggccucugagggcaucaaauauaccgaucgcaaguggugcuuugacgggcagcggaacaaucagauucuggaagagaacauggauguugagaucuggacaaaagaaggagagaagaagaaacucagaccgcgcuggcuugacgcucggacguacuccgauccucuggcccugaaggaguucaaagaguuugccgcuggcagaaagagcauugcgcucgaccuggugaccgaaaucgggcgcguccccucucaucuugcccacagaacacggaaugcucuggauaaccucgugaugcugcauaccuccgagcacggaggccgcgccuauagacacgccgucgaggaacugccugagacaauggaaacccuccuucugcugggccucaugauucugcuuacagggggagcuaugcuguuccucaucagcggcaaagggaucggaaagaccuccauuggccugaucugugugauugccucuagcgggaugcuguggauggcggagaucccccuccaauggauugccuccgcuaucguucuugaguuuuucaugauggugcugcugauuccugaacccgagaagcagcggacaccgcaggacaaucaacucgccuacguggucaucggaauccugacccuugcugccauuaucgcggccaacgaaaugggccugcucgagacaaccaaacgcgaucugggcaugagcaaggaaccugggguugugucucccacguccuaucuggacguggaucuccaucccgcuagcgccuggacacuuuacgcugucgccaccacagugauuaccccuaugcugagacacaccaucgaaaauucuacagcuaacguuagccuggccgcgauugccaaccaggcugugguccucaugggacuggacaaaggcuggccgaucuccaagauggaccuuggggugccccugcucgcccugggaugcuacucucaggucaauccucugacgcucaccgcugccgugcuucugcugaucacacauuaugccauuaucggccccgggcuccaggcgaaagcuacccgggaggcccaaaagagaacagcugccggaauuaugaagaacccuaccguugauggcaucaugacgauugaccuggaucccgugaucuacgacagcaaauuugaaaagcagcuuggccaggucaugcugcucgugcugugugccguucagcugcuccuuaugcgcacauccugggcucugugcgaggcccugacccucgcgaccgggccugugacaacccugugggaaggaucuccgggcaaauucuggaauacaacgaucgccgucagcauggcuaacauuuuucggggguccuaucuugccggagcuggccuggccuucagcaucaugaagucuguggggaccggaaaaagaggcacaggcucccaaggggagacccucggagaaaaguggaagaaaaagcugaaucagcugagccgcaaagauuuugaccucuacaagaaauccggcauuacagagguggaucggaccgaggcgaaggaagggcuuaaaagaggagagaucacgcaccaugccguuucucggggcagcgcuaagcugcagugguucgucgaacgcaacauggugauucccgaggggagagugaucgaccugggauguggccggggcgggugguccuauuacugcgccggacucaagaaagucaccgaaguucgcggcuauacaaaagggggaccuggccacgaggagcccgugccuaugucuaccuacggguggaauauugugaaacugaugagcggaaaggaugucuuuuaccuucccccggaaaaaugugacacacugcucugcgauaucggcgaguccagcccuucucccaccguggaagaguccagaacaauccggguucugaagaugguggagcccuggcugaagaacaaucaguucuguauuaaaguccucaacccuuauaugcccaccgugaucgaacaccuugagcgccugcaaagaaagcauggcgggaugcugguucggaauccucucagccgcaacucuacgcacgaaauguacuggauuuccaauggaacaggcaacaucguggcuagcgucaauauggugucuagacugcuucugaaccgguucaccaugacccauagacgcccgacaauugagaaagacguggaucucggggccggaacgcggcacgucaacgcugaacccgagaccccuaauauggacguuaucggcgagagaaucaagcgcauuaaagaagaacacaacagcacauggcauuaugacgaugaaaaucccuacaagaccugggccuaucacggguccuacgaggugaaggcgacaggaucugccagcuccaugaucaacggcguggucaaacugcugaccaagccuugggacgugguucccauggugacacagauggcuaugaccgauacgaccccguuuggccagcaacgggucuucaaagaaaagguggacacaagaaccccucgcagcaugcccgggacacggagaguuaugggaauuaccgccgaguggcucuggcgcacgcugggccggaauaaaaagccuagacuuugcacacgcgaggaauuuaccaagaaagugcggacaaacgcugccaugggggccgucuucaccgaggaaaaucagugggauuccgcgaaggcugccguggaggacgaagauuuuuggaaacugguugacagagagcgcgagcuccauaagcugggaaaauguggcucuugcguguauaacaugauggggaagagagagaagaaacuuggcgaguucggaaaggccaaaggcagccgggcuaucugguacauguggcugggggcccgcuaccucgaauuugaggcucugggauuccugaaugaggaucacugguuuuccagagaaaacucuuauagcggcgucgagggggaaggacuccauaagcugggcuacauucuucgggacaucuccaaaauccccgggggcgccauguaugcggaugacacggccggaugggacaccagaauuacagaggaugaccugcacaaugaagagaagaucacccagcagauggauccugagcaccggcaacucgcuaacgccauuuucaaacugacauaccagaauaagguggucaaggugcagcgccccaccccgacaggcaccguuauggacaucauuucuagaaaagaucagcgggggagcggacaagugggcacguaugggcuuaacacauuuaccaauauggaagcucagcugauccgccagauggagggagaaggcguccucuccaaggccgaccuggagaacccucaucugcccgagaagaagaucacccaguggcucgagacaaaagggguggagagacugaagcggauggcgauuagcggcgaugacugcgugguuaagcccaucgaugaccgcuucgccaacgcccuucuggcccucaaugauaugggaaaagugagaaaggacauuccucaauggcagccgucuaaaggcuggcacgauuggcagcagguccccuuuuguucccaucacuuccacgaacugaucaugaaggacgggcggaaacuugugguuccuugccgcccccaagacgagcugauuggacgggcucggaucagccagggcgccggguggucucucaaggaaaccgcuugucugggaaaggccuacgcgcagauguggucccugauguauuuccaucgcagagaucuccggcuggccagcaacgcuauuugcucugccgugccuguccacugggugcccacaucccgcacgaccuggagcauccaugcccaccaucaauggaugacaaccgaggacaugcuuacagucuggaauagaguguggaucgaagauaacccuuggauggaggacaaaacccccguuacgaccugggagaaugugccguaccugggcaagcgggaagaucaguggugugggucccucauuggccugacaagcagagcuaccugggcccagaacaucccuacagcgauucagcaaguccgcucucuuaucggaaaugaggaauuucuggacuacaugcccagcaugaaacgguucagaaaggaggaggaauccgagggcgcuauuugguga

SEQ ID NO: 20540 - RNA, 9873 nt, Artificial Sequence
  derived and/or modified CDS sequence (opt5) from DENV-3__GQ199863__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggugauccugcccgaauauggcacgcuggggcucgagugcuccccucgcaccggacuggacuucaaugagaugauucuucugacaaugaaaaacaaggcuuggaugguccauagacagugguuuuucgaucucccccugccguggaccagcggcgccacaaccgaaacgccuacauggaaucggaaagagcuucuggugaccuuuaagaacgcccacgcuaaaaagcaagaagucgugguucucgggucucaggagggagcgaugcacacagcccugaccggcgcuaccgaaauccaaaauuccgggggcacaagcauuuucgccggacaucugaagugucgccucaaaauggacaagcuggagcuuaaaggcaugucuuacgccaugugcacgaacaccuuugugcugaagaaagaggucuccgaaacacagcacgggaccauccucaucaagguggaguacaagggagaagauguucccuguaaaauuccuuucagcacagaggacggccaagggaaggcucauaacggaagacugaucaccgccaaucccguggucacgaaaaaggaggaacccgugaacauugaggcggaaccuccguucggcgaguccaauaucgugauugggaucggcgauaacgcucugaaaaucaauugguauaagaagggaucuagcauuggcaaaauguuugaagccacagccagaggggcuagacgcauggccauccuuggagacaccgcuugggauuucggcuccguugggggaguccucaacagccugggcaagauggugcaccagauuuuugggucugccuacaccgcgcuguucuccggcgugagcugggucaugaaaaucggaauuggcgugcuccugacauggaucgggcuuaauucuaagaacaccagcauguccuuuucuugcauugccaucggaaucauuacacuguaucucggcgcuguugugcaggccgacauggggugugucaucaauuggaaaggaaaggagcugaagugcggcagcgggauuuucgugacgaacgagguucauaccuggacagaacaguacaaauuucaagcugauucccccaagcggcuggccaccgcgaucgccggcgcuugggagaauggaguguguggcauuagaagcacaacccgcauggaaaaccuucucuggaaacagaucgccaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggcuaagaucgucacagccgaaacccaaaacuccagcuucauuaucgauggaccuaauacacccgagugcccgucuguguccagagccuggaacgugugggaagucgaggacuauggcuuuggcguuuucaccacgaauaucuggcucaaacugcgcgaaguguacacacagcugugugaccaccggcuuaugagcgcugcggugaaggaugagagagccguccacgcugacaugggguacuggauugagucccagaaaaacggaucuuggaagcucgaaaaagccagccugaucgaggugaagaccugcaccuggccuaagucccauacacuguggucuaauggcguucucgaaagcgauaugauuauccccaaaucccuggccgggccuauuagccagcacaaccaucgccccggauaucacacccaaacggcuggcccuuggcaccuugggaagcuggagcucgacuuuaauuacugcgagggaacaaccguggucaucacagaaaacuguggcacccggggccccucucugagaacaaccacgguguccgggaaacugauccaugaguggugcugucgcagcugcacccuuccgccucuccgguauaugggagaagauggcuguugguacgggauggagauuagacccaucucugaaaaggaggagaauaugguuaaaucccuggugagcgccggaucuggcaaggucgacaacuucacaaugggggugcugugccucgcgauucuguuugaagagguuaugcggggaaaguucggcaaaaagcacaugaucgcuggcguguucuuuaccuucguccuucugcucagcgggcagauuacauggcgcgauauggcccauacccugaucaugauuggauccaaugccagcgacagaaugggcaugggggugacguaucuggcucuuaucgccacauuuaaaauccagcccuuccuggcgcucggauuuuuccugcggaagcucaccucuagagaaaaccugcuucugggcguggggcucgcuauggccacaacccugcaacugccugaggauauugaacagauggccaauggaaucgcucuuggccugauggcccucaaacugauuacccaguuugagacauaccagcucuggacggcucugaucucccuuaccuguagcaacacaauuuucacccugacagucgccuggcgcaccgcgacgcucauccuggccggcguuucccugcuuccggugugccaaucuagcuccaugcggaagacagacuggcugcccauggcuguggccgcuaugggggucccuccccucccucuguuuaucuucucucucaaggauacccugaaaagacgcagcuggccccuuaaugagggagugauggccguuggccugguguccauucuggccucuagccuccugagaaacgacgucccuauggcugggccccuuguggcgggaggccugcucaucgccuguuauguuauuaccgggacauccgcugaucugaccguggaaaaggccgccgacaucacaugggaggaagaggcugaacagacgggagucagccacaaccucaugauuaccguggacgaugacggcacaaugcggaucaaagaugacgagaccgagaauauccugacaguccuucugaagaccgcccugcucauugugucuggcaucuuuccguacuccauuccugcgacgcugcuuguuuggcauaccuggcagaaacagacacaacgcagcggggugcugugggauguccccucuccucccgaaacccagaaggcugagcucgaagagggaguguacagaaucaaacagcagggcauuuucgggaagacacaaguuggagugggcguccagaaggaggggguguuucacaccauguggcacgugacacggggagccguucugacguauaacggcaaacgccucgaaccgaauugggccuccgucaagaaagaccugaucagcuacggcgggggauggagacuuucugcucaguggcaaaagggcgaggaaguccaggugauugccgucgagccugggaaaaaccccaagaauuuccagaccaugccuggaacauuccagaccaccacaggcgaaaucggggcgaucgcucuggauuuuaagcccggaacguccggcagccccauuaucaaccgggagggcaaagugguugggcuguauggaaauggcguggucaccaagaacgggggauacguguccggcauugcccaaacaaaugccgagccugacgggccgacccccgaacucgaggaagagauguucaaaaagcgcaaccugacaaucauggaucuucauccuggcagcggaaaaaccagaaaguaucugcccgcuauuguucgggaagccaucaagcgcagacuccggacgcugauccucgcuccuacaagaguggucgccgcggagauggaggaagcccugaaaggccuucccauucgcuaccagaccaccgcuacaaagucugagcacaccgggcgggaaaucguggaccugaugugccaugccacauuuaccaugagacugcucagcccuguucgcgugccgaauuauaaccugauuaucauggaugaggcucacuucacggaccccgccuccauugccgcucggggauacaucucuacaagagucggcaugggggaagcggccgcuaucuuuaugaccgccacaccucccggaaccgccgaugcuuucccucagagcaaugcccccauucaggacgaggagcgcgacaucccggaacgguccuggaacucuggcaaugaguggauuacggauuuugcggggaaaaccgugugguucgugccuagcaucaaggcuggcaacgacauugccaacugucuucgcaaaaauggaaagaaggucauccaacuguccagaaaaacauuugauaccgaauaccagaagacaaaacucaacgacugggauuucguugugaccacagacauuucugagaugggcgccaauuuuaaggcugaucgggugaucgaccccagacggugccugaaacccgucauccugaccgaugggccugagcgcgugauucucgccggacccaugccuguuacggcggccagcgcugcccagagacggggccgcguggggagaaacccgcagaaggaaaaugaccaauauaucuucacaggacagccccuuaacaaugaugaggaccaugcucacuggaccgaagccaagaugcugcuggacaacauuaauaccccugagggcaucauucccgcucucuucgaaccugagcgggagaaauccgccgcgaucgauggggaauacagacugaagggcgagagccgcaaaacauuugucgaacuuaugcggagaggagaccugcccguguggcucgcccacaagguugcuucugagggcaucaaauauaccgaucgcaaguggugcuucgacgggcagcggaacaaucagauucuggaagagaacauggauguggagaucuggacaaaagaaggagagaagaagaaacugagaccgcgcuggcucgacgcccggauuuacuccgauccucuugcucugaaggaauuuaaagaguucgccgccggcagaaagagcaucgcucuggaccucgucacggaaauugggcgcgugcccucucaucuggcgcacagaacccggaaugcccuugauaaccuggucaugcuccauacauccgagcacggaggccgcgcuuauagacacgccguggaggaacugccugagaccauggaaacacugcuccuucugggccugaugauccuccugaccgggggagccaugcuuuuucugaucagcggcaaagggauuggaaagacguccaucggccucauuuguguuaucgcuucuagcgggaugcuguggauggccgagauuccccugcaauggaucgcguccgccauugugcucgaguucuuuaugauggugcuucugaucccugaacccgagaagcagcggaccccgcaggacaaucaacuggcuuacgucguuaucggcauucucacacuggccgcuaucauugccgcgaacgaaaugggccuucuggagaccacaaaacgcgaucucggcaugagcaaggaaccugggguggugucucccaccuccuaucuggacgucgaucugcaucccgccagcgcuuggacgcucuacgccguggcuacaaccguuaucacaccuaugcuuagacacaccauugaaaauucuaccgccaacgugagccuggcugccaucgcgaaccaggccgucgugcugaugggacucgacaaaggcuggccgaucuccaagauggaccugggggucccccuucuggcucucggaugcuacucucaggugaauccucugacacugacggccgcuguucuccuucugauuacccauuaugccaucauuggccccgggcugcaggccaaagcgacacgggaggcucaaaagagaaccgccgcuggaaucaugaagaacccuacaguggauggcauuaugaccaucgaccucgaucccgucaucuacgacagcaaauucgaaaagcagcugggccaggugaugcuucugguucucugugccgugcagcugcugcucaugcgcacguccugggcccuuugcgaggcucugacacuggccaccgggccuauuaccacacucugggaaggaucuccgggcaaauuuuggaauaccacaaucgcggucagcauggccaacauuuuccggggguccuaucuggcuggagccggccuugcuuuuagcaucaugaagucuguggggacgggaaaaagaggcaccggcucccaaggggagacacugggagaaaaguggaagaaaaagcucaaucagcugagccgcaaagauuucgaccuguacaagaaauccggcauuaccgagguggaucggacagaggccaaggaagggcucaaaagaggagagaucacccaccaugcgguuucucggggcagcgccaaacuucagugguuugucgaacgcaacauggugauucccgaggggagagugaucgaccugggauguggccggggcgggugguccuauuacugcgcuggacugaagaaagucacggaaguucgcggcuauaccaaagggggaccuggccacgaggagcccgugccuaugucuacauacggguggaauaucgugaaacucaugagcggaaaggaugucuucuaccugcccccggaaaaaugugacacccuucugugcgauauuggcgaguccagcccuucucccacaguggaagaguccagaaccauccggguucucaagaugguggagcccuggcugaagaacaaucaguucuguauuaaaguccugaacccuuauaugcccacagugaucgaacaccucgagcgccuucaaagaaagcauggcgggaugcugguucggaauccucugagccgcaacucuacccacgaaauguacuggauuuccaauggaacgggcaacaucguggccagcgucaauauggugucuagacuccugcuuaaccgguuuacaaugacccauagacgcccgaccaucgagaaagacguggaucugggggcuggaacacggcacgucaacgccgaacccgagacgccuaauauggacguuauuggcgagagaaucaagcgcauuaaagaagaacacaacagcaccuggcauuaugacgaugaaaaucccuacaagacaugggcuuaucacggguccuacgaggugaaggccaccggaucugcgagcuccaugaucaacggcguggucaaacuccugacaaagccuugggacgugguucccauggugacccagauggccaugacagauaccacgccguucggccagcaacgggucuuuaaagaaaagguggacaccagaacaccucgcagcaugcccgggacccggagaguuaugggaauuacagcugaguggcuguggcgcacccucggccggaauaaaaagccuagacugugcacgcgcgaggaguucacaaagaaagugcggaccaacgccgcuaugggggccgucuuuacagaggaaaaucagugggauuccgccaaggcggcuguggaggacgaagauuucuggaaacuuguugacagagagcgcgagcugcauaagcucggaaaauguggcucuugcguguauaacaugauggggaagagagagaagaagcugggcgaguuuggaaaggccaaaggcagccgggccaucugguacauguggcuuggggcucgcuaccuggaguucgaggcccucggauuucugaaugaggaucacugguucuccagagaaaacucuuauagcggcgucgagggggaaggacugcauaagcucggcuacauccugcgggacauuuccaaaauccccgggggcgcuauguaugccgaugacaccgcgggaugggacacgagaauuaccgaggaugaccuucacaaugaagagaagaucacacagcagauggauccugagcaccggcaacuggccaacgcuauuuuuaaacucaccuaccagaauaagguggucaaggugcagcgccccacaccgaccggcacaguuauggacaucaucucuagaaaagaucagcgggggagcggacaagugggcaccuaugggcugaacacguucacaaauauggaagcccagcuuauucgccagauggagggagaaggcguccuguccaaggcugaccucgagaacccucaucugcccgagaagaagaucacccaguggcuggagaccaaagggguggagagacucaagcggauggccauuagcggcgaugacugcgugguuaagcccaucgaugaccgcuuugcgaacgcccugcuugcucugaaugauaugggaaaagugagaaaggacauuccucaauggcagccgucuaaaggcuggcacgauuggcagcagguccccuucuguucccaucacuuccacgaacucaucaugaaggacgggcggaaacuggugguuccuugccgcccccaagacgagcuuauuggacgggcccggaucagccagggcgcuggguggucucugaaggaaacagccugucucggaaaggcuuacgcccagauguggucccugauguauuuucaucgcagagaucugcggcucgcgagcaacgccaucugcucugcugugccuguccacugggugcccaccucccgcacaacguggagcauucaugcccaccaucaauggaugaccacagaggacaugcugaccgucuggaauagaguguggaucgaagauaacccuuggauggaggacaaaacacccguuaccacgugggagaaugugccguaccuuggcaagcgggaagaucaguggugugggucccugauuggccucaccagcagagccacaugggcucagaacaucccuaccgccauucagcaaguccgcucucugaucggaaaugaggaguuccuugacuacaugcccagcaugaaacgguuuagaaaggaggaggaauccgagggcgcgaucugguga

SEQ ID NO: 20541 - RNA, 9873 nt, Artificial Sequence
  derived and/or modified CDS sequence (opt5) from DENV-3__GQ199864__SS-prME
accagccugugccucaugaugauccugcccgccgcucuugccuuccaccugacgucccgggacggagaaccucggaugauuguggggaagaaugaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacugaacaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaucgggauuuugucgaagggcucagcggagcuaccuggguggacgugguccuggagcacggcgggugcguuaccacaauggccaagaacaaacccacgcuggauauugagcuccagaagaccgaagcuacacaacuggccacccuucgcaaacuguguaucgagggaaagauuacaaauaucaccacggacuccagaugcccuacacagggcgaagcgacccucccggaggaacaggaucagaacuauguguguaaacacaccuacguggaccggggcugggggaauggaugcggccuguucgggaagggaagccuugucacaugcgccaaguuucaaugucuggagcccauugagggcaaagugguucagcaugaaaaccucaaguauaccgugaucaucacaguccacacgggggaucagcaucaggugggaaaugagacccaaggcguuacagcugaaauuaccccucaggccucuacaaccgaggcuauccugcccgaauacggcacgcuggggcucgagugcuccccucgcaccggacuggacuucaacgagaugauucuucugacaaugaaaaauaaggccuggauggugcacagacagugguuuuucgaccucccccugccguggaccagcggcgccacaaccgaaacgccuacauggaaccggaaagagcuucuggucaccuuuaagaaugcucacgcgaaaaagcaagaaguggucgugcucgggucucaggagggagccaugcauacagcucugaccggcgccaccgaaauccagaacuccgggggcacaagcauuuucgccggacaccugaagugucgccucaaaauggauaagcuggagcuuaaaggcaugucuuaugcuaugugcacgaacaccuuuguucugaagaaagagguguccgaaacacagcaugggaccauccucaucaaggucgaguacaagggagaagacgugcccuguaaaauuccuuucagcacagaggauggccaagggaaggcccacaauggaagacugaucaccgcgaaccccguugugacgaaaaaggaggaacccgucaauauugaggcugaaccuccguucggcgaguccaacaucgugauugggaucggcgacaaugcccugaaaaucaacugguacaagaagggaucuagcauuggcaaaauguuugaagccacagcuagaggggccagacgcauggcuauccuuggagauaccgccugggacuucggcuccgucgggggaguucucaauagccugggcaagaugguccaucagauuuuugggucugcguauaccgcccuguucuccggcgugagcugggugaugaaaaucggaauuggcguccuccugacauggaucgggcuuaacucuaagaauaccagcauguccuuuucuugcauugcuaucggaaucauuacacuguaccucggcgccgugguucaggcugauauggggugugugaucaacuggaaaggaaaggagcugaagugcggcagcgggauuuucgucacgaaugaggugcacaccuggacagaacaguauaaauuucaagccgacucccccaagcggcuggcgaccgccaucgcuggcgccugggagaacggaguuuguggcauuagaagcacaacccgcauggaaaaucuucucuggaaacagaucgcuaacgagcugaauuacauccugugggaaaacaacauuaagcucacgguggucgugggggauaucauuggaguucuggagcagggcaaacggacccuuacaccucagcccauggagcugaaguauucuuggaaaaccugggggaaggccaagaucgugacagccgaaacccaaaauuccagcuucauuaucgacggaccuaacacacccgagugcccgucugucuccagagcuuggaaugugugggaaguggaggauuacggcuuuggcgucuucaccacgaacaucuggcucaaacugcgcgaaguuuauacacagcugugugaccaccggcuuaugagcgcggccgugaaggacgagagagcugugcaugccgauaugggguacuggauugagucccagaaaaauggaucuuggaagcucgaaaaagccagccugaucgaggucaagaccugcaccuggccuaagucccacacacuguggucuaacggcgugcucgaaagcgacaugauuauccccaaaucccuggcugggccuauuagccagcauaaucaccgccccggauaccacacccaaacggccggcccuuggcaucuugggaagcuggagcucgauuuuaacuauugcgagggaacaaccguugugaucacagaaaauuguggcacccggggccccucucugagaacaaccacggucuccgggaaacugauccacgaguggugcugucgcagcugcacccuuccgccucuccgguacaugggagaagacggcuguugguaugggauggagauuagacccaucucugaaaaggaggagaacauggugaaaucccugguuagcgcgggaucuggcaagguggauaauuucacaauugggguccugugccucgcuauccuguuugaagaggugaugcggggaaaguucggcaaaaagcauaugauugccggcguuuucuuuaccuucgugcuucugcucagcgggcagaucacauggcgcgacauggcccacacccugauuaugaucggauccaacgcuagcgauagaaugggcaugggggucacguaccuggcccuuaucgcgacauuuaaaauucagcccuuccuggcucucggauuuuuccugcggaagcucaccucuagagaaaaucugcuucugggcguggggcucgccauggccacaacccugcaacugccugaggacaucgaacagauggcuaacggaauugcccuuggccugauggcucucaaacugaucacccaguuugagacauaucagcucuggacggcccugauuucccuuaccuguagcaauacaaucuucacccugacaguggcguggcgcaccgccacgcucauccuggcuggcgucucccugcuuccgguuugccaaucuagcuccaugcggaagacagauuggcugcccauggccguggcugccaugggggugccuccccucccucuguuuauuuucucucucaaggacacccugaaaagacgcagcuggccccuuaacgagggagucauggccgugggccugguuuccauccuggcuucuagccuccugagaaacgaugugccuauggcggggccccuugucgccggaggccugcucauugcuuguuacgugaucaccgggacauccgccgaccugaccguugaaaaggccgcugauauuacaugggaggaagaggccgaacagacgggagugagccauaaucucaugaucaccgucgacgacgauggcacaaugcggaucaaagacgaugagaccgagaacauucugacagugcuucugaagaccgcgcugcucaucgucucuggcauuuuuccguauuccaucccugcuacgcugcuuguguggcacaccuggcagaaacagacacaacgcagcgggguucugugggacgugcccucuccucccgaaacccagaaggccgagcucgaagagggagucuacagaauuaaacagcagggcaucuucgggaagacacaagugggaguuggcgugcagaaggagggggucuuucacaccauguggcaugugacacggggagccgugcugacguacaauggcaaacgccucgaaccgaacugggcuuccguuaagaaagaucugauuagcuauggcgggggauggagacuuucugcccaguggcaaaagggcgaggaaguccaggugaucgcgguggagccugggaaaaaucccaagaacuuccagaccaugccuggaacauuccagaccaccacaggcgaaaucggggcuauugcccuggacuuuaagcccggaacguccggcagccccaucauuaaucgggagggcaaagucguggggcuguacggaaacggcguugugaccaagaaugggggauaugucuccggcaucgcccaaacaaacgcugagccugaugggccgacccccgaacucgaggaagagauguucaaaaagcgcaaucugacaauuauggaccuucacccuggcagcggaaaaaccagaaaguaccugcccgccaucgugcgggaagcuaucaagcgcagacuccggacgcugauucucgccccuacaagaguuguggcggccgagauggaggaagcucugaaaggccuucccauccgcuaucagaccaccgccacaaagucugagcauaccgggcgggaaauugucgaucugaugugccacgcuacauuuaccaugagacugcucagcccugugcgcguuccgaacuacaaucugaucauuauggacgaggcccauuucacggaucccgccuccaucgcugcgcggggauauaucucuacaagagugggcaugggggaagccgcugccauuuuuaugaccgccacaccucccggaaccgcugacgccuucccucagagcaacgcgcccauccaggaugaggagcgcgacauuccggaacgguccuggaacucuggcaacgaguggaucacggacuuugcugggaaaaccgucugguucgugccuagcauuaaggccggcaacgauaucgccaauugucuucgcaaaaacggaaagaaggugauucaacuguccagaaaaacauuugacaccgaauaccagaagacaaaacucaaugauugggacuucgucguuaccacagauaucucugagaugggcgcuaacuuuaaggccgaccgggugaucgaucccagacggugccugaaacccgugauucugaccgacgggccugagcgcgucauccucgcgggacccaugccugugacggccgcuagcgccgcucagagacggggccgcguugggagaaauccgcagaaggaaaacgaucaauacauuuucacaggacagccccuuaauaacgacgaggaucacgcccacuggaccgaagcuaagaugcugcuggacaauaucaacaccccugagggcauuauccccgcccucuucgaaccugagcgggagaaauccgcggccaucgacggggaauauagacugaagggcgagagccgcaaaacauuuguggaacuuaugcggagaggagaucugcccgucuggcucgcucauaagguggccucugagggcauuaaauacaccgaccgcaaguggugcuucgaugggcagcggaauaaccagauccuggaagagaauauggacguugagauuuggacaaaagaaggagagaagaagaaacugagaccgcgcuggcucgaugcucggacguauuccgacccucuugcccugaaggaauuuaaagaguucgccgcuggcagaaagagcaucgcgcuggaucucgugaccgaaauugggcgcguccccucucaccuggcccauagaacacggaacgcucuugacaaucuggugaugcuccacaccuccgagcacggaggccgcgccuacagacaugccgucgaggaacugccugagacaauggaaacccugcuccuucugggccugaugauccuccugacagggggagcuaugcuuuuucugaucagcggcaaagggauuggaaagaccuccaucggccucauuugugugaucgccucuagcgggaugcuguggauggcggagauuccccugcaauggaucgccuccgcuauuguucucgaguucuuuaugauggugcuucugaucccugaacccgagaagcagcggacaccgcaggauaaccaacuggccuauguggucaucggcauucucacccuggcugccaucauugcggccaaugaaaugggccuucuggagacaaccaaacgcgaccucggcaugagcaaggaaccugggguugugucucccacguccuaccuggauguggaccugcaccccgcuagcgccuggacacucuaugcugucgccaccacagugaucaccccuaugcuuagacauaccauugagaacucuacagcuaacguuagccuggccgcgaucgccaaucaggcugugguccugaugggacucgauaaaggcuggccgaucuccaagauggaccugggggugccccuucuggcccucggaugcuacucucaggucaacccucugacgcugaccgcugccgugcuccuucugauuacacacuacgccaucauuggccccgggcugcaggcgaaagcuacccgggaggcccaaaagagaacagcugccggaaucaugaagaauccuaccguugacggcauuaugacgaucgaucucgaccccgugaucuaugauagcaaauucgaaaagcagcugggccaggucaugcuucuggugcucugugccguucagcugcugcucaugcgcacauccugggcucuuugcgaggcccugacccuggcgaccgggccuauuacaacccucugggaaggaucuccgggcaaauuuuggaacacaacgaucgccgugagcauggcuaauauuuuccggggguccuaccuggccggagcuggccuugccuuuagcaucaugaagucugucgggaccggaaaaagaggcacaggcucccaaggggagacccugggagaaaaguggaagaaaaagcucaaccagcugagccgcaaagacuucgaucuguauaagaaauccggcauuacagagguggaccggaccgaggcgaaggaagggcucaaaagaggagagaucacgcaucacgccgugucucggggcagcgcuaaacuucagugguuuguugaacgcaauauggucauucccgaggggagagugaucgaucugggauguggccggggcgggugguccuacuauugcgccggacugaagaaagugaccgaaguccgcggcuacacaaaagggggaccuggccacgaggagcccguuccuaugucuaccuauggguggaacaucgugaaacucaugagcggaaaggacguguucuaccugcccccggaaaaaugugauacacuucugugcgacauuggcgaguccagcccuucucccaccgucgaagaguccagaacaauccgggugcucaagaugguugagcccuggcugaagaauaaccaguucuguauuaaagugcugaauccuuacaugcccaccgucaucgaacaucucgagcgccuucaaagaaagcacggcgggaugcuggugcggaacccucugagccgcaauucuacgcaugaaauguauuggauuuccaacggaacaggcaauaucguugcuagcgugaacauggucucuagacuccugcuuaaccgguuuaccaugacccacagacgcccgacaaucgagaaagauguggaccugggggccggaacgcggcacgugaaugcugaacccgagaccccuaacauggaugucauuggcgagagaaucaagcgcauuaaagaagaacacaauagcacauggcacuacgacgacgaaaaccccuauaagaccugggccuaccauggguccuaugagguuaaggcgacaggaucugccagcuccaugaucaauggcguggugaaacuccugaccaagccuugggaugucgugcccaugguuacacagauggcuaugaccgacacgaccccguucggccagcaacggguguuuaaagaaaaggucgauacaagaaccccucgcagcaugcccgggacacggagagugaugggaauuaccgccgaguggcuguggcgcacgcucggccggaacaaaaagccuagacugugcacacgcgaggaguucaccaagaaaguucggacaaaugcugccaugggggccguguuuaccgaggaaaaccagugggacuccgcgaaggcugccgucgaggaugaagacuucuggaaacuuguggauagagagcgcgagcugcacaagcucggaaaauguggcucuugcguuuacaauaugauggggaagagagagaagaagcugggcgaguuuggaaaggccaaaggcagccgggcuaucugguauauguggcuuggggcccgcuaccuggaguucgaggcucucggauuucugaacgaggaccauugguucuccagagaaaauucuuacagcggcguggagggggaaggacugcacaagcucggcuauauccugcgggauauuuccaaaauccccgggggcgccauguacgcggacgauacggccggaugggacaccagaauuacagaggacgaucuucacaacgaagagaagaucacccagcagauggacccugagcaucggcaacuggcuaaugccauuuuuaaacucacauaucagaacaaggucgugaagguccagcgccccaccccgacaggcaccgugauggauaucaucucuagaaaagaccagcgggggagcggacaaguuggcacguacgggcugaauacauucaccaacauggaagcucagcuuauucgccagauggagggagaaggcgugcuguccaaggccgaucucgagaacccucaucugcccgagaagaagaucacccaguggcuggagacaaaaggggucgagagacucaagcggauggcgauuagcggcgacgauugcguggugaagcccaucgacgaucgcuuugccaaugcucugcuugcccugaacgacaugggaaaaguuagaaaggauauuccucaauggcagccgucuaaaggcuggcaugacuggcaacaggugcccuucuguucccaccacuuccaugaacucaucaugaaggaugggcggaaacuggucgugccuugccgcccccaagacgagcuuauuggacgggcucggaucagccagggcgccggguggucucugaaggaaaccgcuugucucggaaaggccuaugcgcagauguggucccugauguacuuucaccgcagagaccugcggcucgccagcaaugcuaucugcucugccguuccugugcauuggguccccacaucccgcacgaccuggagcauucacgcccaucaccaauggaugacaaccgaggauaugcugacaguguggaacagagucuggaucgaagacaauccuuggauggaggauaaaacccccgugacgaccugggagaacguuccguaucuuggcaagcgggaagaccaguggugugggucccugauuggccucacaagcagagcuaccugggcccagaauaucccuacagcgauucagcaagugcgcucucugaucggaaacgaggaguuccuugauuacaugcccagcaugaaacgguuuagaaaggaggaggaauccgagggcgcuaucugguga

SEQ ID NO: 20542 - RNA, 9873 nt, Artificial Sequence
  derived and/or modified CDS sequence (opt5) from DENV-3__GQ199865__SS-prME
accagccugugccucaugaugauccugcccgccgcucuugccuuccaccugacaucccgggacggagaaccucggaugauuguggggaagaaugaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucggcgggguucucaacagccuggggaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaccucagcccauggagcugaaguauucuuggaaaaccugggggaaggccaagaucgugacagccgaaacccaaaacuccagcuucauuaucgauggaccuaauacacccgagugcccgucugucuccagagcuuggaacgugugggaaguggaggacuacggcuuuggcgucuucaccacgaauaucuggcucaaacugcgcgaaguuuauacacagcugugugaccaccggcuuaugagcgcggccgugaaggaugagagagcugugcaugccgacaugggguacuggauugagucccagaaaaacggaucuuggaagcucgaaaaagccagccugaucgaggucaagaccugcaccuggccuaagucccacacacuguggucuaauggcgugcucgaaagcgauaugauuauccccaaaucccuggcugggccuauuagccagcauaaccaccgccccggauaccacacccaaacggccggcccuuggcaucuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcauaugaucgccggcguuuucuuuaccuucgugcuucugcucagcgggcagauuacauggcgcgauauggcccacacccugaucaugauuggauccaaugcuagcgacagaaugggcaugggggucacguaccuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaucagcucuggacggcccugaucucccuuaccuguagcaacacaauuuucacccugacaguggcguggcgcaccgccacgcucauccuggcuggcgucucccugcuuccgaugugccaaucuagcuccaugcggaagacagacuggcugcccauggccguugcugccaugggggugccuccccucccucuguuuaucuucucucucaaggauacccugaaaagacgcagcuggccccuuaaugagggagugauggccgucggccugguguccauucuggcuucuagccuccugagaaacgacguuccuauggcggggccccuuguggccggaggccugcucaucgcuuguuacgucauuaccgggacauccgccgaucugaccguggaaaaggccgcugacaucacauggggagaggaagccgagcagacgggcguuagccauaugcucaugauuaccguggaagacgauggcacaaugcggaucaaagacgaugagaccgagaacauccugacaguccuucugaagaccgcgcugcucauugugucugggaucuuuccguauuccauuccugcuacgcugcuugucuggcacaccuggcagaaacagacacaacgcagcggagugcugugggacguucccucuccucccgaaacccagaaggccgagcucgaagagggcguguacagaaucaaacagcaggggauuuucggaaagacacaagucggcguggggguucagaaggagggaguguuucacaccauguggcaugucacacggggcgccgugcugacguacaauggcaaacgccucgaaccgaacugggcuuccgugaagaaagaucugaucagcuaugggggaggcuggagacuuucugcccaguggcaaaagggggaggaaguucaggucauugcgguggagccuggcaagaaucccaagaacuuccagaccaugccuggcacauuccagaccaccacaggggaaaucggagcuaucgcccuggacuuuaagcccggcacguccggcagccccauuaucaaucgggaggggaaaguggucggacuguacggcaacggggugguuaccaagaauggaggcuauguguccgggauugcccaaacaaacgcugagccugauggcccgacccccgaacucgaggaagagauguucaaaaagcgcaaucugacaaucauggaccuucacccuggaagcggcaaaaccagaaaguaccugcccgccauuguccgggaagcuaucaagcgcagacuccggacgcugauccucgccccuacaagagugguugcggccgagauggaggaagcucugaaagggcuucccauucgcuaucagaccaccgccacaaagucugagcauaccggacgggaaaucguggaucugaugugccacgcuacauuuaccaugagacugcucagcccuguccgcgugccgaacuacaaucugauuaucauggacgaggcccauuucacggaucccgccuccauugcugcgcggggcuauaucucuacaagaguugggaugggagaagccgcugccaucuuuaugaccgccacaccucccggcaccgcugacgccuucccucagagcaacgcgcccauucaggaugaggagcgcgacaucccggaacgguccuggaacucugggaacgaguggauuacggacuuugcuggcaaaaccgugugguucgucccuagcaucaaggccggaaaugauauugccaacugucuucgcaaaaacggcaagaaggugauccaacuguccagaaaaacauuugacaccgaauaccagaagacaaaacucaaugauugggacuucguggucaccacagauauuucugagaugggggcuaacuuuaaggccgaccggguuaucgaucccagacggugccugaaacccgugauccugaccgacggaccugagcgcgugauucucgcgggccccaugccugucacggccgcuagcgccgcucagagacgggggcgcgugggaagaaauccgcagaaggaaaacgaucaauacaucuucacaggccagccccuuaauaacgacgaggaucacgcccacuggaccgaagcuaagaugcugcuggacaauauuaacaccccugaggggaucauucccgcccucuucgaaccugagcgggagaaauccgcggccaucgacggcgaauauagacugaagggagagagccgcaaaacauuuguugaacuuaugcggagaggcgaucugcccguguggcucgcucauaaggucgccucugaggggaucaaauacaccgaccgcaaguggugcuucgauggacagcggaauaaccagauucuggaagagaauauggacguggagaucuggacaaaagaaggcgagaagaagaaacugagaccgcgcuggcucgaugcucggacguauuccgacccucuugcccugaaggaauuuaaagaguucgccgcugggagaaagagcauugcgcuggaucucguuaccgaaaucggacgcgugcccucucaccuggcccauagaacacggaacgcucuugacaaucuggucaugcuccacaccuccgagcacggcggccgcgccuacagacaugccguggaggaacugccugagacaauggaaacccugcuccuucuggggcugaugauucuccugacgggaggcgcuaugcuuuuucugaucagcgggaaaggaaucggcaagaccuccauugggcucaucugugucauugccucuagcggaaugcuguggauggcggagaucccccugcaauggauugccuccgcuaucgugcucgaguucuuuaugaugguucuucugauuccugaacccgagaagcagcggacaccgcaggauaaccaacuggccuauguggugaucggcauccucacccuggcugccauuaucgcggccaaugaaaugggccuucuggagacaaccaaacgcgaccucgggaugagcaaggaaccuggagucguuucucccacguccuaccuggauguggaccugcaccccgcuagcgccuggacacucuaugcuguggccaccacagucauuaccccuaugcuuagacauaccaucgagaacucuacagcuaaugugagccuggccgcgauugccaaccaggcuguugugcugaugggccucgauaaaggguggccgaucuccaagauggaccugggagucccccuucuggcccucggcugcuacucucaggugaacccucugacgcugaccgcugccguccuccuucugaucacacacuacgccauuaucgggcccggacugcaggcgaaagcuacccgggaggcccaaaagagaacagcugccggcauuaugaagaauccuaccguggacggcaucaugacgauugaucucgaccccguuaucuaugauagcaaauucgaaaagcagcugggacaggugaugcuucugguccucugugccgugcagcugcugcucaugcgcacauccugggcucuuugcgaggcccugacccuggcgaccggaccuaucacaacccucugggaaggcucuccggggaaauuuuggaacacaacgauugccguuagcauggcuaauaucuuccggggauccuaccuggccggcgcugggcuugccuuuagcauuaugaagucugugggaaccggcaaaagaggcacagggucccaaggagagacccugggcgaaaaguggaagaaaaagcucaaccagcugagccgcaaagacuucgaucuguauaagaaauccgggaucacagaggucgaccggaccgaggcgaaggaaggacucaaaagaggcgagauuacgcaucacgccgugucucgggggagcgcuaaacuucagugguuuguggaacgcaauaugguuauccccgagggaagagucauugaucugggcuguggcagagggggaugguccuacuauugcgccggccugaagaaagugaccgaagugcgcggguacacaaagggaggcccugggcacgaggagcccgucccuaugucuaccuauggauggaacaucguuaaacucaugagcggcaaggacguguucuaccugcccccggaaaaaugugauacacuucugugcgacaucggcgaguccagcccuucucccaccguggaagaguccagaacaauucggguccucaagaugguggagcccuggcugaagaauaaccaguucuguaucaaaguucugaauccuuacaugcccaccgugauugaacaucucgagcgccuucaaagaaagcacgggggaaugcugguccggaacccucugagccgcaauucuacgcaugaaauguauuggaucuccaacggcacagggaauauuguggcuagcguuaacauggugucuagacuccugcuuaaucgguuuaccaugacccacagacgcccgacaaucgagaaagaugucgaccugggagccggcacgcggcacgugaacgcugaacccgagaccccuaacauggaugugaucggggagagaauuaagcgcaucaaagaagaacacaauagcacauggcacuacgacgacgaaaaccccuauaagaccugggccuaccauggauccuaugaggucaaggcgacaggcucugccagcuccaugauuaauggcguugugaaacuccugaccaagccuugggaugugguccccauggugacacagauggcuaugaccgacacgaccccguucgggcagcaacggguuuuuaaagaaaagguggauacaagaaccccucgcagcaugcccggaacacggagagucaugggcaucaccgccgaguggcuguggcgcacgcucgggcggaacaaaaagccuagacugugcacacgcgaggaguucaccaagaaagugcggacaaaugcugccaugggagccguuuuuaccgaggaaaaccagugggacuccgcgaaggcugccguggaggaugaagacuucuggaaacuugucgauagagagcgcgagcugcacaagcucggcaaaugugggucuugcguguacaauaugaugggcaagagagagaaaaagcugggagaguuuggcaaggccaaagggagccgggcuauuugguauauguggcuuggagcccgcuaccuggaguucgaggcucucggcuuucugaacgaggaccauugguucuccagagaaaauucuuacagcgggguugagggagaaggccugcacaagcucggguauauccugcgggauaucuccaaaauucccggcggagccauguacgcggacgauacggccggcugggacaccagaaucacagaggacgaucuucacaacgaagagaagauuacccagcagauggacccugagcaucggcaacuggcuaaugccaucuuuaaacucacauaucagaacaagguggucaaggugcagcgccccaccccgacagggaccgucauggauauuaucucuagaaaagaccagcggggaagcggccaaguggggacguacggacugaauacauucaccaacauggaagcucagcuuauccgccagauggagggcgaagggguucuguccaaggccgaucucgagaauccucaucugcccgagaaaaagauuacccaguggcuggagacaaaaggcguggagagacucaagcggauggcgaucagcggagacgauugcgucgugaagcccauugacgaucgcuuugccaacgcucugcuugcccugaacgacaugggcaaagugagaaaggauaucccucaauggcagccgucuaaaggguggcaugacuggcagcagguucccuucuguucccaccacuuccaugaacucauuaugaaggauggacggaaacugguggucccuugccgcccccaagacgagcuuaucggcagagcucggauuagccagggggccggauggucucugaaggaaaccgcuugucucggcaaggccuaugcgcagauguggucccugauguacuuucaccgcagagaccugcggcucgccagcaaugcuaucugcucugccgugccuguucauugggugcccacaucccgcacgaccuggagcauccacgcccaucaccaauggaugacaaccgaggauaugcugacagucuggaacagaguguggauugaagacaauccuuggauggaggauaaaacccccgucacgaccugggagaacgugccguaucuugggaagcgggaagaccagugguguggcucccugaucggacucacaagcagagcuaccugggcccagaauauuccuacagcgauccagcaaguucgcucucugauuggcaacgaggaguuccuugauuacaugcccagcaugaaacgguuuagaaaggaggaggaauccgagggggcuaucugguga

SEQ ID NO: 20543 - RNA, 9873 nt, Artificial Sequence
  derived and/or modified CDS sequence (opt5) from DENV-3__GQ199870__SS-prME
accagccugugccucaugaugauccugcccgccgcucuugccuuccaccugacaucccgggacggagaaccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaaaaggccgcugacaucacaugggaggaagaggccgaacagacgggcgugucccacaaccucaugauuaccgucgacgaugacggcacaaugcggaucaaagaugacgagaccgagaauauccugacagugcuucugaagaccgcgcugcucauugucagcgggaucuuuccguacucuauuccugcuacgcugcuuguguggcauaccuggcagaaacagacacaacgcuccggaguucugugggaugugcccagcccucccgaaacccagaaggccgagcucgaagagggcgucuacagaaucaaacagcaggggauuuucggaaagacacaagugggcguuggggugcagaaggagggagucuuucacaccauguggcacgugacacggggcgccgugcugacguauaacggcaaacgccucgaaccgaauugggcuucuguuaagaaagaccugaucuccuacgggggaggcuggagacuuagcgcccaguggcaaaagggggaggaaguccaggugauugcgguggagccuggcaagaaccccaagaauuuccagaccaugccuggcacauuccagaccaccacaggggaaaucggagcuaucgcccuggauuuuaagcccggcacgucuggcucccccauuaucaaccgggaggggaaagucgugggacuguauggcaaugggguugugaccaagaacggaggcuacgucagcgggauugcccaaacaaaugcugagccugacggcccgacccccgaacucgaggaagagauguucaaaaagcgcaaccugacaaucauggaucuucauccuggauccggcaaaaccagaaaguaucugcccgccauugugcgggaagcuaucaagcgcagacuccggacgcugauccucgccccuacaagaguuguggcggccgagauggaggaagcucugaaagggcuucccauucgcuaccagaccaccgccacaaagagcgagcacaccggacgggaaaucgucgaccugaugugccaugcuacauuuaccaugagacugcucucuccugugcgcguuccgaauuauaaccugauuaucauggaugaggcccacuucacggaccccgccagcauugcugcgcggggcuacaucuccacaagaguggggaugggagaagccgcugccaucuuuaugaccgccacaccucccggcaccgcugaugccuucccucagucuaaugcgcccauucaggacgaggagcgcgacaucccggaacggagcuggaacuccgggaaugaguggauuacggauuuugcuggcaaaaccgucugguucgugccuucuaucaaggccggaaacgacauugccaacugucuucgcaaaaauggcaagaaggugauccaacugagcagaaaaacauuugauaccgaauaccagaagacaaaacucaacgacugggauuucgucguuaccacagacauuuccgagaugggggcuaauuuuaaggccgaucgggugaucgaccccagacggugccugaaacccgugauccugaccgauggaccugagcgcgucauucucgcgggccccaugccugugacggccgcuucugccgcucagagacgggggcgcguuggaagaaacccgcagaaggaaaaugaccaauauaucuucacaggccagccccuuaacaaugaugaggaccaugcccacuggaccgaagcuaagaugcugcuggacaacauuaauaccccugaggggaucauucccgcccucuucgaaccugagcgggagaaaagcgcggccaucgauggcgaauacagacugaagggagagucccgcaaaacauuuguggaacuuaugcggagaggcgaccugcccgucuggcucgcucacaagguggccagcgaggggaucaaauauaccgaucgcaaguggugcuucgacggacagcggaacaaucagauucuggaagagaacauggauguugagaucuggacaaaagaaggcgagaagaagaaacugagaccgcgcuggcucgacgcucggacguacucugauccucuugcccugaaggaauuuaaagaguucgccgcugggagaaaguccauugcgcuggaccucgugaccgaaaucggacgcguccccagccaucuggcccacagaacacggaaugcucuugauaaccuggugaugcuccauaccucugagcacggcggccgcgccuauagacacgccgucgaggaacugccugagacaauggaaacccugcuccuucuggggcugaugauucuccugacgggaggcgcuaugcuuuuucugaucuccgggaaaggaaucggcaagaccagcauugggcucaucugugugauugccuccucuggaaugcuguggauggcggagaucccccugcaauggauugccagcgcuaucguucucgaguucuuuaugauggugcuucugauuccugaacccgagaagcagcggacaccgcaggacaaucaacuggccuacguggucaucggcauccucacccuggcugccauuaucgcggccaacgaaaugggccuucuggagacaaccaaacgcgaucucgggauguccaaggaaccuggaguugugagccccacgucuuaucuggacguggaucugcaucccgcuuccgccuggacacucuacgcugucgccaccacagugauuaccccuaugcuuagacacaccaucgagaauagcacagcuaacguuucucuggccgcgauugccaaccaggcugugguccugaugggccucgacaaaggguggccgaucagcaagauggaccugggagugccccuucuggcccucggcugcuacucccaggucaauccucugacgcugaccgcugccgugcuccuucugaucacacauuaugccauuaucgggcccggacugcaggcgaaagcuacccgggaggcccaaaagagaacagcugccggcauuaugaagaacccuaccguugauggcaucaugacgauugaccucgaucccgugaucuacgacucuaaauucgaaaagcagcuggggcaggucaugcuucuggugcucugugccguucagcugcugcucaugcgcacaagcugggcucuuugcgaggcccugacccuggcgaccggaccuaucacaacccucugggaaggcuccccggggaaauuuuggaauacaacgauugccgugucuauggcuaacaucuuccggggaagcuaucuggccggcgcugggcuugccuuuuccauuaugaaaagcgucggaaccggcaaaagaggcacagggucucaaggagagacccugggcgaaaaguggaagaaaaagcucaaucagcugucccgcaaagauuucgaccuguacaagaaaagcgggaucacagagguggaucggaccgaggcgaaggaaggacucaaaagaggcgagauuacgcaccaugccgugucccgggggucugcuaaacuucagugguuuguugaacgcaacauggucauccccgagggaagagugauugaccugggcuguggcagagggggauggagcuauuacugcgccggccugaagaaagugaccgaaguccgcggguauacaaagggaggcccugggcacgaggagcccguuccuauguccaccuacggauggaauaucgugaaacucaugucuggcaaggauguguucuaccugcccccggaaaaaugugacacacuucugugcgauaucggcgagagcuccccuagccccaccgucgaagagucuagaacaauucgggugcucaagaugguugagcccuggcugaagaacaaucaguucuguaucaaagugcugaacccuuauaugcccaccgucauugaacaccucgagcgccuucaaagaaagcaugggggaaugcuggugcggaauccucugucccgcaacagcacgcacgaaaugucuuggaucuccaauggcacagggaacauuguugcuagcgugaauauggucucuagacuccugcuuaaccggagcaccaugacccauagacgcccgacaaucgagaaagacguggaucugggagccggcccccggcacgugaacgcugacccugaacccccuaauauggacgucaucggggagagaauuaagcgcguuaaagaggaacacaacuccacguggcauuacgaugacgagaaucccuauaagaccugggccuaccacggaucuuaugaagugaaggcgacaggcagcgccuccagcaugaucaacggcguggucaaacuccugaccaagccgugggaugugguuccuauggugccccagauggcuaugacagacaccacaccuuuugggcagcaacgggucuucaaagagaagguggauaccagaacgccccgcuccauuccuggaacccggagaguuaugggcaucacagccgaauggcuguggcgcacccucgggcggaauaaaaagcccagacugugcacacgcgaggaguuuaccaagaaagugcggacgaacgcugccaugggagccgucuucacagaagagaaucagugggacucugcgaaggcugccguggaagaugaggacuuuuggaaacuuguugauagagaacgcgagcugcauaagcucggcaaaugugggagcugcguguacaacaugaugggcaagagagagaaaaagcugggagaguucggcaaggccaaagggucccgggcuauuugguauauguggcuuggagcccgcuaccuggaguuugaagcucucggcuuccugaaugaggaccacugguuuucuagagagaacagcuacuccggggucgaaggagagggccugcauaagcucggguauauccugcgggauaucucuaaaauuccgggcggagccauguacgcggacgacaccgccggcugggauacaagaaucaccgaagacgaucuucacaaugaggaaaagauuacgcagcagauggacccugagcaccggcaacuggcuaacgccaucuucaaacucaccuaucagaauaagguggucaaggugcagcgccccacacccaccgggacaguuauggauauuaucagcagaaaagaccagcggggauccggccaaguggggaccuacggacugaacacauuuaccaauauggaggcucagcuuauccgccagauggaaggcgaggggguccugagcaaggccgaucucgaaaacccucaucugccggagaaaaagauuacgcaguggcuggaaacaaaaggcguggagagacucaagcggauggcgaucucuggagacgauugcgugguuaagcccauugacgaucgcuucgccaacgcucugcuugcccugaaugacaugggcaaagugagaaaggauaucccucaauggcagcccuccaaaggguggcacgacuggcagcaggucccuuuuuguagccaucacuuccacgagcucauuaugaaggacggacggaaacuggugguucccugccgcccucaagaugaacuuaucggcagagcucggauuucucagggggccggauggucccugaaggagaccgcuugucucggcaaggccuaugcgcagauguggagccugauguacuuccaucgcagagaccugcggcucgccucuaacgcuaucugcuccgccgugcccguccacugggugccgaccagccgcacaaccugguccauccaugcccaccaucaauggaugacaacggaagauaugcugaccgucuggaauagaguguggauugaggacaacccuuggauggaagauaaaacacccguuaccacaugggagaaugugccuuaucuugggaagcgggaggaccagugguguggcagccugaucggacucaccucuagagcuacgugggcccagaacauucccaccgcgauccagcaaguccgcagccugauuggcaaugaagaguuucuugauuacaugccguccaugaaacgguucagaaaggaagaggagucugaaggggcuaucugguga

SEQ ID NO: 20544 - RNA, 9873 nt, Artificial Sequence
  derived and/or modified CDS sequence (opt5) from DENV-3__JF937630__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacgccuuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugucuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuugucgcuggaggccugcucaucgccuguuaugugauuaccgggaccuccgccgaucugacaguugaaaaggcugccgacaucaccugggaggaagaggcggaacagacaggagugagccacaaccucaugauuacggucgacgaugacggcaccaugcggaucaaagaugacgagacagagaauauccugaccgugcuucugaagacagcucugcucauugucucuggcaucuuuccguacuccauuccugccacccugcuuguguggcauacguggcagaaacagacccaacgcagcgggguucugugggaugugcccucuccucccgaaacacagaaggccgagcucgaagagggagucuacagaaucaaacagcagggcauuuucgggaagacccaagugggaguuggcgugcagaaggagggggucuuucacacaauguggcacgugacccggggagcugugcugacauauaacggcaaacgccucgaaccgaauugggccuccguuaagaaagaccugaucagcuacggcgggggauggagacuuucugcgcaguggcaaaagggcgaggaaguccaggugauugcuguggagccugggaaaaaccccaagaauuuccagacgaugccuggaaccuuccagacaaccaccggcgaaaucggggccaucgcccuggauuuuaagcccggaacauccggcagccccauuaucaaccgggagggcaaagucguggggcuguauggaaauggcguugugacgaagaacgggggauacgucuccggcauugcucaaaccaaugccgagccugacgggccgacacccgaacucgaggaagagauguucaaaaagcgcaaccugaccaucauggaucuucauccuggcagcggaaaaacaagaaaguaucugcccgcuauugugcgggaagccaucaagcgcagacuccggacccugauccucgcgccuacgagaguuguggccgcugagauggaggaagcccugaaaggccuucccauucgcuaccagacaaccgcuaccaagucugagcacacagggcgggaaaucgucgaccugaugugccaugccaccuuuacaaugagacugcucagcccugugcgcguuccgaauuauaaccugauuaucauggaugaggcccacuucaccgaccccgcuuccauugcggcccggggauacaucucuacgagagugggcaugggggaagcugccgccaucuuuaugacagcuaccccucccggaacagccgaugcguucccucagagcaaugcucccauucaggacgaggagcgcgacaucccggaacgguccuggaacucuggcaaugaguggauuaccgauuuugccgggaaaacggucugguucgugccuagcaucaaggccggcaacgacauugcuaacugucuucgcaaaaauggaaagaaggugauccaacuguccagaaaaaccuuugauacagaauaccagaagaccaaacucaacgacugggauuucgucguuacaaccgacauuucugagaugggcgccaauuuuaaggcggaucgggugaucgaccccagacggugccugaaacccgugauccugacagaugggccugagcgcgucauucucgccggacccaugccugugaccgcugccagcgcugcccagagacggggccgcguugggagaaacccgcagaaggaaaaugaccaauauaucuucacgggacagccccuuaacaaugaugaggaccaugcucacuggacagaagccaagaugcugcuggacaacauuaauaccccugagggcaucauucccgcccucuucgaaccugagcgggagaaauccgccgcuaucgauggggaauacagacugaagggcgagagccgcaaaaccuuuguggaacuuaugcggagaggagaccugcccgucuggcucgcccacaagguggcuucugagggcaucaaauauacagaucgcaaguggugcuucgacgggcagcggaacaaucagauucuggaagagaacauggauguugagaucuggaccaaagaaggagagaagaagaaacugagaccgcgcuggcucgacgcccggacauacuccgauccucuugcccugaaggaauuuaaagaguucgcugcgggcagaaagagcauugcccuggaccucgugacggaaaucgggcgcguccccucucaucuggcucacagaacccggaaugcccuugauaaccuggugaugcuccauacauccgagcacggaggccgcgccuauagacacgcugucgaggaacugccugagaccauggaaacacugcuccuucugggccugaugauucuccugaccgggggagccaugcuuuuucugaucagcggcaaagggaucggaaagacguccauuggccucaucugugugauugcgucuagcgggaugcuguggauggccgagaucccccugcaauggauugcuuccgccaucguucucgaguucuuuaugauggugcuucugauuccugaacccgagaagcagcggaccccgcaggacaaucaacuggcuuacguggucaucggaauccucacacuggccgcgauuaucgccgcuaacgaaaugggccuucuggagaccacaaaacgcgaucucggcaugagcaaggaaccugggguugugucucccaccuccuaucuggacguggaucugcaucccgccagcgcuuggacgcucuacgccgucgcuacaaccgugauuacaccuaugcuuagacacaccaucgaaaauucuaccgccaacguuagccuggcggccauugcuaaccaggccgugguccugaugggacucgacaaaggcuggccgaucuccaagauggaccugggggugccccuucuggcucucggaugcuacucucaggucaauccucugacacugacggccgccgugcuccuucugaucacccauuaugcgauuaucggccccgggcugcaggcuaaagccacacgggaggcucaaaagagaaccgccgccggaauuaugaagaacccuacaguugauggcaucaugaccauugaccucgaucccgugaucuacgacagcaaauucgaaaagcagcugggccaggucaugcuucuggugcucugugcuguucagcugcugcucaugcgcacguccugggcccuuugcgaggcgcugacacuggccaccgggccuaucaccacacucugggaaggaucuccgggcaaauuuuggaauaccacaauugcugugagcauggccaacaucuuccggggguccuaucuggcuggagccggccuugcguuuagcauuaugaagucugucgggacgggaaaaagaggcaccggcucccaaggggagacacugggagaaaaguggaagaaaaagcucaaucagcugagccgcaaagauuucgaccuguacaagaaauccggcaucaccgagguggaucggacagaggccaaggaagggcucaaaagaggagagauuacccaccaugcugugucucggggcagcgccaaacuucagugguuuguugaacgcaacauggucauccccgaggggagagugauugaccugggauguggccggggcgggugguccuauuacugcgcuggacugaagaaagugacggaaguccgcggcuauaccaaagggggaccuggccacgaggagcccguuccuaugucuacauacggguggaauaucgugaaacucaugagcggaaaggauguguucuaccugcccccggaaaaaugugacacccuucugugcgauaucggcgaguccagcccuucucccacagucgaagaguccagaaccauucgggugcucaagaugguugagcccuggcugaagaacaaucaguucuguaucaaagugcugaacccuuauaugcccacagucauugaacaccucgagcgccuucaaagaaagcauggcgggaugcuggugcggaauccucugagccgcaacucuacccacgaaauguacuggaucuccaauggaacgggcaacauuguugccagcgugaauauggucucuagacuccugcuuaaccgguuuacaaugacccauagacgcccgaccaucgagaaagacguggaucugggggcuggaacacggcacgugaacgccgaacccgagacgccuaauauggacgucaucggcgagagaauuaagcgcaucaaagaagaacacaacagcaccuggcauuaugacgaugaaaaucccuacaagacaugggcguaucacggguccuacgagguuaaggccaccggaucugcuagcuccaugauuaacggcguggugaaacuccugacaaagccuugggacgucgugcccaugguuacccagauggccaugacagauaccacgccguucggccagcaacggguguuuaaagaaaaggucgacaccagaacaccucgcagcaugcccgggacccggagagugaugggaaucacagcugaguggcuguggcgcacccucggccggaauaaaaagccuagacugugcacgcgcgaggaguucacaaagaaaguucggaccaacgccgccaugggggcgguguuuacagaggaaaaucagugggauuccgcuaaggccgccgucgaggacgaagauuucuggaaacuuguggacagagagcgcgagcugcauaagcucggaaaauguggcucuugcguuuauaacaugauggggaagagagagaagaagcugggcgaguuuggaaaggcuaaaggcagccgggccauuugguacauguggcuuggggcucgcuaccuggaguucgaggcccucggauuucugaaugaggaucacugguucuccagagaaaacucuuauagcggcguggagggggaaggacugcauaagcucggcuacauccugcgggacaucuccaaaauucccgggggcgcgauguaugccgaugacaccgcuggaugggacacgagaaucaccgaggaugaccuucacaaugaagagaagauuacacagcagauggauccugagcaccggcaacuggccaacgcuaucuuuaaacucaccuaccagaauaaggucgugaagguccagcgccccacaccgaccggcacagugauggacauuaucucuagaaaagaucagcgggggagcggacaaguuggcaccuaugggcugaacacguucacaaauauggaagcccagcuuauccgccagauggagggagaaggcgugcuguccaaggcggaccucgagaacccucaucugcccgagaagaagauuacccaguggcuggagaccaaaggggucgagagacucaagcggauggccaucagcggcgaugacugcguggugaagcccauugaugaccgcuuugcuaacgcccugcuugcucugaaugauaugggaaaaguuagaaaggacaucccucaauggcagccgucuaaaggcuggcacgauuggcaacaggugcccuucuguucccaucacuuccacgaacucauuaugaaggacgggcggaaacuggucgugccuugccgcccccaagacgagcuuaucggacgggcgcggauuagccagggcgcuggguggucucugaaggaaacagccugucucggaaaggcguacgcccagauguggucccugauguauuuucaucgcagagaucugcggcucgcuagcaacgccaucugcucugccguuccugugcacuggguccccaccucccgcacaacguggagcauccaugcucaccaucaauggaugaccacagaggacaugcugaccguguggaauagagucuggauugaagauaacccuuggauggaggacaaaacacccgugaccacgugggagaauguuccguaccuuggcaagcgggaagaucaguggugugggucccugaucggccucaccagcagagccacaugggcgcagaacauuccuaccgcuauccagcaagugcgcucucugauuggaaaugaggaguuccuugacuacaugcccagcaugaaacgguuuagaaaggaggaggaauccgagggcgccaucugguga

SEQ ID NO: 20545 - RNA, 9873 nt, Artificial Sequence
  derived and/or modified CDS sequence (opt5) from DENV-3__JN000936__SS-prME
accagccugugccucaugaugauucugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuguguucaccuuuguccuucugcucagcgggcagauuacauggcgcgauauggcccauacccugaucaugauuggauccaaugcuagcgacagaaugggcaugggggugacguaucuggcccuuaucgcgacauucaaaauccagcccuuucuggcucucggauucuuucugcggaagcucaccucuagagaaaaccugcuucugggcguggggcucgccauggccacaacccugcaacugccugaggauauugaacagauggcuaauggaaucgcccuuggccugauggcucucaaacugauuacccaguucgagaucuaccagcucuggacagcccugauuucccuuacguguagcaacaccaucuuuacacugaccgucgcguggcgcacagccacccucauccuggcuggcguuucccugcuuccgaugugccaaucuagcuccaugcggaagacggacuggcugcccauggccguggcugccaugggggugccuccccucccucuguucaucuuuucucucaaggauacacugaaaagacgcagcuggccccuuaaugagggagucauggccgugggccugguuuccauccuggcuucuagccuccugagaaacgacgugccuauggcggggccccuugucgccggaggccugcucauugcuuguuaugugaucaccgggaccuccgccgaucugacaguugaaaaggccgcugacauuaccugggaggaagaggccgaacagacaggagugagccacaaccucaugaucacggucgacgaugacggcaccaugcggaucaaagaugacgagacagagaauauucugaccgugcuucugaagacagcgcugcucaucgucucuggcauuuucccguacuccaucccugcuacccugcuuguguggcauacguggcagaaacagacccaacgcagcgggguucugugggaugugcccucuccucccgaaacacagaaggccgagcucgaagagggagucuacagaauuaaacagcagggcaucuuugggaagacccaagugggaguuggcgugcagaaggagggggucuuccacacaauguggcacgugacccggggagccgugcugacauauaacggcaaacgccucgaaccgaauugggcuuccguuaagaaagaccugauuagcuacggcgggggauggagacuuucugcccaguggcaaaagggcgaggaaguccaggugaucgcgguggagccugggaaaaaccccaagaauuuucagacgaugccuggaaccuuccagacaaccaccggcgaaaucggggcuauugcccuggauuucaagcccggaacauccggcagccccaucauuaaccgggagggcaaagucguggggcuguauggaaauggcguugugacgaagaacgggggauacgucuccggcaucgcccaaaccaaugcugagccugacgggccgacacccgaacucgaggaagagauguuuaaaaagcgcaaccugaccauuauggaucuucauccuggcagcggaaaaacaagaaaguaucugcccgccaucgugcgggaagcuaucaagcgcagacuccggacccugauucucgccccuacgagaguuguggcggccgagauggaggaagcucugaaaggccuucccauccgcuaccagacaaccgccaccaagucugagcacacagggcgggaaauugucgaccugaugugccaugcuaccuucacaaugagacugcucagcccugugcgcguuccgaauuauaaccugaucauuauggaugaggcccacuuuaccgaccccgccuccaucgcugcgcggggauacaucucuacgagagugggcaugggggaagccgcugccauuuucaugacagccaccccucccggaacagcugaugccuuuccucagagcaaugcgcccauccaggacgaggagcgcgacauuccggaacgguccuggaacucuggcaaugaguggaucaccgauuucgcugggaaaacggucugguuugugccuagcauuaaggccggcaacgacaucgccaacugucuucgcaaaaauggaaagaaggugauucaacuguccagaaaaaccuucgauacagaauaccagaagaccaaacucaacgacugggauuuugucguuacaaccgacaucucugagaugggcgcuaauuucaaggccgaucgggugaucgaccccagacggugccugaaacccgugauucugacagaugggccugagcgcgucauccucgcgggacccaugccugugaccgccgcuagcgccgcucagagacggggccgcguugggagaaacccgcagaaggaaaaugaccaauauauuuuuacgggacagccccuuaacaaugaugaggaccaugcccacuggacagaagcuaagaugcugcuggacaacaucaauaccccugagggcauuauccccgcccucuucgaaccugagcgggagaaauccgcggccaucgauggggaauacagacugaagggcgagagccgcaaaaccuucguggaacuuaugcggagaggagaccugcccgucuggcucgcucacaagguggccucugagggcauuaaauauacagaucgcaaguggugcuuugacgggcagcggaacaaucagauccuggaagagaacauggauguugagauuuggaccaaagaaggagagaagaagaaacugagaccgcgcuggcucgacgcucggacauacuccgauccucuugcccugaaggaguucaaagaguuugccgcuggcagaaagagcaucgcgcuggaccucgugacggaaauugggcgcguccccucucaucuggcccacagaacccggaaugcucuugauaaccuggugaugcuccauacauccgagcacggaggccgcgccuauagacacgccgucgaggaacugccugagaccauggaaacacugcuccuucugggccugaugauccuccugaccgggggagcuaugcuuuuccugaucagcggcaaagggauuggaaagacguccaucggccucauuugugugaucaccucuagcgggaugcuguggauggccgagauuccccugcaauggaucgcguccgccauuguucucgaguuuuucaugauggugcuucugaucccugaacccgagaagcagcggacaccgcaggacaaucaacuggcuuacguggucaucggcauucucacccuggccgcuaucauugccgcgaacgaaaugggccuucuggagacaaccaaacgcgaucucggcaugagcaaggaaccugggguugugucucccacguccuaucuggacguggaucugcaucccgccagcgcuuggacacucuacgccgucgcuaccacagugaucaccccuaugcuuagacacaccauugaaaauucuacagccaacguuagccuggcugccaucgcgaaccaggccgugguccugaugggacucgacaaaggcuggccgaucuccaagauggaccugggggugccccuucuggcucucggaugcuacucucaggucaauccucugacgcugaccgccgcugugcuccuucugauuacacauuaugccaucauuggccccgggcugcaggccaaagcgacccgggaggcucaaaagagaacagccgcuggaaucaugaagaacccuaccguugauggcauuaugacgaucgaccucgaucccgugaucuacgacagcaaauuugaaaagcagcugggccaggucaugcuucuggugcucugugccguucagcugcugcucaugcgcacauccugggcccuuugcgaggcucugacccuggccaccgggccuauuacaacccucugggaaggaucuccgggcaaauucuggaauacaacgaucgcggugagcauggccaacauuuuucggggguccuaucuggcuggagccggccuugcuuucagcaucaugaagucugucgggaccggaaaaagaggcacaggcucccaaggggagacccugggagaaaaguggaagaaaaagcucaaucagcugagccgcaaagauuuugaccuguacaagaaauccggcauuacagagguggaucggaccgaggccaaggaagggcucaaaagaggagagaucacgcaccaugcggugucucggggcagcgccaaacuucagugguucguugaacgcaacauggucauucccgaggggagagugaucgaccugggauguggccggggcgggugguccuauuacugcgcuggacugaagaaagugaccgaaguccgcggcuauacaaaagggggaccuggccacgaggagcccguuccuaugucuaccuacggguggaauaucgugaaacucaugagcggaaaggauguguuuuaccugcccccggaaaaaugugacacacuucugugcgauauuggcgaguccagcccuucucccaccgucgaagaguccagaacaauccgggugcucaagaugguugagcccuggcugaagaacaaucaguucuguauuaaagugcugaacccuuauaugcccaccgucaucgaacaccucgagcgccuucaaagaaagcauggcgggaugcuggugcggaauccucugagccgcaacucuacgcacgaaauguacuggauuuccaauggaacaggcaacaucguugccagcgugaauauggucucuagacuccugcuuaaccgguucaccaugacccauagacgcccgacaaucgagaaagacguggaucugggggcuggaacgcggcacgugaacgccgaacccgagaccccuaauauggacgucauuggcgagagaaucaagcgcauuaaagaagaacacaacagcacauggcauuaugacgaugaaaaucccuacaagaccugggcuuaucacggguccuacgagguuaaggccacaggaucugcgagcuccaugaucaacggcguggugaaacuccugaccaagccuugggacgucgugcccaugguuacacagauggccaugaccgauacgaccccguuuggccagcaacggguguucaaagaaaaggucgacacaagaaccccucgcagcaugcccgggacacggagagugaugggaauuaccgcugaguggcuguggcgcacgcucggccggaauaaaaagccuagacugugcacacgcgaggaauuuaccaagaaaguucggacaaacgccgcuaugggggccguguucaccgaggaaaaucagugggauuccgccaaggcggcugucgaggacgaagauuuuuggaaacuuguggacagagagcgcgagcugcauaagcucggaaaauguggcucuugcguuuauaacaugauggggaagagagagaagaagcugggcgaguucggaaaggccaaaggcagccgggccaucugguacauguggcuuggggcucgcuaccuggaauuugaggcccucggauuccugaaugaggaucacugguuuuccagagaaaacucuuauagcggcguggagggggaaggacugcauaagcucggcuacauccugcgggacauuuccaaaauccccgggggcgcuauguaugccgaugacacggcgggaugggacaccagaauuacagaggaugaccuucacaaugaagagaagaucacccagcagauggauccugagcaccggcaacuggccaacgcuauuuucaaacucacauaccagaauaaggucgugaagguccagcgccccaccccgacaggcaccgugauggacaucaucucuagaaaagaucagcgggggagcggacaaguuggcacguaugggcugaacacauuuaccaauauggaagcccagcuuauucgccagauggagggagaaggcgugcuguccaaggcugaccucgagaacccucaucugcccgagaagaagaucacccaguggcuggagacaaaaggggucgagagacucaagcggauggccauuagcggcgaugacugcguggugaagcccaucgaugaccgcuucgcgaacgcccugcuugcucugaaugauaugggaaaaguuagaaaggacauuccucaauggcagccgucuaaaggcuggcacgauuggcaacaggugcccuuuuguucccaucacuuccacgaacucaucaugaaggacgggcggaaacuggucgugccuugccgcccccaagacgagcuuauuggacgggcccggaucagccagggcgcuggguggucucugaaggaaaccgccugucucggaaaggcuuacgcccagauguggucccugauguauuuccaucgcagagaucugcggcucgcgagcaacgccaucugcucugcuguuccugugcacuggguccccacaucccgcacgaccuggagcauucaugcccaccaucaauggaugacaaccgacgauaugcugacaguguggaauagagucuggaucgaggacaacccuuggauggaagauaaaacccccgugacgaccugggagaauguuccguaccuuggcaagcgggaggaccaguggugugggucccugauuggccucacaagcagagccaccugggcucagaacaucccuacagccauucagcaagugcgcucucugaucggaaaugaagaguuucuugauuacaugcccagcaugaaacgguucagaaaggaagaggaguccgaaggcgcgaucugguga

SEQ ID NO: 20546 - RNA, 9873 nt, Artificial Sequence
  derived and/or modified CDS sequence (opt5) from DENV-3__HQ541796__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauacagugaucgggauuggcgauaacgcccugaaaaucaauugguauaagaagggaucuagcaucggcaaaauguuugaagccaccgcuagaggggccagacgcauggcuauucuuggagacaccgccugggauuucggcuccgucgggggaguucucaacagccugggcaagaugguccaccagaucuuugggucugcguacacagcccuguucuccggcgugagcugggugaugaaaauuggaaucggcguccuccugaccuggauugggcuuaauucuaagaacacaagcauguccuuuucuugcaucgcuauuggaaucaucacgcuguaucucggcgccgugguucaggcugacauggggugugugauuaauuggaaaggaaaggagcugaagugcggcagcgggaucuucgucaccaacgaggugcauacauggaccgaacaguacaaauuucaagccgauucccccaagcggcuggcgacagccauugcuggcgccugggagaauggaguuuguggcaucagaagcaccacgcgcauggaaaaccuucucuggaaacagauugcuaaugagcugaacuauauccugugggaaaauaacaucaagcucaccguggucgugggggacauuaucggaguucuggagcagggcaaacggacacuuaccccucagcccauggagcugaaguacucuuggaaaacaugggggaaggccaagauugugaccgccgaaacacaaaacuccagcuucaucauugauggaccuaauacccccgagugcccgucugucuccagagcuuggaacgugugggaaguggaggacuauggcuuuggcgucuucacgacaaauaucuggcucaaacugcgcgaaguuuacacccagcugugugaccaccggcuuaugagcgcggccgugaaggaugagagagcugugcacgccgacaugggguacuggaucgagucccagaaaaacggaucuuggaagcucgaaaaagccagccugauugaggucaagaccugcacauggccuaagucccauacccuguggucuaauggcgugcucgaaagcgauaugaucauucccaaaucccuggcugggccuaucagccagcacaaccaucgccccggauaucacacgcaaacagccggcccuuggcaccuugggaagcuggagcucgacuuuaauuacugcgagggaaccacaguugugauuaccgaaaacuguggcacacggggccccucucugagaaccacgaccgucuccgggaaacugauccaugaguggugcugucgcagcugcacacuuccgccucuccgguauaugggagaagauggcuguugguacgggauggagaucagacccauuucugaaaaggaggagaauauggugaaaucccugguuagcgcgggaucuggcaagguggacaacuucaccauggggguccugugccucgcuauccuguuugaagaggugaugcggggaaaguucggcaaaaagcacaugauugccggcguuuucuuuacauucgugcuucugcucagcgggcagaucaccuggcgcgauauggcccauacgcugauuaugaucggauccaaugcuagcgacagaaugggcaugggggucacauaucuggcccuuauugcgaccuuuaaaauccagcccuuccuggcucucggauuuuuccugcggaagcucacaucuagagaaaaccugcuucugggcguggggcucgccauggccaccacccugcaacugccugaggauaucgaacagauggcuaauggaauugcccuuggccugauggcucucaaacugaucacacaguuugagacguaccagcucuggaccgcccugauuucccuuacauguagcaacaccaucuucacacugaccguggcguggcgcacggccacacucauucuggcuggcgucucccugcuuccgguuugccaaucuagcuccaugcggaagaccgacuggcugcccauggccguggcugccaugggggugccuccccucccucuguuuaucuucggacucaaggauacccugaaaagacgcucuuggccccuuaaugagggcgucauggccguggggcugguuagcauccuggcuuccucucuccugagaaacgacgugccuauggcgggaccccuugucgccggcgggcugcucauugcuuguuaugugaucacaggaaccagcgccgaucugacaguugaaaaggccgcugacauuacgugggaggaagaggccgaacagaccggcgugucccacaaccucaugaucacagucgacgaugacggcaccaugcggauuaaagaugacgagacagagaauauccugaccgugcuucugaagacggcgcugcucaucgucagcgggauuuuuccguacucuaucccugcuacccugcuuguguggcauacauggcagaaacagacccaacgcuccggaguucugugggaugugcccagcccucccgaaacacagaaggccgagcucgaagagggcgucuacagaauuaaacagcaggggaucuucggaaagacccaagugggcguuggggugcagaaggagggagucuuucacacaauguggcacgugacgcggggcgccgugcugaccuauaacggcaaacgccucgaaccgaauugggcuucuguuaagaaagaccugauuuccuacgggggaggcuggagacuuagcgcccaguggcaaaagggggaggaaguccaggugaucgcgguggagccuggcaagaaccccaagaauuuccagacaaugccuggcaccuuccagaccacaacgggggaaauuggagcuaucgcccuggauuuuaagcccggcaccucuggcucccccaucauuaaccgggaggggaaagucgugggacuguauggcaaugggguugugacaaagaacggaggcuacgucagcgggaucgcccaaaccaaugcugagccugacggcccgacacccgaacucgaggaagagauguucaaaaagcgcaaccugaccauuauggaucuucauccuggauccggcaaaacgagaaaguaucugcccgccaucgugcgggaagcuauuaagcgcagacuccggacacugauccucgccccuaccagaguuguggcggccgagauggaggaagcucugaaagggcuucccauccgcuaccagaccacagccaccaagagcgagcacacaggacgggaaauugucgaccugaugugccaugcuaccuuuacgaugagacugcucucuccugugcgcguuccgaauuauaaccugaucauuauggaugaggcccacuucacagaccccgccagcaucgcugcgcggggcuacauuuccaccagaguggggaugggagaagccgcugccaucuuuaugacagccaccccucccggcacggcugaugccuucccucagucuaaugcgcccauccaggacgaggagcgcgacauuccggaacggagcuggaacuccgggaaugaguggaucaccgauuuugcuggcaaaacagucugguucgugccuucuauuaaggccggaaacgacaucgccaacugucuucgcaaaaauggcaagaaggugauucaacugagcagaaaaaccuuugauacagaauaccagaagaccaaacucaacgacugggauuucgucguuacaaccgacaucuccgagaugggggcuaauuuuaaggccgaucgggugauugaccccagacggugccugaaacccgugauccugacggauggaccugagcgcgucauccucgcgggccccaugccugugacagccgcuucugccgcucagagacgggggcgcguuggaagaaacccgcagaaggaaaaugaccaauauauuuucaccggccagccccuuaacaaugaugaggaccaugcccacuggaccgaagcuaagaugcugcuggacaacaucaauacaccugaggggauuauccccgcccucuucgaaccugagcgggagaaaagcgcggccauugauggcgaauacagacugaagggagagucccgcaaaaccuuuguggaacuuaugcggagaggcgaccugacagucuggcucgcucacaagguggccagcgaggggaucaaauauacggaucgcaaguggugcuucgacggacagcggaacaaucagauccuggaagagaacauggauguugagauuuggaccaaagaaggcgagaagaagaaacugagaccccgcuggcucgacgcucggacauacucugauccgcuugcccugaaggaauuuaaagaguucgccgcugggagaaaguccaucgcgcuggaccucgugaccgaaauuggacgcgucccuagccaucuggcccacagaacacggaaugcucuugauaaccuggugaugcuccauaccucugagcacggcggccgcgccuauagacacgccgucgaggaacugcccgagacgauggaaacccugcuccuucuggggcugaugauccuccugacaggaggcgcuaugcuuuuucugauuuccgggaaaggaaucggcaagaccagcaucgggcucauuugugugaucgccuccucuggaaugcuguggauggcggagauuccucugcaauggaucgccagcgcuauuguucucgaguucuuuaugauggugcuucugauccccgaaccugagaagcagcggacaccccaggacaaucaacuggccuacguggucauuggcauccucacccuggcugccaucauugcggccaacgaaaugggccuucuggagacgacaaaacgcgaucucgggauguccaaggaaccgggaguugugagcccuaccucuuaucuggacguggaucugcaucccgcuuccgccuggacacucuacgcugucgccaccaccgugaucacacccaugcuuagacacacgauugagaauagcaccgcuaacguuucucuggccgcgaucgccaaccaggcugugguccugaugggccucgacaaaggguggccuauuagcaagauggaccugggagugccgcuucuggcccucggcugcuacucccaggucaauccccugacacugaccgcugccgugcuccuucugaucacacauuaugccaucauugggccuggacugcaggcgaaagcuacccgggaggcccaaaagagaacggcugccggcaucaugaagaaccccacaguugauggcauuaugaccaucgaccucgauccugugauuuacgacucuaaauucgaaaagcagcuggggcaggucaugcuucuggugcucugugccguucagcugcugcucaugcgcaccagcugggcucuuugcgaggcccugacacuggcgaccggacccaucacaacgcucugggaaggcuccccugggaaauuuuggaauaccacaaucgccgugucuauggcuaacauuuuccggggaagcuaucuggccggcgcugggcuugccuuuuccaucaugaaaagcgucggaaccggcaaaagaggcacagggucucaaggagagacccugggcgaaaaguggaagaaaaagcucaaucagcugucccgcaaagauuucgaccuguacaagaaaagcgggauuacggagguggaucggaccgaggcgaaggaaggacucaaaagaggcgagaucacacaccaugccgugucccgggggucugcuaaacuucagugguuuguugaacgcaacauggucauuccggagggaagagugaucgaccugggcuguggcagagggggauggagcuauuacugcgccggccugaagaaagugaccgaaguccgcggguauacaaagggaggccccgggcacgaggagccuguucccauguccaccuacggauggaauauugugaaacucaugucuggcaaggauguguucuaccugccucccgaaaaaugugacacacuucugugcgauaucggcgagagcuccccgagcccuaccgucgaagagucuagaacgauccgggugcucaagaugguugagcccuggcugaagaacaaucaguucuguauuaaagugcugaaccccuauaugccuacagucaucgaacaccucgagcgccuucaaagaaagcaugggggaaugcuggugcggaauccccugucccgcaacagcacccacgaaauguacuggauuucuaauggcaccgggaacaucguugcuuccgugaauauggucagcagacuccugcuuaaccgguuuacaaugacgcauagacgcccuaccauugagaaagacguggaucugggagccggcacacggcacgugaacgcugaaccggagacccccaauauggacgucaucggggagagaaucaagcgcauuaaagaagaacacaacucuacauggcauuaugacgaugaaaauccuuacaagaccugggccuaucacggaagcuacgagguuaaggcgacaggcuccgccucuagcaugaucaacggcguggugaaacuccugaccaagcccugggacgucgugccuaugguuacgcagauggcuaugaccgauacaacccccuucgggcagcaacggguguuuaaagaaaaggucgacacaagaaccccgcgcuccaugccuggaacgcggagagugaugggcauuacagccgaguggcuguggcgcacccucgggcggaauaaaaagcccagacugugcacacgcgaggaguucaccaagaaaguucggacgaacgcugccaugggagccguguuuaccgaggaaaaucagugggauagcgcgaaggcugccgucgaggacgaagauuucuggaaacuuguggacagagagcgcgagcugcauaagcucggcaaauguggguccugcguuuauaacaugaugggcaagagagagaagaagcugggagaguuuggcaaggccaaagggucucgggcuaucugguacauguggcuuggagcccgcuaccuggaguucgaggcucucggcuuucugaaugaggaucacugguucagcagagaaaacuccuauucugggguggagggagaaggccugcauaagcucggguacauucugcgggacaucagcaaaaucccuggcggagccauguaugcggaugacacagccggcugggacaccagaauuacagaggaugaccuucacaaugaagagaagaucacccagcagauggaucccgagcaccggcaacuggcuaacgccauuuuuaaacucacauaccagaauaaggucgugaagguccagcgcccuacccccacggggacagugauggacaucauuuccagaaaagaucagcggggaucuggccaaguugggaccuauggacugaacaccuucacaaauauggaagcucagcuuauccgccagauggagggcgaaggggugcugagcaaggccgaccucgagaacccgcaucugccugagaaaaagaucacccaguggcuggagacaaaaggcgucgagagacucaagcggauggcgauuuccggagaugacugcguggugaagcccaucgaugaccgcuuugccaacgcucugcuugcccugaaugauaugggcaaaguuagaaaggacauuccccaauggcagccuagcaaaggguggcacgauuggcaacaggugccguucuguucucaucacuuccacgaacucaucaugaaggacggacggaaacuggucgugcccugccgcccucaagacgagcuuauuggcagagcucggaucucccagggggccggauggagccugaaggaaacggcuugucucggcaaggccuacgcgcagauguggucucugauguauuuucaucgcagagaucugcggcucgccuccaacgcuauuugcagcgccguucccgugcacugggucccuaccucucgcacaaccugguccauccaugcccaccaucaauggaugacaaccgaggacaugcugacgguguggaauagagucuggaucgaagauaaccccuggauggaggacaaaaccccugugacaaccugggagaauguucccuaccuugggaagcgggaagaucagugguguggcagccugauuggacucacauccagagcuaccugggcccagaacaucccgacggcgauucagcaagugcgcagccugaucggcaaugaggaguuccuugacuacaugccuucuaugaaacgguuuagaaaggaggaggaaagcgagggggcuauuugguga

SEQ ID NO: 20547 - RNA, 9873 nt, Artificial Sequence
  derived and/or modified CDS sequence (opt5) from DENV-3__HQ166034__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaccucagcccauggagcugaaguauucuuggaaaaccugggggaaggccaagaucgugacagccgaaacccaaaacuccagcuucauuaucgauggaccuaauacacccgagugcccgucugucuccagagcuuggaacgugugggaaguggaggacuacggcuuuggcgucuucaccacgaauaucuggcucaaacugcgcgaaguuuauacacagcugugugaccaccggcuuaugagcgcggccgugaaggaugagagagcugugcaugccgacaugggguacuggauugagucccagaaaaacggaucuuggaagcucgaaaaagccagccugaucgaggucaagaccugcaccuggccuaagucccacacacuguggucuaauggcgugcucgaaagcgauaugauuauccccaaaucccuggcugggccuauuagccagcauaaccaccgccccggauaccacacccaaacggccggcccuuggcaucuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcauaugaucgccggcguuuucuuuaccuucgugcuucugcucagcgggcagauuacauggcgcgauauggcccacacccugaucaugauuggauccaaugcuagcgacagaaugggcaugggggucacguaccuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagaucuaucagcucuggacagcccugauuucccuuacguguagcaacaccaucuucacacugaccguggcguggcgcacagccacccucauccuggcuggcgucucccugcuuccgaugugccaaucuagcuccaugcggaagacggacuggcugcccauggccguugcugccaugggggugccuccccucccucuguuuauuuucucucucaaggauacacugaaaagacgcagcuggccccuuaaugagggagugauggccgucggccugguguccauccuggcuucuagccuccugagaaacgacguuccuauggcggggccccuuguggccggaggccugcucauugcuuguuacgucaucaccgggaccuccgccgaucugacaguggaaaaggccgcugacauuaccugggaggaagaggccgaacagacaggaguuagccauaaccucaugaucacgguggacgaugacggcaccaugcggaucaaagaugacgagacagagaauauucugaccguccuucugaagacagcgcugcucaucgugucuggcauuuuuccguauuccaucccugcuacccugcuugucuggcacacguggcagaaacagacccaacgcagcggggugcugugggauguucccucuccucccgaaacacagaaggccgagcucgaagagggaguguacagaauuaaacagcagggcaucuucgggaagacccaagucggagugggcguucagaaggaggggguguuucacacaauguggcaugucacccggggagccgugcugacauacaacggcaaacgccucgaaccgaauugggcuuccgugaagaaagaccugauuagcuauggcgggggauggagacuuucugcccaguggcaaaagggcgaggaaguucaggucaucgcgguggagccugggaaaaaccccaagaauuuccagacgaugccuggaaccuuccagacaaccaccggcgaaaucggggcuauugcccuggauuuuaagcccggaacauccggcagccccaucauuaaccgggagggcaaaguggucgggcuguacggaaauggcgugguuacgaagaacgggggauauguguccggcaucgcccaaaccaaugcugagccugacgggccgacacccgaacucgaggaagagauguucaaaaagcgcaaccugaccauuauggaucuucacccuggcagcggaaaaacaagaaaguaccugcccgccaucguccgggaagcuaucaagcgcagacuccggacccugauucucgccccuacgagagugguugcggccgagauggaggaagcucugaaaggccuucccauccgcuaucagacaaccgccaccaagucugagcauacagggcgggaaauuguggaccugaugugccacgcuaccuuuacaaugagacugcucagcccuguccgcgugccgaauuacaaccugaucauuauggaugaggcccauuucaccgaccccgccuccaucgcugcgcggggauauaucucuacgagaguuggcaugggggaagccgcugccauuuuuaugacagccaccccucccggaacagcugaugccuucccucagagcaaugcgcccauccaggacgaggagcgcgacauuccggaacgguccuggaacucuggcaaugaguggaucaccgauuuugcugggaaaacggugugguucgucccuagcauuaaggccggcaacgacaucgccaacugucuucgcaaaaauggaaagaaggugauucaacuguccagaaaaaccuuugauacagaauaccagaagaccaaacucaacgacugggauuucguggucacaaccgacaucucugagaugggcgcuaauuuuaaggccgaucggguuaucgaccccagacggugccugaaacccgugauucugacagaugggccugagcgcgugauccucgcgggacccaugccugucaccgccgcuagcgccgcucagagacggggccgcguggggagaaacccgcagaaggaaaaugaccaauacauuuucacgggacagccccuuaacaaugaugaggaccacgcccacuggacagaagcuaagaugcugcuggacaacaucaauaccccugagggcauuauccccgcccucuucgaaccugagcgggagaaauccgcggccaucgauggggaauauagacugaagggcgagagccgcaaaaccuuuguugaacuuaugcggagaggagaccugcccguguggcucgcucauaaggucgccucugagggcauuaaauacacagaucgcaaguggugcuucgacgggcagcggaacaaucagauccuggaagagaacauggauguggagauuuggaccaaagaaggagagaagaagaaacugagaccgcgcuggcucgacgcucggacauauuccgauccucuugcccugaaggaauuuaaagaguucgccgcuggcagaaagagcaucgcgcuggaccucguuacggaaauugggcgcgugcccucucaccuggcccauagaacccggaaugcucuugauaaccuggucaugcuccacacauccgagcacggaggccgcgccuacagacaugccguggaggaacugccugagaccauggaaacacugcuccuucugggccugaugauccuccugaccgggggagcuaugcuuuuucugaucagcggcaaagggauuggaaagacguccaucggccucauuugugucaucgccucuagcgggaugcuguggauggcggagauuccccugcaauggaucgccuccgcuauugugcucgaguucuuuaugaugguucuucugaucccugaacccgagaagcagcggaccccgcaggacaaucaacuggccuauguggugaucggcauucucacacuggcugccaucauugcggccaacgaaaugggccuucuggagaccacaaaacgcgaucucggcaugagcaaggaaccuggggucguuucucccaccuccuaccuggacguggaucugcaccccgcuagcgccuggacgcucuaugcuguggccacaaccgucaucacaccuaugcuuagacauaccauugaaaauucuaccgcuaacgugagccuggccgcgaucgccaaccaggcuguugugcugaugggacucgacaaaggcuggccgaucuccaagauggaccugggggucccccuucuggcccucggaugcuacucucaggugaauccucugacacugacggcugccguccuccuucugauuacccacuacgccaucauuggccccgggcugcaggcgaaagcuacacgggaggcccaaaagagaaccgcugccggaaucaugaagaacccuacaguggauggcauuaugaccaucgaccucgaucccguuaucuaugacagcaaauucgaaaagcagcugggccaggugaugcuucugguccucugugugguucagcugcugcucaugcgcacguccugggcccuuugcgaggcucugacacuggccaccgggccuauuaccacacucugggaaggaucuccgggcaaauuuuggaauaccacaaucgcggugagcauggccaacauuuuccggggguccuaccuggcuggagccggccuugcuuuuagcaucaugaagucugucgggacgggaaaaagaggcaccggcucccaaggggagacacugggagaaaaguggaagaaaaagcucaaucagcugagccgcaaagauuucgaccuguauaagaaauccggcauuaccgagguggaucggacagaggccaaggaagggcucaaaagaggagagaucacccaucacgcggugucucggggcagcgccaaacuucagugguuuguugaacgcaacauggucauucccgaggggagagugaucgaccugggauguggccggggcgggugguccuacuauugcgcuggacugaagaaagugacggaaguccgcggcuacaccaaagggggaccuggccacgaggagcccguuccuaugucuacauauggguggaauaucgugaaacucaugagcggaaaggauguguucuaccugcccccggaaaaaugugacacccuucugugcgauauuggcgaguccagcccuucucccacagucgaagaguccagaaccauccgggugcucaagaugguugagcccuggcugaagaacaaucaguucuguauuaaagugcugaacccuuacaugcccacagucaucgaacaucucgagcgccuucaaagaaagcacggcgggaugcuggugcggaauccucugagccgcaacucuacccaugaaauguauuggauuuccaauggaacgggcaacaucguugccagcgugaauauggucucuagacuccugcuuaaccgguuuacaaugacccacagacgcccgaccaucgagaaagacguggaucugggggcuggaacacggcacgugaacgccgaacccgagacgccuaauauggacgucauuggcgagagaaucaagcgcauuaaagaagaacacaacagcaccuggcacuacgacgaugaaaaucccuauaagacaugggcuuaccauggguccuaugagguuaaggccaccggaucugcgagcuccaugaucaacggcguggugaaacuccugacaaagccuugggacgucgugcccaugguuacccagauggccaugacagauaccacgccguucggccagcaacggguguuuaaagaaaaggucgacaccagaacaccucgcagcaugcccgggacccggagagugaugggaauuacagcugaguggcuguggcgcacccucggccggaauaaaaagccuagacugugcacgcgcgaggaguucacaaagaaaguucggaccaacgccgcuaugggggccguguuuacagaggaaaaucagugggauuccgccaaggcggcugucgaggacgaagauuucuggaaacuuguggacagagagcgcgagcugcacaagcucggaaaauguggcucuugcguuuacaacaugauggggaagagagagaagaagcugggcgaguuuggaaaggccaaaggcagccgggccaucugguauauguggcuuggggcucgcuaccuggaguucgaggcccucggauuucugaaugaggaucauugguucuccagagaaaacucuuacagcggcguggagggggaaggacugcacaagcucggcuauauccugcgggacauuuccaaaauccccggggcugccauguacgcggaugacaccgccggcugggacacgagaauuaccgaggaugaccuucacaaugaagagaagaucacacagcagauggauccugagcaucggcaacuggcuaacgccauuuuuaaacucaccuaucagaauaaggucgugaagguccagcgccccacaccgaccggaacagugauggacaucaucucuagaaaagaucagcggggcagcgggcaaguuggaaccuacggccugaacacguucacaaauauggaagcucagcuuauucgccagauggagggggaaggagugcuguccaaggccgaccucgagaacccucaucugcccgagaagaagaucacccaguggcuggagaccaaaggcgucgagagacucaagcggauggcgauuagcggggaugacugcguggugaagcccaucgaugaccgcuuugccaacgcucugcuugcccugaaugauaugggcaaaguuagaaaggacauuccucaauggcagccgucuaaaggauggcaugauuggcaacaggugcccuucuguucccaccacuuccaugaacucaucaugaaggacggccggaaacuggucgugccuugccgcccccaagacgagcuuauugggagagcucggaucagccagggagccggcuggucucugaaggaaacagcuugucucgggaaggccuaugcgcagauguggucccugauguacuuucaccgcagagaucugcggcucgccagcaacgcuaucugcucugccguuccugugcauuggguccccaccucccgcacaacguggagcauucacgcccaucaccaauggaugaccacagaggacaugcugaccguguggaauagagucuggaucgaagauaacccuuggauggaggacaaaacacccgugaccacgugggagaauguuccguaucuuggaaagcgggaagaucagugguguggcucccugauugggcucaccagcagagcuacaugggcccagaacaucccuaccgcgauucagcaagugcgcucucugaucggcaaugaggaguuccuugacuacaugcccagcaugaaacgguuuagaaaggaggaggaauccgagggagcuaucugguga

SEQ ID NO: 20548 - RNA, 9873 nt, Artificial Sequence
  derived and/or modified CDS sequence (opt5) from DENV-3__HM756274__SS-prME
accagccugugccucaugaugauccugcccgcggcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacgccuuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugucuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucggacucaaggauacacugaaaagacgcucuuggccccuuaaugagggcgucauggcuguggggcugguuagcauucuggcguccucucuccugagaaacgacgugccuauggccggaccccuugucgcuggcgggcugcucaucgccuguuaugugauuaccggaaccagcgccgaucugacaguugaaaaggcugccgacaucaccugggaggaagaggcggaacagacaggcgugucccacaaccucaugauuacggucgacgaugacggcaccaugcggaucaaagaugacgagacagagaauauccugaccgugcuucugaagacagcucugcucauugucagcgggaucuuuccguacucuauuccugccacccugcuuguguggcauacguggcagaaacagacccaacgcuccggaguucugugggaugugcccagcccucccgaaacacagaaggccgagcucgaagagggcgucuacagaaucaaacagcaggggauuuucggaaagacccaagugggcguuggggugcagaaggagggagucuuucacacaauguggcacgugacccggggcgcugugcugacacauaacggcaaacgccucgaaccgaauugggccucuguuaagaaagaccugaucuccuaugggggaggcuggagacuuagcgcgcaguggcaaaagggggaggaaguccaggugauugcuguggagccuggcaagaaccccaagaauuuccagacgaugccuggcaccuuccagacaaccaccggggaaaucggagccaucgcccuggauuuuaagcccggcacaucuggcucccccauuaucaaccgggaggggaaagucgugggacuguacggcaaugggguugugacgaagaacggaggcuaugucagcgggauugcucaaaccaaugccgagccugacggcccgacacccgaacucgaggaagagauguucaaaaagcgcaaccugaccaucauggaucuucacccuggauccggcaaaacaagaaaguaccugcccgcuauugugcgggaagccaucaagcgcagacuccggacccugauccucgcgccuacgagaguuguggccgcugagauggaggaagcccugaaagggcuucccauucgcuaucagacaaccgcuaccaagagcgagcauacaggacgggaaaucgucgaccugaugugccacgccaccuuuacaaugagacugcucucuccugugcgcguuccgaauuacaaccugauuaucauggaugaggcccauuucaccgaccccgcuagcauugcggcccggggcuauaucuccacgagaguggggaugggagaagcugccgccaucuuuaugacagcuaccccucccggcacagccgaugcguucccucagucuaaugcucccauucaggacgaggagcgcgacaucccggaacggagcuggaacuccgggaaugaguggauuaccgauuuugccggcaaaacggucugguucgugccuucuaucaaggccggaaacgacauugcuaacugucuucgcaaaaauggcaagaaggugauccaacugagcagaaaaaccuuugauacagaauaccagaagaccaaacucaacgacugggauuucgucguuacaaccgacauuuccgagaugggggccaauuuuaaggcggaucgggugaucgaccccagacggugccugaaacccgugauccugacagauggaccugagcgcgucauucucgccggccccaugccugugaccgcugccucugcugcccagagacgggggcgcguuggaagaaacccgcagaaggaaaaugaccaauacaucuucacgggccagccccuuaacaaugaugaggaccacgcucacuggacagaagccaagaugcugcuggacaacauuaauaccccugaggggaucauucccgcccucuucgaaccugagcgggagaaaagcgccgcuaucgauggcgaauauagacugaagggagagucccgcaaaaccuuuguggaacuuaugcggagaggcgaccugcccgucuggcucgcccauaagguggcuagcgaggggaucaaauacacagaucgcaaguggugcuucgacggacagcggaacaaucagauucuggaagagaacauggauguugagaucuggaccaaagaaggcgagaagaagaaacugagaccgcgcuggcucgacgcccggacauauucugauccucuugcccugaaggaauuuaaagaguucgcugcggggagaaaguccauugcccuggaccucgugacggaaaucggacgcguccccagccaccuggcucauagaacccggaaugcccuugauaaccuggugaugcuccacacaucugagcacggcggccgcgccuacagacaugcugucgaggaacugccugagaccauggaaacacugcuccuucuggggcugaugauucuccugaccggaggcgccaugcuuuuucugaucuccgggaaaggaaucggcaagacgagcauugggcucaucugugugauugcguccucuggaaugcuguggauggccgagaucccccugcaauggauugcuagcgccaucguucucgaguucuuuaugauggugcuucugauuccugaacccgagaagcagcggaccccgcaggacaaucaacuggcuuauguggucaucggcauccucacacuggccgcgauuaucgccgcuaacgaaaugggccuucuggagaccacaaaacgcgaucucgggauguccaaggaaccuggaguugugagccccaccucuuaccuggacguggaucugcaccccgccuccgcuuggacgcucuaugccgucgcuacaaccgugauuacaccuaugcuuagacauaccaucgagaauagcaccgccaacguuucucuggcggccauugcuaaccaggccgugguccugaugggccucgacaaaggguggccgaucagcaagauggaccugggagugccccuucuggcucucggcugcuacucccaggucaauccucugacacugacggccgccgugcuccuucugaucacccacuacgcgauuaucgggcccggacugcaggcuaaagccacacgggaggcucaaaagagaaccgccgccggcauuaugaagaacccuacaguugauggcaucaugaccauugaccucgaucccgugaucuaugacucuaaauucgaaaagcagcuggggcaggucaugcuucuggugcucugugcuguucagcugcugcucaugcgcacgagcugggcccuuugcgaggcgcugacacuggccaccggaccuaucaccacacucugggaaggcuccccggggaaauuuuggaauaccacaauugcugugucuauggccaacaucuuccggggaagcuaccuggcuggcgccgggcuugcguuuuccauuaugaaaagcgucggaacgggcaaaagaggcaccgggucucaaggagagacacugggcgaaaaguggaagaaaaagcucaaucagcugucccgcaaagauuucgaccuguauaagaaaagcgggaucaccgagguggaucggacagaggccaaggaaggacucaaaagaggcgagauuacccaucacgcugugucccgggggucugccaaacuucagugguuuguugaacgcaacauggucauccccgagggaagagugauugaccugggcuguggcagagggggauggagcuacuauugcgcuggccugaagaaagugacggaaguccgcggguacaccaagggaggcccugggcacgaggagcccguuccuauguccacauauggauggaauaucgugaaacucaugucuggcaaggauguguucuaccugcccccggaaaaaugugacacccuucugugcgauaucggcgagagcuccccuagccccacagucgaagagucuagaaccauucgggugcucaagaugguugagcccuggcugaagaacaaucaguucuguaucaaagugcugaacccuuacaugcccacagucauugaacaucucgagcgccuucaaagaaagcacgggggaaugcuggugcggaauccucugucccgcaacagcacccaugaaauguauuggaucucuaauggcacggggaacauuguugccuccgugaauauggucagcagacuccugcuuaaccgguuuacaaugacccacagacgcccgaccaucgagaaagacguggaucugggagcuggcacacggcacgugaacgccgaacccgagacgccuaauauggacgucaucggggagagaauuaagcgcaucaaagaagaacacaacucuaccuggcacuacgacgaugaaaaucccuauaagacaugggcguaccauggaagcuaugagguuaaggccaccggcuccgcuucuagcaugauuaacggcguggugaaacuccugacaaagccuugggacgucgugcccaugguuacccagauggccaugacagauaccacgccguucgggcagcaacggguguuuaaagaaaaggucgacaccagaacaccucgcuccaugcccggaacccggagagugaugggcaucacagcugaguggcuguggcgcacccucgggcggaauaaaaagccuagacugugcacgcgcgaggaguucacaaagaaaguucggaccaacgccgccaugggagcgguguuuacagaggaaaaucagugggauagcgcuaaggccgccgucgaggacgaagauuucuggaaacuuguggacagagagcgcgagcugcacaagcucggcaaauguggguccugcguuuacaacaugaugggcaagagagagaagaagcugggagaguuuggcaaggcuaaagggucucgggccauuugguauauguggcuuggagcucgcuaccuggaguucgaggcccucggcuuucugaaugaggaucauugguucagcagagaaaacuccuacucugggguggagggagaaggccugcacaagcucggguauauccugcgggacaucagcaaaauucccggcggagcgauguacgccgaugacaccgcuggcugggacacgagaaucaccgaggaugaccuucacaaugaagagaagauuacacagcagauggauccugagcaucggcaacuggccaacgcuaucuuuaaacucaccuaucagaauaaggucgugaagguccagcgccccacaccgaccgggacagugauggacauuaucuccagaaaagaucagcggggaucuggccaaguugggaccuacggacugaacacguucacaaauauggaagcccagcuuauccgccagauggagggcgaaggggugcugagcaaggcggaccucgagaacccucaucugcccgagaaaaagauuacccaguggcuggagaccaaaggcgucgagagacucaagcggauggccaucuccggagaugacugcguggugaagcccauugaugaccgcuuugcuaacgcccugcuugcucugaaugauaugggcaaaguuagaaaggacaucccucaauggcagccgagcaaaggguggcaugauuggcaacaggugcccuucuguucucaccacuuccaugaacucauuaugaaggacggacggaaacuggucgugccuugccgcccccaagacgagcuuaucggcagagcccggauuucccagggggcuggauggagccugaaggaaacagccugucucggcaaggcguaugcccagauguggucucugauguacuuucaccgcagagaucugcggcucgcuuccaacgccaucugcagcgccguuccugugcauuggguccccaccucucgcacaacgugguccauccacgcucaucaccaauggaugaccacagaggacaugcugaccguguggaauagagucuggauugaagauaacccuuggauggaggacaaaacacccgugaccacgugggagaauguuccguaucuugggaagcgggaagaucagugguguggcagccugaucggacucaccuccagagccacaugggcgcagaacauuccuaccgcuauccagcaagugcgcagccugauuggcaaugaggaguuccuugacuacaugcccucuaugaaacgguuuagaaaggaggaggaaagcgagggggccaucugguga

SEQ ID NO: 20549 - RNA, 9873 nt, Artificial Sequence
  derived and/or modified CDS sequence (opt5) from DENV-3__HM756275__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaccucagcccauggagcugaaguauucuuggaaaaccugggggaaggccaagaucgugacagccgaaacccaaaacuccagcuucauuaucgauggaccuaauacacccgagugcccgucugucuccagagcuuggaacgugugggaaguggaggacuacggcuuuggcgucuucaccacgaauaucuggcucaaacugcgcgaaguuuauacacagcugugugaccaccggcuuaugagcgcggccgugaaggaugagagagcugugcaugccgacaugggguacuggauugagucccagaaaaacggaucuuggaagcucgaaaaagccagccugaucgaggucaagaccugcaccuggccuaagucccacacacuguggucuaauggcgugcucgaaagcgauaugauuauccccaaaucccuggcugggccuauuagccagcauaaccaccgccccggauaccacacccaaacggccggcccuuggcaucuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcauaugaucgccggcguuuucuuuaccuucgugcuucugcucagcgggcagauuacauggcgcgauauggcccacacccugaucaugauuggauccaaugcuagcgacagaaugggcaugggggucacguaccuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagaucuaucagcucuggacagcccugauuucccuuacguguagcaacaccaucuucacacugaccguggcguggcgcacagccacccucauccuggcuggcgucucccugcuuccgaugugccaaucuagcuccaugcggaagacggacuggcugcccauggccguugcugccaugggggugccuccccucccucuguuuauuuucucucucaaggauacacugaaaagacgcagcuggccccuuaaugagggagugauggccgucggccugguguccauccuggcuucuagccuccugagaaacgacguuccuauggcggggccccuuguggccggaggccugcucauugcuuguuacgucaucaccgggaccuccgccgaucugacaguggaaaaggccgcugacauuaccugggaggaagaggccgaacagacaggaguuagccauaaccucaugaucacgguggacgaugacggcaccaugcggaucaaagaugacgagacagagaauauucugaccguccuucugaagacagcgcugcucaucgugucuggcauuuuuccguauuccaucccugcuacccugcuugucuggcacacguggcagaaacagacccaacgcagcggggugcugugggauguucccucuccucccgaaacacagaaggccgagcucgaagagggaguguacagaauuaaacagcagggcaucuucgggaagacccaagucggagugggcguucagaaggaggggguguuucacacaauguggcaugucacccggggagccgugcugacauacaacggcaaacgccucgaaccgaauugggcuuccgugaagaaagaccugauuagcuauggcgggggauggagacuuucugcccaguggcaaaagggcgaggaaguucaggucaucgcgguggagccugggaaaaaccccaagaauuuccagacgaugccuggaaccuuccagacaaccaccggcgaaaucggggcuauugcccuggauuuuaagcccggaacauccggcagccccaucauuaaccgggagggcaaaguggucgggcuguacggaaauggcgugguuacgaagaacgggggauauguguccggcaucgcccaaaccaaugcugagccugacgggccgacacccgaacucgaggaagagauguucaaaaagcgcaaccugaccauuauggaucuucacccuggcagcggaaaaacaagaaaguaccugcccgccaucguccgggaagcuaucaagcgcagacuccggacccugauucucgccccuacgagagugguugcggccgagauggaggaagcucugaaaggccuucccauccgcuaucagacaaccgccaccaagucugagcauacagggcgggaaauuguggaccugaugugccacgcuaccuuuacaaugagacugcucagcccuguccgcgugccgaauuacaaccugaucauuauggaugaggcccauuucaccgaccccgccuccaucgcugcgcggggauauaucucuacgagaguuggcaugggggaagccgcugccauuuuuaugacagccaccccucccggaacagcugaugccuucccucagagcaaugcgcccauccaggacgaggagcgcgacauuccggaacgguccuggaacucuggcaaugaguggaucaccgauuuugcugggaaaacggugugguucgucccuagcauuaaggccggcaacgacaucgccaacugucuucgcaaaaauggaaagaaggugauucaacuguccagaaaaaccuuugauacagaauaccagaagaccaaacucaacgacugggauuucguggucacaaccgacaucucugagaugggcgcuaauuuuaaggccgaucggguuaucgaccccagacggugccugaaacccgugauucugacagaugggccugagcgcgugauccucgcgggacccaugccugucaccgccgcuagcgccgcucagagacggggccgcguggggagaaacccgcagaaggaaaaugaccaauacauuuucacgggacagccccuuaacaaugaugaggaccacgcccacuggacagaagcuaagaugcugcuggacaacaucaauaccccugagggcauuauccccgcccucuucgaaccugagcgggagaaauccgcggccaucgauggggaauauagacugaagggcgagagccgcaaaaccuuuguugaacuuaugcggagaggagaccugcccguguggcucgcucauaaggucgccucugagggcauuaaauacacagaucgcaaguggugcuucgacgggcagcggaacaaucagauccuggaagagaacauggauguggagauuuggaccaaagaaggagagaagaagaaacugagaccgcgcuggcucgacgcucggacauauuccgauccucuugcccugaaggaauuuaaagaguucgccgcuggcagaaagagcaucgcgcuggaccucguuacggaaauugggcgcgugcccucucaccuggcccauagaacccggaaugcucuugauaaccuggucaugcuccacacauccgagcacggaggccgcgccuacagacaugccguggaggaacugccugagaccauggaaacacugcuccuucugggccugaugauccuccugaccgggggagcuaugcuuuuucugaucagcggcaaagggauuggaaagacguccaucggccucauuugugucaucgccucuagcgggaugcuguggauggcggagauuccccugcaauggaucgccuccgcuauugugcucgaguucuuuaugaugguucuucugaucccugaacccgagaagcagcggaccccgcaggacaaucaacuggccuauguggugaucggcauucucacacuggcugccaucauugcggccaacgaaaugggccuucuggagaccacaaaacgcgaucucggcaugagcaaggaaccuggggucguuucucccaccuccuaccuggacguggaucugcaccccgcuagcgccuggacgcucuaugcuguggccacaaccgucaucacaccuaugcuuagacauaccauugaaaauucuaccgcuaacgugagccuggccgcgaucgccaaccaggcuguugugcugaugggacucgacaaaggcuggccgaucuccaagauggaccugggggucccccuucuggcccucggaugcuacucucaggugaauccucugacacugacggcugccguccuccuucugauuacccacuacgccaucauuggccccgggcugcaggcgaaagcuacacgggaggcccaaaagagaaccgcugccggaaucaugaagaacccuacaguggauggcauuaugaccaucgaccucgaucccguuaucuaugacagcaaauucgaaaagcagcugggccaggugaugcuucugguccucugugugguucagcugcugcucaugcgcacguccugggcccuuugcgaggcucugacacuggccaccgggccuauuaccacacucugggaaggaucuccgggcaaauuuuggaauaccacaaucgcggugagcauggccaacauuuuccggggguccuaccuggcuggagccggccuugcuuuuagcaucaugaagucugucgggacgggaaaaagaggcaccggcucccaaggggagacacugggagaaaaguggaagaaaaagcucaaucagcugagccgcaaagauuucgaccuguauaagaaauccggcauuaccgagguggaucggacagaggccaaggaagggcucaaaagaggagagaucacccaucacgcggugucucggggcagcgccaaacuucagugguuuguugaacgcaacauggucauucccgaggggagagugaucgaccugggauguggccggggcgggugguccuacuauugcgcuggacugaagaaagugacggaaguccgcggcuacaccaaagggggaccuggccacgaggagcccguuccuaugucuacauauggguggaauaucgugaaacucaugagcggaaaggauguguucuaccugcccccggaaaaaugugacacccuucugugcgauauuggcgaguccagcccuucucccacagucgaagaguccagaaccauccgggugcucaagaugguugagcccuggcugaagaacaaucaguucuguauuaaagugcugaacccuuacaugcccacagucaucgaacaucucgagcgccuucaaagaaagcacggcgggaugcuggugcggaauccucugagccgcaacucuacccaugaaauguauuggauuuccaauggaacgggcaacaucguugccagcgugaauauggucucuagacuccugcuuaaccgguuuacaaugacccacagacgcccgaccaucgagaaagacguggaucugggggcuggaacacggcacgugaacgccgaacccgagacgccuaauauggacgucauuggcgagagaaucaagcgcauuaaagaagaacacaacagcaccuggcacuacgacgaugaaaaucccuauaagacaugggcuuaccauggguccuaugagguuaaggccaccggaucugcgagcuccaugaucaacggcguggugaaacuccugacaaagccuugggacgucgugcccaugguuacccagauggccaugacagauaccacgccguucggccagcaacggguguuuaaagaaaaggucgacaccagaacaccucgcagcaugcccgggacccggagagugaugggaauuacagcugaguggcuguggcgcacccucggccggaauaaaaagccuagacugugcacgcgcgaggaguucacaaagaaaguucggaccaacgccgcuaugggggccguguuuacagaggaaaaucagugggauuccgccaaggcggcugucgaggacgaagauuucuggaaacuuguggacagagagcgcgagcugcacaagcucggaaaauguggcucuugcguuuacaacaugauggggaagagagagaagaagcugggcgaguuuggaaaggccaaaggcagccgggccaucugguauauguggcuuggggcucgcuaccuggaguucgaggcccucggauuucugaaugaggaucauugguucuccagagaaaacucuuacagcggcguggagggggaaggacugcacaagcucggcuauauccugcgggacauuuccaaaauccccgggggcgcuauguacgccgaugacaccgcgggaugggacacgagaauuaccgaggaugaccuucacaaugaagagaagaucacacagcagauggauccugagcaucggcaacuggccaacgcuauuuuuaaacucaccuaucagaauaaggucgugaagguccagcgccccacaccgaccggcacagugauggacaucaucucuagaaaagaucagcgggggagcggacaaguuggcaccuacgggcugaacacguucacaaauauggaagcccagcuuauucgccagauggagggagaaggcgugcuguccaaggcugaccucgagaacccucaucugcccgagaagaagaucacccaguggcuggagaccaaaggggucgagagacucaagcggauggccauuagcggcgaugacugcguggugaagcccaucgaugaccgcuuugcgaacgcccugcuugcucugaaugauaugggaaaaguuagaaaggacauuccucaauggcagccgucuaaaggcuggcaugauuggcaacaggugcccuucuguucccaccacuuccaugaacucaucaugaaggacgggcggaaacuggucgugccuugccgcccccaagacgagcuuauuggacgggcccggaucagccagggcgcuggguggucucugaaggaaacagccugucucggaaaggcuuaugcccagauguggucccugauguacuuucaccgcagagaucugcggcucgcgagcaacgccaucugcucugcuguuccugugcauuggguccccaccucccgcacaacguggagcauucacgcccaucaccaauggaugaccacagaggacaugcugaccguguggaauagagucuggaucgaagauaacccuuggauggaggacaaaacacccgugaccacgugggagaauguuccguaucuuggcaagcgggaagaucaguggugugggucccugauuggccucaccagcagagccacaugggcucagaacaucccuaccgccauucagcaagugcgcucucugaucggaaaugaggaguuccuugacuacaugcccagcaugaaacgguuuagaaaggaggaggaauccgagggcgcgaucugguga

SEQ ID NO: 20550 - RNA, 9873 nt, Artificial Sequence
  derived and/or modified CDS sequence (opt5) from DENV-3__JF937632__SS-prME
accagccugugccucaugaugauccugcccgccgcucuugccuuccaccugaccucccgggacggagaaccucggaugauuguggggaagaacgaacgcggaaaaucucuccuguuuaagacggcgagcggcaucaauauguguacccuuauugcuauggaucugggggaaaugugcgacgauacggugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauauuggagaagauggcuguugguacgggauggagaucagacccauuucugaaaaggaggagaauauggugaaaucccugguuagcgcgggaucuggcaagguggacaacuucacaauggggguccugugccucgcuauccuguuugaagaggugaugcggggaaaguucggcaaaaagcacaugauugccggcguuuucuuuaccuucgugcuucugcucagcgggcagaucacauggcgcgauauggcccauacccugauuaugaucggauccaaugcuagcgacagaaugggcaugggggucacguaucuggcccuuaucgcgacauuuaaaauucagcccuuccuggcucucggauuuuuccugcggaagcucaccucuagagaaaaccugcuucugggcguggggcucgccauggccacaacccugcaacugccugaggauaucgaacagauggcuaauggaauugcccuuggccugauggcucucaaacugaucacccaguuugagacauaccagcucuggacggcccugauuucccuuaccuguagcaacacaaucuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuauuuucucucucaaggauacccugaaaagacgcagcuggccccuuaaugagggagucauggccgugggccugguuuccauccuggcuucuagccuccugagaaacgacgugccuauggcggggccccuugucgccggaggccugcucauugcuuguuaugugaucaccgggacauccgccgaucugaccguugaacgggccgcugacauuacaugggaggaagaggccgaacagacgggagugagccacaaccucaugaucaccgucgacgaugacggcacaaugcgcaucaaggaugacgagaccgagaauauucugacagugcuucugaaaaccgcgcugcucaucgucucuggcauuuuuccguacuccaucccugcuacgcugcuuguguggcauaccuggcagaagcagacacaaagaagcgggguucugugggaugugcccucuccucccgaaacccagaaagccgagcucgaagagggagucuaccggauuaagcagcagggcaucuucgggaaaacacaagugggaguuggcgugcagaaggagggggucuuucacaccauguggcacgugacacgcggagccgugcugacguauaacggcaagagacucgaaccgaauugggcuuccguuaaaaaggaccugauuagcuacggcgggggauggcggcuuucugcccaguggcaaaaaggcgaggaaguccaggugaucgcgguggagccugggaagaaccccaaaaauuuccagaccaugccuggaacauuccagaccaccacaggcgaaaucggggcuauugcccuggauuuuaagcccggaacguccggcagccccaucauuaaccgcgagggcaaggucguggggcuguauggaaauggcguugugaccaaaaacgggggauacgucuccggcaucgcccaaacaaaugcugagccugacgggccgacccccgaacucgaggaagagauguucaagaaaagaaaccugacaauuauggaucuucauccuggcagcggaaagacccggaaauaucugcccgccaucgugcgcgaagcuaucaagagacggcucagaacgcugauucucgccccuacacgcguuguggcggccgagauggaggaagcucugaagggccuucccauccgguaccagaccaccgccacaaaaucugagcacaccgggagagaaauugucgaccugaugugccaugcuacauuuaccaugcgccugcucagcccugugcggguuccgaauuauaaccugaucauuauggaugaggcccacuucacggaccccgccuccaucgcugcgagaggauacaucucuacacgcgugggcaugggggaagccgcugccauuuuuaugaccgccacaccucccggaaccgcugaugccuucccucagagcaaugcgcccauccaggacgaggagcgggacauuccggaaagauccuggaacucuggcaaugaguggaucacggauuuugcugggaagaccgucugguucgugccuagcauuaaagccggcaacgacaucgccaacugucuucgcaagaauggcaaaaaggugauucaacugucccggaagacauuugauaccgaauaccagaaaacaaagcucaacgacugggauuucgucguuaccacagacaucucugagaugggagcuaauuuuaaagccgauagagugaucgacccccggcgcugccugaagcccgugauucugaccgaugggccugagagagucauccucgcgggacccaugccugugacggccgcuagcgccgcucagcggcgcggcagaguugggcggaacccgcagaaagaaaaugaccaauauauuuucacaggacagccccuuaacaaugaugaggaccaugcccacuggaccgaagcuaagaugcugcuggacaacaucaauaccccugagggcauuauccccgcccucuucgaaccugagagagagaaguccgcggccaucgauggggaauaccgccugaaaggcgagagccggaagacauuuguggaacuuaugagacgcggagaccugcccgucuggcucgcucacaaaguggccucugagggcauuaaguauaccgaucggaaauggugcuucgacgggcagagaaacaaucagauccuggaagagaacauggauguugagauuuggacaaaggaaggagagaaaaagaagcugcgcccgcgguggcucgacgcuagaacguacuccgauccucuugcccugaaagaauuuaaggaguucgccgcuggccgcaaaagcaucgcgcuggaccucgugaccgaaauugggagaguccccucucaucuggcccaccggacacgcaaugcucuugauaaccuggugaugcuccauaccuccgagcacggaggcagagccuaucggcacgccgucgaggaacugccugagacaauggaaacccugcuccuucugggccugaugauccuccugacagggggagcuaugcuuuuucugaucagcggcaaggggauuggaaaaaccuccaucggccucauuugugugaucgccucuagcgggaugcuguggauggcggagauuccccugcaauggaucgccuccgcuauuguucucgaguucuuuaugauggugcuucugaucccugaacccgagaagcagcgcacaccgcaggacaaucaacuggccuacguggucaucggcauucucacccuggcugccaucauugcggccaacgaaaugggccuucuggagacaaccaagagagaucucggcaugagcaaagaaccugggguugugucucccacguccuaucuggacguggaucugcaucccgcuagcgccuggacacucuacgcugucgccaccacagugaucaccccuaugcuucggcacaccauugaaaauucuacagcuaacguuagccuggccgcgaucgccaaccaggcugugguccugaugggacucgacaagggcuggccgaucuccaaaauggaccugggggugccccuucuggcccucggaugcuacucucaggucaauccucugacgcugaccgcugccgugcuccuucugauuacacauuaugccaucauuggccccgggcugcaggcgaaggcuaccagagaggcccaaaaacgcacagcugccggaaucaugaagaacccuaccguugauggcauuaugacgaucgaccucgaucccgugaucuacgacagcaaguucgaaaaacagcugggccaggucaugcuucuggugcucugugccguucagcugcugcucaugcggacauccugggcucuuugcgaggcccugacccuggcgaccgggccuauuacaacccucugggaaggaucuccgggcaaguuuuggaauacaacgaucgccgugagcauggcuaacauuuucagaggguccuaucuggccggagcuggccuugccuuuagcaucaugaaaucugucgggaccggaaagcgcggcacaggcccccaaggggagacccugggagaaaaauggaagaagaaacucaaucagcugucccggaaggauuucgaccuguacaaaaagagcggcauuacagagguggauagaaccgaggcgaaagaagggcucaagcggggagagaucacgcaccaugccgugucccgcggcucugcuaaacuucagugguuuguugaaagaaacauggucauuccugaggggcgggugaucgaccugggauguggccgcggcggguggagcuauuacugcgccggacugaagaaggugaccgaagucagaggcuauacaaaagggggacccggccacgaggagccuguucccauguccaccuacggguggaauaucgugaagcucaugucuggaaaagauguguucuaccugccgccugaaaagugugacacacuucugugcgauauuggcgagagcucccccagccccaccgucgaagagucucggacaauccgcgugcucaaaaugguugagccuuggcugaagaacaaucaguucuguauuaaggugcugaaccccuauaugccuaccgucaucgaacaccucgagagacuucaacggaaacauggcgggaugcuggugcgcaauccgcuguccagaaacagcacgcacgaaauguacuggauuucuaauggaacaggcaacaucguugcuuccgugaauauggucagccggcuccugcuuaacagauuuaccaugacccaucgccggcccacaaucgagaaggacguggaucugggggccggaacgagacacgugaacgcugaaccugagacccccaauauggacgucauuggcgagcgcaucaaacggauuaaggaagaacacaacucuacauggcauuaugacgaugaaaauccuuacaaaaccugggccuaucacgggagcuacgagguuaaggcgacaggauccgccucuagcaugaucaacggcguggugaagcuccugaccaaacccugggacgucgugccgaugguuacacagauggcuaugaccgauacgaccccuuucggccagcaaagaguguuuaaggaaaaagucgacacacgcacaccccgguccaugccugggacaagacgcgugaugggaauuaccgccgaguggcuguggcggacgcucggcagaaauaagaaaccccgccugugcacacgggaggaguucaccaagaagguuagaacaaacgcugccaugggggccguguuuaccgaggaaaaucagugggauagcgcgaaagcugccgucgaggacgaagauuucuggaaacuuguggaccgcgagagagagcugcauaaacucggaaaguguggcuccugcguuuauaacaugauggggaaacgggaaaagaaacugggcgaguuuggaaaggccaagggcucucgcgcuaucugguacauguggcuuggggccagauaccuggaguucgaggcucucggauuucugaaugaggaucacugguucagccgggaaaacuccuauucuggcguggagggggaaggacugcauagacucggcuacauccugcgggacauuagcaaaaucccugggggcgccauguaugcggaugacacggccggaugggacacccgcauuacagaggaugaccuucacaaugaagagaagaucacccagcagauggaucccgagcacagacaacuggcuaacgccauuuuuaaacucacauaccagaauaaggucgugaaaguccagcggccgaccccuacaggcaccgugauggacaucaucucccgcaaggaucagagagggucuggacaaguuggcacguaugggcugaacacauucaccaauauggaagcucagcuuauucggcagauggagggagaaggcgugcugagcaaggccgaccucgagaacccccaucugcccgagaagaagaucacccaguggcuggagacaaaaggggucgagcgccucaagagaauggcgauuuccggcgaugacugcguggugaaaccuaucgaugaccgguuugccaacgcucugcuugcccugaaugauaugggaaagguucgcaaggacauuccgcaauggcagcccagcaaaggcuggcacgauuggcaacaggugccuuucuguucucaucacuuccacgaacucaucaugaaggacgggagaaaacuggucgugcccugccggccucaagacgagcuuauuggacgcgcuagaaucucccagggcgccggguggagccugaaggaaaccgcuugucucggaaaagccuacgcgcagauguggucucugauguauuuucaucggcgcgaucugagacucgccuccaacgcuaucugcagcgccguucccgugcacugggucccuacaucucggacgaccugguccauucaugcccaccaucaauggaugacaaccgaggacaugcugacaguguggaauagagucuggaucgaagauaaccccuggauggaggacaagaccccggugacgaccugggagaauguuccuuaccuuggcaagcgcgaagaucaguggugugggagccugauuggccucacaucccgggcuaccugggcccagaacauccccacagcgauucagcaagugagaagccugaucggaaaugaggaguuccuugacuacaugccuucuaugaaacgcuuucggaaggaggaggaaagcgagggcgcuaucugguga

SEQ ID NO: 20551 - RNA, 9873 nt, Artificial Sequence
  derived and/or modified CDS sequence (opt5) from DENV-3__HM756281__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcucggggggccagacgcauggcuauccuuggagacaccgccugggauuucggcuccguggggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacaugggguguguggucaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccaaggagcugaaauacucuuggaagaccugggggaaggccaaaauugucacagccgaaacccaaaacuccagcuucaucauugauggaccuaauacacccgagugcccgucuguguccagagcuuggaacgugugggaagucgaggacuauggcuuuggcguuuucaccacgaauaucuggcucaagcugcgcgaaguguacacacagcugugugaccaccggcuuaugagcgcggccgugaaagaugagagagcuguccacgccgacaugggguacuggaucgagucccagaagaacggaucuuggaaacucgaaaaggccagccugauugaggugaagaccugcaccuggccuaaaucccauacacuguggucuaauggcguucucgaaagcgauaugaucauucccaagucccuggcugggccuaucagccagcacaaccaucgccccggauaucacacccaaacggccggcccuuggcaccuugggaaacuggagcucgacuuuaauuacugcgagggaacaaccguggucauuacagaaaacuguggcacccggggccccucucugagaacaaccacgguguccgggaagcugauccaugaguggugcugucgcagcugcacccuuccgccucuccgguauaugggagaagauggcuguugguacgggauggagaucagacccauuucugaaaaagaggagaauaugguuaagucccuggugagcgcgggaucuggcaaggucgacaacuucacaaugggggugcugugccucgcuauccuguuugaagagguuaugcggggaaaauucggcaagaaacacaugauugccggcguguucuuuaccuucguccuucugcucagcgggcagaucacauggcgcgauauggcccauacccugauuaugaucggauccaaugcuagcgacagaaugggcaugggggugacguaucuggcccuuauugcgacauuuaagauccagcccuuccuggcucucggauuuuuccugcggaaacucaccucuagagaaaaccugcuucugggcguggggcucgccauggccacaacccugcaacugccugaggauaucgaacagauggcuaauggaauugcccuuggccugauggcucucaagcugaucacccaguuugagacauaccagcucuggacggcccugauuucccuuaccuguagcaacacaaucuucacccugacagucgcguggcgcaccgccacgcucauucuggcuggcguuucccugcuuccggugugccaaucuagcuccaugcggaagacagacuggcugcccauggccguggcugccaugggggucccuccccucccucuguuuaucuucucucucaaagauacccugaagagacgcagcuggccccuuaaugagggagugauggccguuggccugguguccauccuggcuucuagccuccugagaaacgacgucccuauggcggggccccuuguggccggaggccugcucauugcuuguuauguuaucaccgggacauccgccgaucugaccguggaaaaagccgcugacauuacaugggaggaagaggccgaacagacgggagucagccacaaccucaugaucaccguggacgaugacggcacaaugcggauuaaggaugacgagaccgagaauauccugacaguccuucugaaaaccgcgcugcucaucgugucuggcauuuuuccguacuccaucccugcuacgcugcuuguuuggcauaccuggcagaagcagacacaacgcagcggggugcugugggauguccccucuccucccgaaacccagaaagccgagcucgaagagggaguguacagaauuaagcagcagggcaucuucgggaagacacaaguuggagugggcguccagaaagaggggguguuucacaccauguggcacgugacacggggagccguucugacguauaacggcaagcgccucgaaccgaauugggcuuccgucaaaaaggaccugauuagcuacggcgggggauggagacuuucugcccaguggcaaaaaggcgaggaagugcaggugaucgcggucgagccugggaagaaccccaagaauuuccagaccaugccuggaacauuccagaccaccacaggcgaaauuggggcuaucgcccuggauuuuaaacccggaacguccggcagccccaucauuaaccgggagggcaaggugguugggcuguauggaaauggcguggucaccaaaaacgggggauacguguccggcaucgcccaaacaaaugcugagccugacgggccgacccccgaacucgaggaagagauguucaagaaacgcaaccugacaauuauggaucuucauccuggcagcggaaagaccagaaaguaucugcccgccaucguucgggaagcuauuaaacgcagacuccggacgcugauccucgccccuacaagaguggucgcggccgagauggaggaagcucugaagggccuucccauccgcuaccagaccaccgccacaaaaucugagcacaccgggcgggaaauuguggaccugaugugccaugcuacauuuaccaugagacugcucagcccuguucgcgugccgaauuauaaccugaucauuauggaugaggcccacuucacggaccccgccuccaucgcugcgcggggauacauuucuacaagagucggcaugggggaagccgcugccaucuuuaugaccgccacaccucccggaaccgcugaugccuucccucagagcaaugcgcccauccaggacgaggagcgcgacauuccggaacgguccuggaacucuggcaaugaguggaucacggauuuugcugggaagaccgugugguucgugccuagcauuaaagccggcaacgacaucgccaacugucuuagaaagaauggaaagaaagucauucaacugucccgcaagacauuugauaccgaauaccagaaaacaaagcucaacgacugggauuucguugugaccacagacaucucugagaugggcgcuaauuuuaaagccgaucgggugauugaccccagacggugccugaagcccgucauccugaccgaugggccugagcgcgugauccucgcgggacccaugccuguuacggccgcuagcgccgcucagagacggggccgcguggggagaaacccgcagaaggaaaaugaccaauauauuuucacaggacagccccuuaacaaugaugaggaccaugcccacuggaccgaagcuaaaaugcugcuggacaacaucaauaccccugagggcauuauccccgcccucuucgaaccugagcgggagaaguccgcggccauugauggggaauacagacugaaaggcgagagccgcaagacauuugucgaacuuaugcggagaggagaccugcccguguggcucgcucacaaaguugccucugagggcaucaaguauaccgaucgcaaauggugcuucgacgggcagcggaacaaucagauccuggaagagaacauggauguggagauuuggacaaaggaaggagagaagaaaaagcugagaccgcgcuggcucgacgcucggacguacuccgauccucuugcccugaaagaauuuaaggaguucgccgcuggcagaaaaagcaucgcgcuggaccucgucaccgaaauugggcgcgugcccucucaucuggcccacagaacacggaaugcucuugauaaccuggucaugcuccauaccuccgagcacggaggccgcgccuauagacacgccguggaggaacugccugagacaauggaaacccugcuccuucugggccugaugauccuccugacggggggagcuaugcuuuuucugauuagcggcaaggggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaaacagcggacaccgcaggacaaucaacuggccuacgucguuauuggaauccucacccuggcugccaucauugcggccaacgaaaugggccuucuggagacaaccaagcgcgaucucggcaugagcaaagaaccugggguggugucucccacguccuaucuggacgucgaucugcaucccgcuagcgccuggacacucuacgcuguggccaccacaguuaucaccccuaugcuuagacacaccauugagaauucuacagcuaacgugagccuggccgcgaucgccaaccaggcugucgugcugaugggacucgacaagggcuggccgauuuccaaaauggaccugggggucccccuucuggcccucggaugcuacucucaggugaauccucugacgcugaccgcugccguucuccuucugaucacacauuaugccaucauuggccccgggcugcaggcgaaggcuacccgggaggcccaaaagagaacagcugccggaaucaugaaaaacccuaccguggauggcauuaugacgaucgaccucgaucccgucauuuacgacagcaaguucgaaaaacagcugggccaggugaugcuucugguucucugugccgugcagcugcugcucaugcgcacauccugggcucuuugcgaggcccugacccuggcgaccgggccuaucacaacccucugggaaggaucuccgggcaaguuuuggaauacaacgaucgccgucagcauggcuaacauuuuccggggguccuaucuggccggagcuggccuugccuuuagcaucaugaaaucuguggggaccggaaagagaggcacaggcucccaaggggagacccugggagaaaaguggaaaaagaaacucaaucagcugagccgcaaggauuucgaccuguacaaaaaguccggcauuacagagguggaucggaccgaggcgaaagaagggcucaagagaggagagaucacgcaccaugccguuucucggggcagcgcuaagcuucagugguuugucgaacgcaacauggugauucccgaggggagagugaucgaccugggauguggccggggcgggugguccuauuacugcgccggacugaaaaaggucaccgaaguucgcggcuauacaaaagggggaccuggccacgaggagcccgugccuaugucuaccuacggguggaauauugugaagcucaugagcggaaaagaugucuucuaccugcccccggaaaagugugacacacuucugugcgauaucggcgaguccagcccuucucccaccguggaagaguccagaacaauccggguucucaagaugguggagcccuggcugaaaaacaaucaguucuguauuaagguccugaacccuuauaugcccaccgugaucgaacaccucgagcgccuucaaagaaaacauggcgggaugcugguucggaauccucugagccgcaacucuacgcacgaaauguacuggauuuccaauggaacaggcaacaucguggcuagcgucaauauggugucuagacuccugcuuaaccgguuuaccaugacccauagacgcccgacaauugagaaggacguggaucugggggccggaacgcggcacgucaacgcugaacccgagaccccuaauauggacguuaucggcgagagaaucaaacgcauuaaggaagagcacaacagcacauggcauuaugacgaugaaaaucccuacaagaccugggccuaucacggguccuacgaggugaaagcgacaggaucugccagcuccaugaucaacggcguggucaagcuccugaccaaaccuugggacgugguucccauggugacacagauggcuaugaccgauacgaccccguucggccagcaacgggucuuuagagaaaagguggacacacgcaccccucggagcaugcccgggacaagacgcguuaugggaauuaccgccgaguggcuguggcggacgcucggcagaaauaaaaagccucgccugugcacacgggaggaauucaccaagaaagugagaacaaacgcugccaugggggccgucuuuaccgaggaaaaucagugggauuccgcgaaggcugccguggaggacgaagauuucuggaaacuuguugaccgcgagagagagcugcauaagcucggaaaauguggcucuugcguguauaacaugauggggaagcgggaaaaaaagcugggcgaguuuggaaaggccaaaggcagccgcgcuaucugguacauguggcuuggggccagauaccuggaauucgaggcucucggauuucugaaugaggaucacugguucucccgggaaaacucuuauagcggcgucgagggggaaggacugcauaagcucggcuacauucugagagacaucuccaaaauccccgggggcgccauguaugcggaugacacggccggaugggacacccggauuacagaggaugaccuucacaaugaagagaagaucacccagcagauggauccugagcaccgccaacuggcuaacgccauuuuuaaacucacauaccagaauaagguggucaaggugcagagacccaccccgacaggcaccguuauggacaucauuucucggaaagaucagcgcgggagcggacaagugggcacguaugggcugaacacauucaccaauauggaagcucagcuuaucagacagauggagggagaaggcguccuguccaaggccgaccucgagaacccucaucugcccgaaaaaaagaucacccaguggcuggagacaaaagggguggagcggcucaagcgcauggcgauuagcggcgaugacugcgugguuaagcccaucgaugacagauuugccaacgcucugcuugcccugaaugauaugggaaaagugcggaaggacauuccucaauggcagccgucuaaaggcuggcacgauuggcagcagguccccuucuguucccaucacuuccacgaacucaucaugaaggacgggcgcaaacuggugguuccuugcagaccccaagacgagcuuauuggacgggcucgcaucagccagggcgccggguggucucugaaggaaaccgcuugucucggaaaggccuacgcgcagauguggucccugauguauuuucauagacgggaucugcgccucgccagcaacgcuauuugcucugccgugccuguccacugggugcccacauccagaacgaccuggagcauccaugcccaccaucaauggaugacaaccgaggacaugcugacagucuggaaucggguguggaucgaagauaacccuuggauggaggacaaaacccccguuacgaccugggagaaugugccguaccuuggcaagagagaagaucaguggugugggucccugauuggccucacaagccgcgcuaccugggcccagaacaucccuacagcgauucagcaaguccggucucugaucggaaaugaggaauuccuugacuacaugcccagcaugaaaagauuucgcaaggaggaggaauccgagggcgcuauuugguga

SEQ ID NO: 20552 - RNA, 9873 nt, Artificial Sequence
  derived and/or modified CDS sequence (opt5) from DENV-3__JF937643__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcucggggggccagacgcauggcuauccuuggagacaccgccugggauuucggcuccguggggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagaaagcugugcacgccgacaugggguacuggauugagucccagaagaacggaucuuggaaacucgaaaaggccagccugaucgaggucaagaccugcaccuggccuaaaucccauacacuguggucuaauggcgugcucgaaagcgauaugauuauccccaagucccuggcugggccuauuagccagcacaaccauagacccggauaucacacccaaacggccggcccuuggcaccuugggaaacuggagcucgacuuuaauuacugcgagggaacaaccguugugaucacagaaaacuguggcacccgcggccccucucugcggacaaccacggucuccgggaagcugauccaugaguggugcuguagaagcugcacccuuccgccucuccgcuauaugggagaagauggcuguugguacgggauggagauucggcccaucucugaaaaagaggagaauauggugaagucccugguuagcgcgggaucuggcaagguggacaacuucacaauggggguccugugccucgcuauucuguuugaagaggugaugagaggaaaauucggcaagaaacacaugaucgccggcguuuucuuuaccuucgugcuucugcucagcgggcagauuacauggcgggauauggcccauacccugaucaugauuggauccaaugcuagcgaccgcaugggcaugggggucacguaucuggcccuuaucgcgacauuuaagauccagcccuuccuggcucucggauuuuuccugagaaaacucaccucucgggaaaaccugcuucugggcguggggcucgccauggccacaacccugcaacugccugaggauauugaacagauggcuaauggaaucgcccuuggccugauggcucucaagcugauugcccaguuugagaccuaccagcucuggacagcgcugaucucccuuacguguagcaacaccauuuucacacugaccguggccuggagaacagcuacccucauccuggccggcgucucccugcuuccgguuugccaaucuagcuccaugcgcaagacggacuggcugcccauggcuguggccgccaugggggugccuccccucccucuguuuaucuucucucucaaagauacacugaagcggagaagcuggccccuuaaugagggagucauggcugugggccugguuuccauucuggcgucuagccuccugcgcaacgacgugccuauggccgggccccuugucgcuggaggccugcucaucgccuguuaugugauuaccgggaccuccgccgaucugacaguugaaaaagcugccgacaucaccugggaggaagaggcggaacagacaggagugagccacaaccucaugauugcugucgacgaugacggcacgaugagaaucaaggaugacgagaccgagaauauccugacagugcuucugaaaaccgcccugcucauugucucuggcaucuuuccguacuccauuccugccacacugcuuguguggcauaccuggcagaagcagacgcaacggagcgggguucugugggaugugcccucuccucccgaaacccagaaagcugagcucgaagagggagucuaccgcaucaagcagcagggcauuuucgggaagacacaagugggaguuggcgugcagaaagagggggucuuucacaccauguggcacgugacaagaggagccgugcugaccuauaacggcaagcggcucgaaccgaauugggcguccguuaaaaaggaccugaucagcuacggcgggggauggcgccuuucugcucaguggcaaaaaggcgaggaaguccaggugauugccguggagccugggaagaaccccaagaauuuccagacaaugccuggaacguuccagaccacaaccggcgaaaucggggccaucgcucuggauuuuaaacccggaaccuccggcagccccauuaucaacagagagggcaaggucguggggcuguauggaaauggcguugugacaaaaaacgggggauacgucuccggcauugcccaaacgaaugcugagccugacgggccgacccccgaacucgaggaagagauguucaagaaacggaaccugacaaucauggaucuucauccuggcagcggaaagacccgcaaguaucugcccgccauugugagagaagcgaucaaacggcgccucagaacacugauccucgccccuacccggguuguggcugccgagauggaggaagcucugaagggccuucccauuagauaccagacgacagccaccaaaucugagcacaccgggcgcgaaaucgucgaccugaugugccaugccacauuuaccaugcggcugcucagcccugugagaguuccgaauuauaaccugauuaucauggaugaggcucacuucacagaccccgcguccauugccgcucgcggauacaucucuacccgggugggcaugggggaagccgccgcuaucuuuaugacggccacaccucccggaaccgcggaugcuuucccucagagcaaugcccccauucaggacgaggagagagacaucccggaacgcuccuggaacucuggcaaugaguggauuacagauuuugccgggaagaccgucugguucgugccuagcaucaaagcuggcaacgacauugccaacugucuucggaagaauggaaagaaagugauccaacuguccagaaagacguuugauaccgaauaccagaaaacaaagcucaacgacugggauuucgucguuaccacagacauuucugagaugggcgcgaauuuuaaagccgaucgcgugaucgacccccggagaugccugaagcccgugauccugaccgaugggccugagcgggucauucucgcuggacccaugccugugacagccgcuagcgccgcucagcgcagaggccggguugggcgcaacccgcagaaggaaaaugaccaauauaucuucaccggacagccccuuaacaaugaugaggaccaugcccacuggacggaagcgaaaaugcugcuggacaacauuaauacaccugagggcaucauucccgcccucuucgaaccugagagagagaaguccgcugccaucgauggggaauaccggcugaaaggcgagagcagaaagaccuuuguggaacuuaugcgccggggagaccugcccgucuggcucgcucacaaaguggccucugagggcaucaaguauaccgauagaaaauggugcuucgacgggcagcgcaacaaucagauucuggaagagaacauggauguugagaucuggacaaaggaaggagagaagaaaaagcugcggccgagauggcucgacgcccgcaccuacuccgauccucuugcucugaaagaauuuaaggaguucgcggccggccggaaaagcauugcucuggaccucgugacagaaaucgggagaguccccucucaucuggcccaccgcacgagaaaugcccuugauaaccuggugaugcuccauaccuccgagcacggaggccgggcuuaucgccacgccgucgaggaacugccugagacaauggaaacccugcuccuucugggccugaugauucuccugacagggggagcgaugcuuuuucugaucagcggcaaggggaucggaaagaccuccauuggccucaucugugugauugccucuagcgggaugcuguggauggcugagaucccccugcaauggauugccuccgcuaucguucucgaguucuuuaugauggugcuucugauuccugaacccgagaaacagagaacgccgcaggacaaucaacuggccuacguggucaucggaauccucacccuggcggccguuauugcugccaacgaaaugggccuucuggagacaaccaagcgggaucucggcaugagcaaagaaccugggguggugucucccacauccuaucuggacgucgaucugcaucccgcuagcgccuggacccucuacgcuguggccacgacaguuaucaccccuaugcuucgccacacaauugagaauucuaccgcgaacgugagccuggccgcuaucgccaaccaggcugucgugcugaugggacucgacaagggcuggccgauuuccaaaauggaccugggggucccccuucuggcccucggaugcuacucucaggugaauccucugacccugacagccgcgguucuccuucugaucacgcauuaugcuaucauuggccccgggcugcaggccaaggcuaccagagaggcccaaaagcggacagccgcuggaaucaugaaaaacccuaccguggauggcauuaugacaaucgaccucgaucccgucauuuacgacagcaaguucgaaaaacagcugggccaggugaugcuucugguucucugugccgugcagcugcugcucaugagaaccuccugggcgcuuugcgaggcccugacgcuggcuacagggccuaucaccacccucugggaaggaucuccgggcaaguuuuggaauacaaccaucgccgucagcauggcuaacauuuuccgcggguccuaucuggccggagcgggccuugccuuuagcaucaugaaaucuguggggacaggaaagcggggcacgggcucccaaggggagacccugggagaaaaguggaaaaagaaacucaaucagcugagcagaaaggauuucgaccuguacaaaaaguccggcauuacagagguggaucgcaccgaggcuaaagaagggcucaagcggggagagaucacacaccaugccguuucuagaggcagcgcuaagcuucagugguuugucgaacggaacauggugauucccgaggggcgcgugaucgaccugggauguggcagaggcgggugguccuauuacugcgccggacugaaaaaggucaccgaaguucggggcuauacgaaagggggaccuggccacgaggagcccgugccuaugucuaccuacggguggaauauugugaagcucaugagcggaaaagaugucuucuaccugcccccggaaaagugugacacacuucugugcgauaucggcgaguccagcccuucucccaccguggaagagucccgcacaaucagaguucucaagaugguggagcccuggcugaaaaacaaucaguucuguauuaagguccugaacccuuauaugcccaccgugaucgaacaccucgagcggcuucaacgcaaacauggcgggaugcugguuagaaauccucugagccggaacucuacacacgaaauguacuggauuuccaauggaaccggcaacaucguggcuagcgucaauauggugucucgccuccugcuuaacagauuuacgaugacacaucggagaccgaccauugagaaggacguggaucugggggccggaacccgccacgucaacgcggaacccgagacaccuaauauggacguuaucggcgagcggaucaaaagaauuaaggaagagcacaacagcacguggcauuaugacgaugaaaaucccuacaagaccugggccuaucacggguccuacgaggugaaagcuacaggaucugccagcuccaugaucaacggcguggucaagcuccugaccaaaccuugggacgugguucccauggugacacagauggcuaugaccgauacaaccccguucggccagcaacgcgucuuuaaggaaaaaguggacacgcggaccccuagaagcaugcccgggacacgccggguuaugggaauuaccgccgaguggcuguggagaacacucggccgcaauaagaagccucggcugugcaccagagaggaauucacgaaaaaggugcgcacaaacgccgcgaugggggcugucuuuaccgaggaaaaucagugggauuccgccaaagccgcuguggaggacgaagauuucuggaagcuuguugaccgggagagagagcugcauaaacucggaaaguguggcucuugcguguauaacaugauggggaaacgcgaaaagaagcugggcgaguuuggaaaagccaagggcagcagagcuaucugguacauguggcuuggggcccgguaccuggaauucgaggcgcucggauuucugaaugaggaucacugguucucccgcgaaaacucuuauagcggcgucgagggggaaggacugcauaaacucggcuacauucugagagacaucuccaagauccccgggggcgccauguaugcugaugacacagccggaugggacacccggauuacggaggaugaccuucacaaugaagagaaaaucacccagcagauggauccugagcacagacaacuggcuaacgccauuuuuaagcucacauaccagaauaagguggucaaagugcagcggcccaccccgacaggcaccguuauggacaucauuucucgcaaggaucagagagggagcggacaagugggcacauaugggcugaacaccuucacgaauauggaagcgcagcuuauccggcagauggagggagaaggcguccuguccaaagccgaccucgagaacccucaucugcccgaaaagaaaaucacacaguggcuggagaccaaggggguggagcgccucaagagaauggcuauuagcggcgaugacugcgugguuaaacccaucgaugaccgguuugccaacgcucugcuugcccugaaugauaugggaaaggugcgcaaagacauuccucaauggcagccgucuaagggcuggcacgauuggcagcagguccccuucuguucccaucacuuccacgaacucaucaugaaagacgggagaaagcuggugguuccuugccggccccaagacgagcuuauuggacgcgcuagaaucagccagggcgccggguggucucugaaggaaaccgcgugucucggaaaagccuacgcucagauguggucccugauguauuuucaucggcgcgaucugagacucgccagcaacgccauuugcucugcugugccuguccacugggugcccacaucccggaccacauggagcauccaugcccaccaucaauggaugacgaccgacgauaugcugacagucuggaaucgcguguggaucgaggacaacccuuggauggaagauaagacccccguuacaaccugggagaaugugccguaccuuggcaaaagagaggaccaguggugugggucccugauuggccucacgagccgggcgaccugggcucagaacaucccuacagccauucagcaagucagaucucugaucggaaaugaagaguuccuugauuacaugcccagcaugaagcgcuuucggaaagaagaggaguccgaaggcgccauuugguga

SEQ ID NO: 20553 - RNA, 9873 nt, Artificial Sequence
  derived and/or modified CDS sequence (opt5) from DENV-3__HM181972__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucauguggggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggugcucggauuuuuccugcggaagcucaccucuagagaaaaccugcuucugggcguggggcucgcuauggccacaacccugcaacugccugaggauauugaacagauggccaauggaaucgcucuuggccugauggcccucaaacugauuacccaguuugagacauaccagcucuggacggcucugaucucccuuaccuguagcaacacaauuuucacccugacagucgccuggcgcaccgcgacgcucauccuggccggcguuucccugcuuccggugugccaaucuagcuccaugcggaagacagacuggcugcccauggcuguggccgcuaugggggucccuccccucccucuguuuaucuucucucucaaggauacccugaaaagacgcagcuggccccuuaaugagggagugauggccguuggccugguguccauucuggccucuagccuccugagaaacgacgucccuauggcugggccccuuguggcgggaggccugcucaucgccuguuauguuauuaccgggacauccgcugaucugaccguggaaaaggccgccgacaucacaugggaggaagaggcugaacagacgggagucagccacaaccucaugauuaccguggacgaugacggcacaaugcggaucaaagaugacgagaccgagaauauccugacaguccuucugaagaccgcccugcucauugugucuggcaucuuuccguacuccauuccugcgacgcugcuuguuuggcauaccuggcagaaacagacacaacgcagcggggugcugugggauguccccucuccucccgaaacccagaaggcugagcucgaagagggaguguacagaaucaaacagcagggcauuuucgggaagacacaaguuggagugggcguccagaaggaggggguguuucacaccauguggcacgugacacggggagccguucugacguauaacggcaaacgccucgaaccgaauugggccuccgucaagaaagaccugaucagcuacggcgggggauggagacuuucugcucaguggcaaaagggcgaggaaguccaggugauugccgucgagccugggaaaaaccccaagaauuuccagaccaugccuggaacauuccagaccaccacaggcgaaaucggggcgaucgcucuggauuuuaagcccggaacguccggcagccccauuaucaaccgggagggcaaagugguugggcuguauggaaauggcguggucaccaagaacgggggauacguguccggcauugcccaaacaaaugccgagccugacgggccgacccccgaacucgaggaagagauguucaaaaagcgcaaccugacaaucauggaucuucauccuggcagcggaaaaaccagaaaguaucugcccgcuauuguucgggaagccaucaagcgcagacuccggacgcugauccucgcuccuacaagaguggucgccgcggagauggaggaagcccugaaaggccuucccauucgcuaccagaccaccgcuacaaagucugagcacaccgggcgggaaaucguggaccugaugugccaugccacauuuaccaugagacugcucagcccuguucgcgugccgaauuauaaccugauuaucauggaugaggcucacuucacggaccccgccuccauugccgcucggggauacaucucuacaagagucggcaugggggaagcggccgcuaucuuuaugaccgccacaccucccggaaccgccgaugcuuucccucagagcaaugcccccauucaggacgaggagcgcgacaucccggaacgguccuggaacucuggcaaugaguggauuacggauuuugcggggaaaaccgugugguucgugccuagcaucaaggcuggcaacgacauugccaacugucuucgcaaaaauggaaagaaggucauccaacuguccagaaaaacauuugauaccgaauaccagaagacaaaacucaacgacugggauuucguugugaccacagacauuucugagaugggcgccaauuuuaaggcugaucgggugaucgaccccagacggugccugaaacccgucauccugaccgaugggccugagcgcgugauucucgccggacccaugccuguuacggcggccagcgcugcccagagacggggccgcguggggagaaacccgcagaaggaaaaugaccaauauaucuucacaggacagccccuuaacaaugaugaggaccaugcucacuggaccgaagccaagaugcugcuggacaacauuaauaccccugagggcaucauucccgcucucuucgaaccugagcgggagaaauccgccgcgaucgauggggaauacagacugaagggcgagagccgcaaaacauuugucgaacuuaugcggagaggagaccugcccguguggcucgcccacaagguugcuucugagggcaucaaauauaccgaucgcaaguggugcuucgacgggcagcggaacaaucagauucuggaagagaacauggauguggagaucuggacaaaagaaggagagaagaagaaacugagaccgcgcuggcucgacgcccggacguacuccgauccucuugcucugaaggaauuuaaagaguucgccgccggcagaaagagcauugcucuggaccucgucaccgaaaucgggcgcgugcccucucaucuggcgcacagaacacggaaugcccuugauaaccuggucaugcuccauaccuccgagcacggaggccgcgcuuauagacacgccguggaggaacugccugagacaauggaaacccugcuccuucugggccugaugauucuccugacagggggagccaugcuuuuucugaucagcggcaaagggaucggaaagaccuccauuggccucaucuguguuauugcuucuagcgggaugcuguggauggccgagaucccccugcaauggauugcguccgccaucgugcucgaguucuuuaugauggugcuucugauuccugaacccgagaagcagcggacaccgcaggacaaucaacuggcuuacgucguuaucggaauccucacccuggccgcuauuaucgccgcgaacgaaaugggccuucuggagacaaccaaacgcgaucucggcaugagcaaggaaccugggguggugucucccacguccuaucuggacgucgaucugcaucccgccagcgcuuggacacucuacgccguggcuaccacaguuauuaccccuaugcuuagacacaccaucgaaaauucuacagccaacgugagccuggcugccauugcgaaccaggccgucgugcugaugggacucgacaaaggcuggccgaucuccaagauggaccugggggucccccuucuggcucucggaugcuacucucaggugaauccucugacgcugaccgccgcuguucuccuucugaucacacauuaugccauuaucggccccgggcugcaggccaaagcgacccgggaggcucaaaagagaacagccgcuggaauuaugaagaacccuaccguggauggcaucaugacgauugaccucgaucccgucaucuacgacagcaaauucgaaaagcagcugggccaggugaugcuucugguucucugugccgugcagcugcugcucaugcgcacauccugggcccuuugcgaggcucugacccuggccaccgggccuaucacaacccucugggaaggaucuccgggcaaauuuuggaauacaacgauugcggucagcauggccaacaucuuccggggguccuaucuggcuggagccggccuugcuuuuagcauuaugaagucuguggggaccggaaaaagaggcacaggcucccaaggggagacccugggagaaaaguggaagaaaaagcucaaucagcugagccgcaaagauuucgaccuguacaagaaauccggcaucacagagguggaucggaccgaggccaaggaagggcucaaaagaggagagauuacgcaccaugcgguuucucggggcagcgccaaacuucagugguuugucgaacgcaacauggugauccccgaggggagagugauugaccugggauguggccggggcgggugguccuauuacugcgcuggacugaagaaagucaccgaaguucgcggcuauacaaaagggggaccuggccacgaggagcccgugccuaugucuaccuacggguggaauaucgugaaacucaugagcggaaaggaugucuucuaccugcccccggaaaaaugugacacacuucugugcgauaucggcgaguccagcccuucucccaccguggaagaguccagaacaauucggguucucaagaugguggagcccuggcugaagaacaaucaguucuguaucaaaguccugaacccuuauaugcccaccgugauugaacaccucgagcgccuucaaagaaagcauggcgggaugcugguucggaauccucugagccgcaacucuacgcacgaaauguacuggaucuccaauggaacaggcaacauuguggccagcgucaauauggugucuagacuccugcuuaaccgguuuaccaugacccauagacgcccgacaaucgagaaagacguggaucugggggcuggaacgcggcacgucaacgccgaacccgagaccccuaauauggacguuaucggcgagagaauuaagcgcaucaaagaagaacacaacagcacauggcauuaugacgaugaaaaucccuacaagaccugggcuuaucacggguccuacgaggugaaggccacaggaucugcgagcuccaugauuaacggcguggucaaacuccugaccaagccuugggacgugguucccauggugacacagauggccaugaccgauacgaccccguucggccagcaacgggucuuuaaagaaaagguggacacaagaaccccucgcagcaugcccgggacacggagaguuaugggaaucaccgcugaguggcuguggcgcacgcucggccggaauaaaaagccuagacugugcacacgcgaggaguucaccaagaaagugcggacaaacgccgcuaugggggccgucuuuaccgaggaaaaucagugggauuccgccaaggcggcuguggaggacgaagauuucuggaaacuuguugacagagagcgcgagcugcauaagcucggaaaauguggcucuugcguguauaacaugauggggaagagagagaagaagcugggcgaguuuggaaaggccaaaggcagccgggccauuugguacauguggcuuggggcucgcuaccuggaguucgaggcccucggauuucugaaugaggaucacugguucuccagagaaaacucuuauagcggcgucgagggggaaggacugcauaagcucggcuacauccugcgggacaucuccaaaauucccgggggcgcuauguaugccgaugacacggcgggaugggacaccagaaucacagaggaugaccuucacaaugaagagaagauuacccagcagauggauccugagcaccggcaacuggccaacgcuaucuuuaaacucacauaccagaauaagguggucaaggugcagcgccccaccccgacaggcaccguuauggacauuaucucuagaaaagaucagcgggggagcggacaagugggcacguaugggcugaacacauucaccaauauggaagcccagcuuauccgccagauggagggagaaggcguccuguccaaggcugaccucgagaacccucaucugcccgagaagaagauuacccaguggcuggagacaaaagggguggagagacucaagcggauggccaucagcggcgaugacugcgugguuaagcccauugaugaccgcuuugcgaacgcccugcuugcucugaaugauaugggaaaagugagaaaggacaucccucaauggcagccgucuaaaggcuggcacgauuggcagcagguccccuucuguucccaucacuuccacgaacucauuaugaaggacgggcggaaacuggugguuccuugccgcccccaagacgagcuuaucggacgggcccggauuagccagggcgcuggguggucucugaaggaaaccgccugucucggaaaggcuuacgcccagauguggucccugauguauuuucaucgcagagaucugcggcucgcgagcaacgccaucugcucugcugugccuguccacugggugcccacaucccgcacgaccuggagcauccaugcccaccaucaauggaugacaaccgaggacaugcugacagucuggaauagaguguggauugaagauaacccuuggauggaggacaaaacccccguuacgaccuggggcaaugugccguaccuugggaagcgggaggaucagugguguggcucccugaucggacucacaagcagagccaccugggcucagaacauuccuacagccauccagcaaguccgcucucugauuggcaaugaagaguuccuugacuacaugcccagcaugaaacgguuuagaaaggaagaggaguccgaaggggcgaucugguga

SEQ ID NO: 20554 - RNA, 9873 nt, Artificial Sequence
  derived and/or modified CDS sequence (opt5) from DENV-3__HM631857__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggcgagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauaccgcccauacgcugaucaugauuggauccaaugcuagcgacagaaugggcaugggggucacauaucuggcccuuaucgcgaccuuuaaaauccagcccuuccuggcucucggauuuuuccugcggaagcucacaucuagagaaaaccugcuucugggcguggggcucgccauggccaccacccugcaacugccugaggauauugaacagauggcuaauggaaucgcccuuggccugauggcucucaaacugauuacacaguuugagacguaccagcucuggaccgcccugaucucccuuacauguagcaacaccauuuucacacugaccguggcguggcgcacggccacacucauccuggcuggcgucucccugcuuccgguuugccaaucuagcuccaugcggaagaccgacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuacaggaaccagcgccgaucugacaguugaaaaggccgcugacaucacgugggaggaagaggccgaacagaccggcgugucccacaaccucaugauuacagucgacgaugacggcaccaugcggaucaaagaugacgagacagagaauauccugaccgugcuucugaagacggcgcugcucauugucagcgggaucuuuccguacucuauuccugcuacccugcuuguguggcauacauggcagaaacagacccaacgcuccggaguucugugggaugugcccagcccucccgaaacacagaaggccgagcucgaagagggcgucuacagaaucaaacagcaggggauuuucggaaagacccaagugggcguuggggugcagaaggagggagucuuucacacaauguggcacgugacgcggggcgccgugcugaccuauaacggcaaacgccucgaaccgaauugggcuucuguuaagaaagaccugaucuccuacgggggaggcuggagacuuagcgcccaguggcaaaagggggaggaaguccaggugauugcgguggagccuggcaagaaccccaagaauuuccagacaaugccuggcaccuuccagaccacaacgggggaaaucggagcuaucgcccuggauuuuaagcccggcaccucuggcucccccauuaucaaccgggaggggaaagucgugggacuguauggcaaugggguugugacaaagaacggaggcuacgucagcgggauugcccaaaccaaugcugagccugacggcccgacacccgaacucgaggaagagauguucaaaaagcgcaaccugaccaucauggaucuucauccuggauccggcaaaacgagaaaguaucugcccgccauugugcgggaagcuaucaagcgcagacuccggacacugauccucgccccuaccagaguuguggcggccgagauggaggaagcucugaaagggcuucccauucgcuaccagaccacagccaccaagagcgagcacacaggacgggaaaucgcugaccugaugugccaugccaccuuuacgaugagacugcucucuccuguccgcgugccgaauuauaaccugauuaucauggaugaggcccacuucacagaccccgcuagcauugcggcccggggcuacaucuccaccagaguugggaugggagaagcugccgccaucuuuaugacagcuaccccucccggcacggccgaugcguucccucagucuaaugcucccauucaggacgaggagcgcgacaucccggaacggagcuggaacuccgggaaugaguggauuaccgauuuugccggcaaaacagugugguucgucccuucuaucaaggccggaaacgacauugcuaacugucuucgcaaaaauggcaagaaggugauccaacugagcagaaaaaccuuugauacagaauaccagaagaccaaacucaacgacugggauuucguggucacaaccgacauuuccgagaugggggccaauuuuaaggcggaucggguuaucgaccccagacggugccugaaacccgugauccugacggauggaccugagcgcgugauucucgccggccccaugccugucacagcugccucugcugcccagagacgggggcgcgugggaagaaacccgcagaaggaaaaugaccaauauaucuucaccggccagccccuuaacaaugaugaggaccaugcucacuggaccgaagccaagaugcugcuggacaacauuaauacaccugaggggaucauucccgcccucuucgaaccugagcgggagaaaagcgccgcuaucgauggcgaauacagacugaagggagagucccgcaaaaccuuuguugaacuuaugcggagaggcgaccugcccguguggcucgcccacaaggucgcuagcgaggggaucaaauauacagaucgcaaguggugcuucgacggacagcggaacaaucagauucuggaagagaacauggauguggagaucuggacgaaagaaggcgagaagaagaaacugagaccgcgcuggcucgacgcccggaccuacucugauccucuugcccugaaggaauuuaaagaguucgcugcggggagaaaguccauugcccuggaccucguuacagaaaucggacgcgugcccagccaucuggcucacagaacccggaaugcccuugauaaccuggucaugcuccauacaucugagcacggcggccgcgccuauagacacgcuguggaggaacugccugagaccauggaaacgcugcuccuucuggggcugaugauucuccugaccggaggcgccaugcuuuuucugaucuccgggaaaggaaucggcaagacaagcauugggcucaucugugucauugcguccucuggaaugcuguggauggccgagaucccccugcaauggauugcuagcgccaucgugcucgaguucuuuaugaugguucuucugauuccugaacccgagaagcagcggaccccgcaggacaaucaacuggcuuacguggugaucggcauccucacacuggccgcggucauugccgcuaacgaaaugggccuucuggagaccacgaaacgcgaucucgggauguccaaggaaccuggaguugugagccccacaucuuaucuggacguggaucugcaucccgccuccgcuuggacccucuacgccgucgcuacaaccgugaucaccccuaugcuuagacacacaauugagaauagcacggccaacguuucucuggcggccaucgcuaaccaggccgugguccugaugggccucgacaaaggguggccgauuagcaagauggaccugggagugccccuucuggcucucggcugcuacucccaggucaauccucugacccugacagccgccgugcuccuucugaucacccauuaugcgaucauugggcccggacugcaggcuaaagccacacgggaggcucaaaagagaaccgccgccggcaucaugaagaacccuacgguugauggcauuaugacaaucgaccucgaucccgugauuuacgacucuaaauucgaaaagcagcuggggcaggucaugcuucuggugcucugugcuguucagcugcugcucaugcgcaccagcugggcccuuugcgaggcgcugacccuggccacaggaccuaucaccacacucugggaaggcuccccggggaaauuuuggaauacgaccaucgcugugucuauggccaacauuuuccggggaagcuaucuggcuggcgccgggcuugcguuuuccaucaugaaaagcgucggaacaggcaaaagaggcaccgggucucaaggagagacacugggcgaaaaguggaagaaaaagcucaaucagcugucccgcaaagauuucgaccuguacaagaaaagcgggauuaccgagguggaucggacggaggccaaggaaggacucaaaagaggcgagaucacccaccaugcugugucccgggggucugccaaacuucagugguuuguugaacgcaacauggucauucccgagggaagagugaucgaccugggcuguggcagagggggauggagcuauuacugcgcuggccugaagaaagugacagaaguccgcggguauaccaagggaggcccugggcacgaggagcccguuccuauguccacauacggauggaauauugugaaacucaugucuggcaaggauguguucuaccugcccccggaaaaaugugacacccuucugugcgauaucggcgagagcuccccuagccccacagucgaagagucuagaaccauccgggugcucaagaugguugagcccuggcugaagaacaaucaguucuguauuaaagugcugaacccuuauaugcccacggucaucgaacaccucgagcgccuucaaagaaagcaugggggaaugcuggugcggaauccucugucccgcaacagcacacacgaaauguacuggauuucuaauggcaccgggaacaucguugccuccgugaauauggucagcagacuccugcuuaaccgguuuaccaugacacauagacgcccgacgauugagaaagacguggaucugggagcuggcacccggcacgugaacgucgaacccgagacaccuaauauggacguuaucggggagagaaucaagcgcauuaaagaagaacacaacucuaccuggcauuaugacgaugaaaaucccuacaagacaugggccuaucacggaagcuacgaggugaaggcgaccggcuccgccucuagcaugaucaacggcguggucaaacuccugacaaagccuugggacgugguucccauggugacccagauggcuaugacggauaccacaccguucgggcagcaacgggucuuuaaagaaaagguggacaccagaacaccucgcuccaugcccggaacccggagaguuaugggcauuacggccgaguggcuguggcgcacacucgggcggaauaaaaagccuagacugugcacccgcgaggaguucacaaagaaagugcggaccaacgcugccaugggagccgucuuuacggaggaaaaucagugggauagcgcgaaggcugccguggaggacgaagauuucuggaaacuuguugacagagagcgcgagcugcauaagcucggcaaauguggguccugcguguauaacaugaugggcaagagagagaagaagcugggagaguuuggcaaggccaaagggucucgggcuaucugguacauguggcuuggagcccgcuaccuggaguucgaggcucucggcuuucugaaugaggaucacugguucagcagagaaaacuccuauucuggggucgagggagaaggccugcauaagcucggguacauucugcgggacaucagcaaaauccccggcggagccauguaugcggaugacaccgccggcugggacacaagaauuaccgaggaugaccuucacaaugaagagaagaucacacagcagauggauccugagcaccggcaacuggcuaacgccauuuuuaaacucaccuaccagaauaagguggucaaggugcagcgccccacaccgaccgggacgguuauggacaucauuuccagaaaagaucagcggggaucuggccaaguggggacauauggacugaacaccuucaccaauauggaagcucagcuuauccgccagauggagggcgaagggguccugagcaaggccgaccucgagaacccucaucugcccgagaaaaagaucacacaguggcuggagaccaaaggcguggagagacucaagcggauggcgauuuccggagaugacugcgugguuaagcccaucgaugaccgcuuugccaacgcucugcuugcccugaaugauaugggcaaagugagaaaggacauuccucaauggcagccgagcaaaggguggcacgauuggcagcagguccccuucuguucucaucacuuccacgaacucaucaugaaggacggacggaaacuggugguuccuugccgcccccaagacgagcuuauuggcagagcucggaucucccagggggccggauggagccugaaggaaacagcuugucucggcaaggccuacgcgcagauguggucucugauguauuuucaucgcagagaucugcggcucgccuccaacgcuauuugcagcgccgugccuguccacugggugcccacgucucgcaccacaugguccauccaugcccaccaucaauggaugaccacagaggacaugcugaccgucuggaauagaguguggaucgaagauaacccuuggauggaggacaaaacgcccguuaccacaugggagaaugugccguaccuugggaagcgggaagaucagugguguggcagccugauuggacucaccuccagagcuacaugggcccagaacaucccuaccgcgauucagcaaguccgcagccugaucggcaaugaggaguuccuugacuacaugcccucuaugaaacgguuuagaaaggaggaggaaagcgagggggcuauuugguga

SEQ ID NO: 20555 - RNA, 9873 nt, Artificial Sequence
  derived and/or modified CDS sequence (opt5) from DENV-3__HM631860__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcucggggggccagacgcauggcuauccuuggagacaccgccugggauuucggcuccguggggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacaugggguguguggucaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccaaggagcugaaauacucuuggaagaccugggggaaggccaaaauugucacagccgaaacccaaaacuccagcuucaucauugauggaccuaauacacccgagugcccgucuguguccagagcuuggaacgugugggaagucgaggacuauggcuuuggcguuuucaccacgaauaucuggcucaagcugcgcgaaguguacacacagcugugugaccaccggcuuaugagcgcggccgugaaagaugagagagcuguccacgccgacaugggguacuggaucgagucccagaagaacggaucuuggaaacucgaaaaggccagccugauugaggugaagaccugcaccuggccuaaaucccauacacuguggucuaauggcguucucgaaagcgauaugaucauucccaagucccuggcugggccuaucagccagcacaaccaucgccccggauaucacacccaaacggccggcccuuggcaccuugggaaacuggagcucgacuuuaauuacugcgagggaacaaccguggucauuacagaaaacuguggcacccggggccccucucugagaacaaccacgguguccgggaagcugauccaugaguggugcugucgcagcugcacccuuccgccucuccgguauaugggagaagauggcuguugguacgggauggagaucagacccauuucugaaaaagaggagaauaugguuaagucccuggugagcgcgggaucuggcaaggucgacaacuucacaaugggggugcugugccucgcuauccuguuugaagagguuaugcggggaaaauucggcaagaaacacaugauugccggcguguucuuuaccuucguccuucugcucagcgggcagaucacauggcgcgauauggcccauacccugauuaugaucggauccaaugcuagcgacagaaugggcaugggggugacguaucuggcccuuauugcgacauuuaagauccagcccuuccuggcucucggauuuuuccugcggaaacucaccucuagagaaaaccugcuucugggcguggggcucgccauggccacaacccugcaacugccugaggauaucgaacagauggcuaauggaauugcccuuggccugauggcucucaagcugaucacccaguuugagacauaccagcucuggacggcccugauuucccuuaccuguagcaacacauauuucacccugacagucgcguggcgcaccgccacgcucauccuggcuggcguuucccugcuuccggugugccaaucuagcuccaugcggaagacagacuggcugcccauggccguggcugccaugggggucccuccccucccucuguuuauuuucucucucaaagauacccugaagagacgcagcuggccccuuaaugagggagugauggccguuggccugguguccauccuggcuucuagccuccugagaaacgacgucccuauggcggggccccuuguggccggaggccugcucaucgcuuguuacguuauuaccgggacauccgccgaucugaccguggaaaaagccgcugacaucacaugggaggaagaggccgaacagacgggagucagccacaaccucaugauuaccguggacgaugacggcacaaugcggaucaaggaugacgagaccgagaauauucugacaguccuucugaaaaccgcgcugcucaucgugucuggcaucuuuccguacuccauuccugcuacgcugcuuguuuggcauaccuggcagaagcagacacaacgcagcggggugcugugggauguccccucuccucccgaaacccagaaagccgagcucgaagagggaguguauagaaucaagcagcagggcauuuucgggaagacacaaguuggagugggcguccagaaagaggggguguuucacaccauguggcacgugacacggggagccguucugacguacaacggcaagcgccucgaaccgaauugggcuuccgucaaaaaggaccugaucagcuauggcgggggauggagacuuucugcccaguggcaaaaaggcgaggaagugcaggugauugcggucgagccugggaagaaccccaagaauuuccagaccaugccuggaacauuccagaccaccacaggcgaaaucggggcuauugcccuggauuuuaaacccggaacguccggcagccccaucaucaaccgggagggcaaggugguugggcuguacggaaauggcguggucaccaaaaacgggggauauguguccggcauugcccaaacaaaugcugagccugacgggccgacccccgaacucgaggaagagauguucaagaaacgcaaccugacaaucauggaucuucauccuggcagcggaaagaccagaaaguaccugcccgccauuguucgggaagcuaucaaacgcagacuccggacgcugauucucgccccuacaagaguggucgcggccgagauggaggaagcucugaagggccuucccauccgcuaucagaccaccgccacaaaaucugagcacaccgggcgggaaaucguggaccugaugugccaugcuacauuuaccaugagacugcucagcccuguucgcgugccgaauuacaaccugauuaucauggaugaggcccacuucacggaccccgccuccauugcugcgcggggauacaucucuacaagagucggcaugggggaagccgcugccauuuuuaugaccgccacaccucccggaaccgcugaugccuucccucagagcaaugcgcccauccaggacgaggagcgcgacaucccggaacgguccuggaacucuggcaaugaguggauuacggauuuugcugggaagaccgugugguucgugccuagcaucaaagccggcaacgacauugccaacugucuuagaaagaauggaaagaaagucauccaacugucccgcaagacauuugauaccgaauaucagaaaacaaagcucaacgacugggauuucguugugaccacagacauuucugagaugggcgcuaauuuuaaagccgaucgggugaucgaccccagacggugccugaagcccgucauucugaccgaugggccugagcgcgugauccucgcgggacccaugccuguuacggccgcuagcgccgcucagagacggggccgcguggggagaaacccgcagaaggaaaaugaccaauacaucuucacaggacagccccuuaacaaugaugaggaccaugcccacuggaccgaagcuaaaaugcugcuggacaacauuaauaccccugagggcaucauucccgcccucuucgaaccugagcgggagaaguccgcggccaucgauggggaauauagacugaaaggcgagagccgcaagacauuugucgaacuuaugcggagaggagaccugcccguguggcucgcucacaaaguugccucugagggcauuaaguacaccgaucgcaaauggugcuucgacgggcagcggaacaaucagauccuggaagagaacauggauguggagaucuggacaaaggaaggagagaagaaaaagcugagaccgcgcuggcucgacgcucggacguauuccgauccucuugcccugaaagaauuuaaggaguucgccgcuggcagaaaaagcauugcgcuggaccucgucaccgaaaucgggcgcgugcccucucaucuggcccacagaacacggaaugcucuugauaaccuggucaugcuccauaccuccgagcacggaggccgcgccuacagacacgccguggaggaacugccugagacaauggaaacccugcuccuucugggccugaugauucuccugacggggggagcuaugcuuuuucugaucagcggcaaggggauuggaaagaccuccaucggccucaucuguguuauugccucuagcgggaugcuguggauggcggagaucccccugcaauggauugccuccgcuaucgugcucgaguucuuuaugauggugcuucugauuccugaacccgagaaacagcggacaccgcaggacaaucaacuggccuaugucguuaucggaauucucacccuggcugccaucaucgcggccaacgaaaugggccuucuggagacaaccaagcgcgaucucggcaugagcaaagaaccugggguggugucucccacguccuaccuggacgucgaucugcaucccgcuagcgccuggacacucuacgcuguggccaccacaguuauuaccccuaugcuuagacacaccaucgagaauucuacagcuaacgugagccuggccgcgauugccaaccaggcugucgugcugaugggacucgacaagggcuggccgaucuccaaaauggaccugggggucccccuucuggcccucggaugcuauucucaggugaauccucugacgcugaccgcugccguucuccuucugauuacacauuacgccaucaucggccccgggcugcaggcgaaggcuacccgggaggcccaaaagagaacagcugccggaauuaugaaaaacccuaccguggauggcaucaugacgauugaccucgaucccgucaucuaugacagcaaguucgaaaaacagcugggccaggugaugcuucugguucucugugccgugcagcugcugcucaugcgcacauccugggcucuuugcgaggcccugacccuggcgaccgggccuauuacaacccucugggaaggaucuccgggcaaguuuuggaauacaacgaucgccgucagcauggcuaacaucuuccggggguccuaccuggccggagcuggccuugccuuuagcauuaugaaaucuguggggaccggaaagagaggcacaggcucccaaggggagacccugggagaaaaguggaaaaagaaacucaaucagcugagccgcaaggauuucgaccuguauaaaaaguccggcaucacagagguggaucggaccgaggcgaaagaagggcucaagagaggagagauuacgcaccaugccguuucucggggcagcgcuaagcuucagugguuugucgaacgcaacauggugauccccgaggggagagugauugaccugggauguggccggggcgggugguccuacuauugcgccggacugaaaaaggucaccgaaguucgcggcuacacaaaagggggaccuggccacgaggagcccgugccuaugucuaccuacggguggaauaucgugaagcucaugagcggaaaagaugucuucuaucugcccccggaaaagugugacacacuucugugcgauauuggcgaguccagcccuucucccaccguggaagaguccagaacaauccggguucucaagaugguggagcccuggcugaaaaacaaucaguucuguaucaagguccugaacccuuacaugcccaccgugauugaacaccucgagcgccuucaaagaaaacauggcgggaugcugguucggaauccucugagccgcaacucuacgcacgaaauguauuggaucuccaauggaacaggcaacauuguggcuagcgucaauauggugucuagacuccugcuuaaccgguuuaccaugacccauagacgcccgacaaucgagaaggacguggaucugggggccggaacgcggcacgucaacgcugaacccgagaccccuaauauggacguuauuggcgagagaaucaaacgcaucaaggaagagcacaacagcacauggcauuacgacgaugaaaaucccuauaagaccugggccuaccacggguccuaugaggugaaagcgacaggaucugccagcuccaugauuaacggcguggucaagcuccugaccaaaccuugggacgugguucccauggugacacagauggcuaugaccgauacgaccccguucggccagcaacgggucuuuaaggaaaaaguggacacaagaaccccucgcagcaugcccgggacacggagaguuaugggaaucaccgccgaguggcuguggcgcacgcucggccggaauaagaagccuagacugugcacacgcgaggaauucaccaaaaaggugcggacaaacgcugccaugggggccgucuuuaccgaggaaaaucagugggauuccgcgaaagcugccguggaggacgaagauuucuggaagcuuguugacagagagcgcgagcugcauaaacucggaaaguguggcucuugcguguacaacaugauggggaaaagagaaaagaagcugggcgaguuuggaaaagccaagggcagccgggcuauuugguacauguggcuuggggcccgcuaucuggaauucgaggcucucggauuucugaaugaggaucacugguucuccagagaaaacucuuacagcggcgucgagggggaaggacugcauaaacucggcuauauccugcgggacauuuccaagauccccgggggcgccauguacgcggaugacacggccggaugggacaccagaaucacagaggaugaccuucacaaugaagagaaaauuacccagcagauggauccugagcaccggcaacuggcuaacgccaucuuuaagcucacauaucagaauaagguggucaaagugcagcgccccaccccgacaggcaccguuauggacauuaucucuagaaaggaucagcgggggagcggacaagugggcacguacgggcugaacacauucaccaauauggaagcucagcuuauucgccagauggagggagaaggcguccuguccaaagccgaccucgagaacccucaucugcccgaaaagaaaaucacccaguggcuggagacaaaggggguggagagacucaagcggauggcgaucagcggcgaugacugcgugguuaaacccauugaugaccgcuuugccaacgcucugcuugcccugaaugauaugggaaaggugagaaaagacaucccucaauggcagccgucuaagggcuggcacgauuggcagcagguccccuucuguucccaucacuuccacgaacucauuaugaaagacgggcggaagcuggugguuccuugccgcccccaagacgagcuuaucggaagagcucggauuagccagggcgccggguggucucugaaggaaaccgcuugucucggaaaagccuaugcgcagauguggucccugauguacuuucaucgcagagaucugcggcucgccagcaacgcuaucugcucugccgugccuguccacugggugcccacaucccgcacgaccuggagcauucaugcccaccaucaauggaugacaaccgaggacaugcugacagucuggaauagaguguggaucgaagauaacccuuggauggaggacaagacccccguuacgaccugggagaaugugccguaccuuggcaaacgggaagaucaguggugugggucccugaucggccucacaagcagagcuaccugggcccagaacauuccuacagcgauccagcaaguccgcucucugauuggaaaugaggaauuccuugacuauaugcccagcaugaagcgguuuagaaaagaggaggaauccgagggcgcuaucugguga

SEQ ID NO: 20556 - RNA, 9873 nt, Artificial Sequence
  derived and/or modified CDS sequence (opt5) from DENV-3__HM181977__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcucggggggccagacgcauggcuauccuuggagacaccgccugggauuucggcuccguggggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacaugggguguguggucaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccaaggagcugaaauacucuuggaagaccugggggaaggccaaaauugucacagccgaaacccaaaacuccagcuucaucauugauggaccuaauacacccgagugcccgucuguguccagagcuuggaacgugugggaagucgaggacuauggcuuuggcguuuucaccacgaauaucuggcucaagcugcgcgaaguguacacacagcugugugaccaccggcuuaugagcgcggccgugaaagaugagagagcuguccacgccgacaugggguacuggaucgagucccagaagaacggaucuuggaaacucgaaaaggccagccugauugaggugaagaccugcaccuggccuaaaucccauacacuguggucuaauggcguucucgaaagcgauaugaucauucccaagucccuggcugggccuaucagccagcacaaccaucgccccggauaucacacccaaacggccggcccuuggcaccuugggaaacuggagcucgacuuuaauuacugcgagggaacaaccguggucauuacagaaaacuguggcacccggggccccucucugagaacaaccacgguguccgggaagcugauccaugaguggugcugucgcagcugcacccuuccgccucuccgguauaugggagaagauggcuguugguacgggauggagaucagacccauuucugaaaaagaggagaauaugguuaagucccuggugagcgcgggaucuggcaaggucgacaacuucacaaugggggugcugugccucgcuauccuguuugaagagguuaugcggggaaaauucggcaagaaacacaugauugccggcguguucuuuaccuucguccuucugcucagcgggcagaucacauggcgcgauauggcccauacccugauuaugaucggauccaaugcuagcgacagaaugggcaugggggugacguaucuggcccuuauugcgacauuuaagauccagcccuuccuggcucucggauuuuuccugcggaaacucaccucuagagaaaaccugcuucugggcguggggcucgccauggccacaacccugcaacugccugaggauaucgaacagauggcuaauggaauugcccuuggccugauggcucucaagcugaucacccaguuugagacauaccagcucuggacggcccugauuucccuuaccuguagcaacacaaucuucacccugacagucgcguggcgcaccgccacgcucauucuggcuggcguuucccugcuuccggugugccaaucuagcuccaugcggaagacagacuggcugcccauggccguggcugccaugggggucccuccccucccucuguuuaucuucucucucaaagauacccugaagagacgcagcuggccccuuaaugagggagugauggccguuggccugguguccauccuggcuucuagccuccugagaaacgacgucccuauggcggggccccuuguggccggaggccugcucauugcuuguuauguuaucaccgggacauccgccgaucugaccguggaaaaagccgcugacauuacaugggaggaagaggccgaacagacgggagucagccacaaccucaugaucaccguggacgaugacggcacaaugcggauuaaggaugacgagaccgagaauauccugacaguccuucugaaaaccgcgcugcucaucgugucuggcauuuuuccguacuccaucccugcuacgcugcuuguuuggcauaccuggcagaagcagacacaacgcagcggggugcugugggauguccccucuccucccgaaacccagaaagccgagcucgaagagggaguguacagaauuaagcagcagggcaucuucgggaagacacaaguuggagugggcguccagaaagaggggguguuucacaccauguggcacgugacacggggagccguucugacguauaacggcaagcgccucgaaccgaauugggcuuccgucaaaaaggaccugauuagcuacggcgggggauggagacuuucugcccaguggcaaaaaggcgaggaagugcaggugaucgcggucgagccugggaagaaccccaagaauuuccagaccaugccuggaacauuccagaccaccacaggcgaaauuggggcuaucgcccuggauuuuaaacccggaacguccggcagccccaucauuaaccgggagggcaaggugguugggcuguauggaaauggcguggucaccaaaaacgggggauacguguccggcaucgcccaaacaaaugcugagccugacgggccgacccccgaacucgaggaagagauguucaagaaacgcaaccugacaauuauggaucuucauccuggcagcggaaagaccagaaaguaucugcccgccaucguucgggaagcuauuaaacgcagacuccggacgcugauccucgccccuacaagaguggucgcggccgagauggaggaagcucugaagggccuucccauccgcuaccagaccaccgccacaaaaucugagcacaccgggcgggaaauuguggaccugaugugccaugcuacauuuaccaugagacugcucagcccuguucgcgugccgaauuauaaccugaucauuauggaugaggcccacuucacggaccccgccuccaucgcugcgcggggauacauuucuacaagagucggcaugggggaagccgcugccaucuuuaugaccgccacaccucccggaaccgcugaugccuucccucagagcaaugcgcccauccaggacgaggagcgcgacauuccggaacgguccuggaacucuggcaaugaguggaucacggauuuugcugggaagaccgugugguucgugccuagcauuaaagccggcaacgacaucgccaacugucuuagaaagaauggaaagaaagucauucaacugucccgcaagacauuugauaccgaauaccagaaaacaaagcucaacgacugggauuucguugugaccacagacaucucugagaugggcgcuaauuuuaaagccgaucgggugauugaccccagacggugccugaagcccgucauccugaccgaugggccugagcgcgugauccucgcgggacccaugccuguuacggccgcuagcgccgcucagagacggggccgcguggggagaaacccgcagaaggaaaaugaccaauauauuuucacaggacagccccuuaacaaugaugaggaccaugcccacuggaccgaagcuaaaaugcugcuggacaacaucaauaccccugagggcauuauccccgcccucuucgaaccugagcgggagaaguccgcggccauugauggggaauacagacugaaaggcgagagccgcaagacauuugucgaacuuaugcggagaggagaccugcccguguggcucgcucacaaaguugccucugagggcaucaaguauaccgaucgcaaauggugcuucgacgggcagcggaacaaucagauccuggaagagaacauggauguggagauuuggacaaaggaaggagagaagaaaaagcugagaccgcgcuggcucgacgcucggacguacuccgauccucuugcccugaaagaauuuaaggaguucgccgcuggcagaaaaagcaucgcgcuggaccucgucaccgaaauugggcgcgugcccucucaucuggcccacagaacacggaaugcucuugauaaccuggucaugcuccauaccuccgagcacggaggccgcgccuauagacacgccguggaggaacugccugagacaauggaaacccugcuccuucugggccugaugauccuccugacggggggagcuaugcuuuuucugauuagcggcaaggggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaaacagcggacaccgcaggacaaucaacuggccuacgucguuauuggaauccucacccuggcugccaucauugcggccaacgaaaugggccuucuggagacaaccaagcgcgaucucggcaugagcaaagaaccugggguggugucucccacguccuaucuggacgucgaucugcaucccgcuagcgccuggacacucuacgcuguggccaccacaguuaucaccccuaugcuuagacacaccauugagaauucuacagcuaacgugagccuggccgcgaucgccaaccaggcugucgugcugaugggacucgacaagggcuggccgauuuccaaaauggaccugggggucccccuucuggcccucggaugcuacucucaggugaauccucugacgcugaccgcugccguucuccuucugaucacacauuaugccaucauuggccccgggcugcaggcgaaggcuacccgggaggcccaaaagagaacagcugccggaaucaugaaaaacccuaccguggauggcauuaugacgaucgaccucgaucccgucauuuacgacagcaaguucgaaaaacagcugggccaggugaugcuucugguucucugugccgugcagcugcugcucaugcgcacauccugggcucuuugcgaggcccugacccuggcgaccgggccuaucacaacccucugggaaggaucuccgggcaaguuuuggaauacaacgaucgccgucagcauggcuaacauuuuccggggguccuaucuggccggagcuggccuugccuuuagcaucaugaaaucuguggggaccggaaagagaggcacaggcucccaaggggagacccugggagaaaaguggaaaaagaaacucaaucagcugagccgcaaggauuucgaccuguacaaaaaguccggcauuacagagguggaucggaccgaggcgaaagaagggcucaagagaggagagaucacgcaccaugccguuucucggggcagcgcuaagcuucagugguuugucgaacgcaacauggugauucccgaggggagagugaucgaccugggauguggccggggcgggugguccuauuacugcgccggacugaaaaaggucaccgaaguucgcggcuauacaaaagggggaccuggccacgaggagcccgugccuaugucuaccuacggguggaauauugugaagcucaugagcggaaaagaugucuucuaccugcccccggaaaagugugacacacuucugugcgauaucggcgaguccagcccuucucccaccguggaagaguccagaacaauccggguucucaagaugguggagcccuggcugaaaaacaaucaguucuguauuaagguccugaacccuuauaugcccaccgugaucgaacaccucgagcgccuucaaagaaaacauggcgggaugcugguucggaauccucugagccgcaacucuacgcacgaaauguacuggauuuccaauggaacaggcaacaucguggcuagcgucaauauggugucuagacuccugcuuaaccgguuuaccaugacccauagacgcccgacaauugagaaggacguggaucugggggccggaacgcggcacgucaacgcugaacccgagaccccuaauauggacguuaucggcgagagaaucaaacgcauuaaggaagagcacaacagcacauggcauuaugacgaugaaaaucccuacaagaccugggccuaucacggguccuacgaggugaaagcgacaggaucugccagcuccaugaucaacggcguggucaagcuccugaccaaaccuugggacgugguucccauggugacacagauggcuaugaccgauacgaccccguucggccagcaacgggucuuuaaggaaaaaguggacacaagaaccccucgcagcaugcccgggacacggagaguuaugggaauuaccgccgaguggcuguggcgcacgcucggccggaauaagaagccuagacugugcacacgcgaggaauucaccaaaaaggugcggacaaacgcugccaugggggccgucuuuaccgaggaaaaucagugggauuccgcgaaagcugccguggaggacgaagauuucuggaagcuuguugacagagagcgcgagcugcauaaacucggaaaguguggcucuugcguguauaacaugauggggaaaagagaaaagaagcugggcgaguuuggaaaagccaagggcagccgggcuaucugguacauguggcuuggggcccgcuaccuggaauucgaggcucucggauuucugaaugaggaucacugguucuccagagaaaacucuuauagcggcgucgagggggaaggacugcauaaacucggcuacauucugcgggacaucuccaagauccccgggggcgccauguaugcggaugacacggccggaugggacaccagaauuacagaggaugaccuucacaaugaagagaaaaucacccagcagauggauccugagcaccggcaacuggcuaacgccauuuuuaagcucacauaccagaauaagguggucaaagugcagcgccccaccccgacaggcaccguuauggacaucauuucuagaaaggaucagcgggggagcggacaagugggcacguaugggcugaacacauucaccaauauggaagcucagcuuauccgccagauggagggagaaggcguccuguccaaagccgaccucgagaacccucaucugcccgaaaagaaaaucacccaguggcuggagacaaaggggguggagagacucaagcggauggcgauuagcggcgaugacugcgugguuaaacccaucgaugaccgcuuugccaacgcucugcuugcccugaaugauaugggaaaggugagaaaagacauuccucaauggcagccgucuaagggcuggcacgauuggcagcagguccccuucuguucccaucacuuccacgaacucaucaugaaagacgggcggaagcuggugguuccuugccgcccccaagacgagcuuauuggaagagcucggaucagccagggcgccggguggucucugaaggaaaccgcuugucucggaaaagccuacgcgcagauguggucccugauguauuuucaucgcagagaucugcggcucgccagcaacgcuauuugcucugccgugccuguccacugggugcccacaucccgcacgaccuggagcauccaugcccaccaucaauggaugacaaccgaggacaugcugacagucuggaauagaguguggaucgaagauaacccuuggauggaggacaagacccccguuacgaccugggagaaugugccguaccuuggcaaacgggaagaucaguggugugggucccugauuggccucacaagcagagcuaccugggcccagaacaucccuacagcgauucagcaaguccgcucucugaucggaaaugaggaauuccuugacuacaugcccagcaugaagcgguuuagaaaagaggaggaauccgagggcgcuauuugguga

SEQ ID NO: 20557 - RNA, 9873 nt, Artificial Sequence
  derived and/or modified CDS sequence (opt5) from DENV-3__HM181978__SS-prME
accagccugugccucaugaugauccugcccgccgcucuugccuuccaccugacaucccgggacggagaaccucggaugauuguggggaagaaugaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccagcgcuucugacagaaugggcaugggggucacguaucuggcccuuaucgcgacauuuaaaauccagcccuuccuggcucucggauuuuuccugcggaagcucaccuccagagaaaaucugcuucugggcguggggcucgccauggccacaacccugcaacugccugaggauauugaacagauggcuaacggaaucgcccuuggccugauggcucucaaacugauuacccaguuugagacauaccagcucuggacggcccugaucagccuuaccuguuccaauacaauuuucacccugacaguggcguggcgcaccgccacgcucauccuggcuggcgucucucugcuuccgguuugccaaagcuccucuaugcggaagacagacuggcugcccauggccguggcugccaugggggugccuccccucccucuguuuaucuucggacucaaggauacccugaaaagacgcagcuggccccuuaacgagggcgucauggccguggggcugguuuccauucuggcuucuagccuccugagaaaugacgugccuauggcgggaccccuugucgccggcgggcugcucaucgcuuguuaugugauuaccggaacauccgccgaucugaccguugaaaaggccgcugacaucacaugggaggaagaggccgaacagacgggcgugagccacaaccucaugauuaccgucgacgaugacggcacaaugcggaucaaagaugacgagaccgagaacauccugacagugcuucugaagaccgcgcugcucauugucucugggaucuuuccguacuccauuccugcuacgcugcuuguguggcauaccuggcagaaacagacacaacgcagcggaguucugugggaugugcccucuccucccgaaacccagaaggccgagcucgaagagggcgucuacagaaucaaacagcaggggauuuucggaaagacacaagugggcguuggggugcagaaggagggagucuuucacaccauguggcacgugacacggggcgccgugcugacguauaauggcaaacgccucgaaccgaacugggcuuccguuaagaaagaccugaucagcuacgggggaggcuggagacuuucugcccaguggcaaaagggggaggaaguccaggugauugcgguggagccuggcaagaaucccaagaacuuccagaccaugccuggcacauuccagaccaccacaggggaaaucggagcuaucgcccuggauuuuaagcccggcacguccggcagccccauuaucaaucgggaggggaaagucgugggacuguauggcaacgggguugugaccaagaauggaggcuacgucuccgggauugcccaaacaaacgcugagccugacggcccgacccccgaacucgaggaagagauguucaaaaagcgcaaucugacaaucauggaucuucauccuggaagcggcaaaaccagaaaguaucugcccgccauugugcgggaagcuaucaagcgcagacuccggacgcugauccucgccccuacaagaguuguggcggccgagauggaggaagcucugaaagggcuucccauucgcuaccagaccaccgccacaaagucugagcacaccggacgggaaaucgucgaccugaugugccaugcuacauuuaccaugagacugcucagcccugugcgcguuccgaacuauaaucugauuaucauggaugaggcccacuucacggaccccgccuccauugcugcgcggggcuacaucucuacaagaguggggaugggagaagccgcugccaucuuuaugaccgccacaccucccggcaccgcugaugccuucccucagagcaacgcgcccauucaggacgaggagcgcgacaucccggaacgguccuggaacucugggaacgaguggauuacggauuuugcuggcaaaaccgucugguucgugccuagcaucaaggccggaaaugacauugccaacugucuucgcaaaaacggcaagaaggugauccaacuguccagaaaaacauuugauaccgaauaccagaagacaaaacucaaugacugggauuucgucguuaccacagacauuucugagaugggggcuaacuuuaaggccgaucgggugaucgaccccagacggugccugaaacccgugauccugaccgauggaccugagcgcgucauucucgcgggccccaugccugugacggccgcuagcgccgcucagagacgggggcgcguuggaagaaauccgcagaaggaaaacgaccaauauaucuucacaggccagccccuuaauaacgaugaggaccaugcccacuggaccgaagcuaagaugcugcuggacaauauuaacaccccugaggggaucauucccgcccucuucgaaccugagcgggagaaauccgcggccaucgauggcgaauacagacugaagggagagagccgcaaaacauuuguggaacuuaugcggagaggcgaccugcccgucuggcucgcucacaagguggccucugaggggaucaaauauaccgaucgcaaguggugcuucgacggacagcggaauaaccagauucuggaagagaauauggauguugagaucuggacaaaagaaggcgagaagaagaaacugagaccgcgcuggcucgacgcucggacguacuccgauccucuugcccugaaggaauuuaaagaguucgccgcugggagaaagagcauugcgcuggaccucgugaccgaaaucggacgcguccccucucaucuggcccacagaacacggaacgcucuugauaaucuggugaugcuccauaccuccgagcacggcggccgcgccuauagacacgccgucgaggaacugccugagacaauggaaacccugcuccuucuggggcugaugauucuccugacgggaggcgcuaugcuuuuucugaucagcgggaaaggaaucggcaagaccuccauugggcucaucugugugauugccucuagcggaaugcuguggauggcggagaucccccugcaauggauugccuccgcuaucguucucgaguucuuuaugauggugcuucugauuccugaacccgagaagcagcggacaccgcaggacaaccaacuggccuacguggucaucggcauccucacccuggcugccauuaucgcggccaaugaaaugggccuucuggagacaaccaaacgcgaucucgggaugagcaaggaaccuggaguugugucucccacguccuaucuggacguggaucugcaucccgcuagcgccuggacacucuacgcugucgccaccacagugauuaccccuaugcuuagacacaccaucgagaacucuacagcuaauguuagccuggccgcgauugccaaccaggcugugguccugaugggccucgacaaaggguggccgaucuccaagauggaccugggagugccccuucuggcccucggcugcuacucucaggucaacccucugacgcugaccgcugccgugcuccuucugaucacacauuaugccauuaucgggcccggacugcaggcgaaagcuacccgggaggcccaaaagagaacagcugccggcauuaugaagaauccuaccguugauggcaucaugacgauugaccucgaucccgugaucuacgacagcaaauucgaaaagcagcuggggcaggucaugcuucuggugcucugugccguucagcugcugcucaugcgcacauccugggcucuuugcgaggcccugacccuggcgaccggaccuaucacaacccucugggaaggcucuccggggaaauuuuggaacacaacgauugccgugagcauggcuaauaucuuccggggauccuaucuggccggcgcugggcuugccuuuagcauuaugaagucugucggaaccggcaaaagaggcacagggucccaaggagagacccugggcgaaaaguggaagaaaaagcucaaccagcugagccgcaaagauuucgaccuguacaagaaauccgggaucacagagguggaucggaccgaggcgaaggaaggacucaaaagaggcgagauuacgcaccaugccgugucucgggggagcgcuaaacuucagugguuuguugaacgcaauauggucauccccgagggaagagugauugaccugggcuguggcagagggggaugguccuauuacugcgccggccugaagaaagugaccgaaguccgcggguauacaaagggaggcccugggcacgaggagcccguuccuaugucuaccuacggauggaacaucgugaaacucaugagcggcaaggauguguucuaccugcccccggaaaaaugugacacacuucugugcgauaucggcgaguccagcccuucucccaccgucgaagaguccagaacaauucgggugcucaagaugguugagcccuggcugaagaauaaccaguucuguaucaaagugcugaauccuuauaugcccaccgucauugaacaccucgagcgccuucaaagaaagcaugggggaaugcuggugcggaacccucugagccgcaauucuacgcacgaaauguacuggaucuccaacggcacagggaauauuguugcuagcgugaacauggucucuagacuccugcuuaaucgguuuaccaugacccauagacgcccgacaaucgagaaagacguggaucugggagccggcacgcggcacgugaacgcugaacccgagaccccuaacauggacgucaucggggagagaauuaagcgcaucaaagaagaacacaauagcacauggcauuaugacgaugaaaaccccuacaagaccugggccuaucacggauccuacgagguuaaggcgacaggcucugccagcuccaugauuaauggcguggugaaacuccugaccaagccuugggacgucgugcccaugguuacacagauggcuaugaccgauacgaccccguucgggcagcaacggguguuuaaagaaaaggucgacacaagaaccccucgcagcaugcccggaacacggagagugaugggcaucaccgccgaguggcuguggcgcacgcucgggcggaacaaaaagccuagacugugcacacgcgaggaguucaccaagaaaguucggacaaaugcugccaugggagccguguuuaccgaggaaaaccagugggauuccgcgaaggcugccgucgaggacgaagauuucuggaaacuuguggacagagagcgcgagcugcauaagcucggcaaaugugggucuugcguuuauaauaugaugggcaagagagagaaaaagcugggagaguuuggcaaggccaaagggagccgggcuauuugguacauguggcuuggagcccgcuaccuggaguucgaggcucucggcuuucugaacgaggaucacugguucuccagagaaaauucuuauagcgggguggagggagaaggccugcauaagcucggguacauccugcgggacaucuccaaaauucccggcggagccauguaugcggaugacacggccggcugggacaccagaaucacagaggaugaccuucacaacgaagagaagauuacccagcagauggauccugagcaccggcaacuggcuaaugccaucuuuaaacucacauaccagaacaaggucgugaagguccagcgccccaccccgacagggaccgugauggacauuaucucuagaaaagaucagcggggaagcggccaaguugggacguauggacugaauacauucaccaacauggaagcucagcuuauccgccagauggagggcgaaggggugcuguccaaggccgaccucgagaauccucaucugcccgagaaaaagauuacccaguggcuggagacaaaaggcgucgagagacucaagcggauggcgaucagcggagaugacugcguggugaagcccauugaugaccgcuuugccaacgcucugcuugcccugaacgauaugggcaaaguuagaaaggacaucccucaauggcagccgucuaaaggguggcacgauuggcaacaggugcccuucuguucccaucacuuccacgaacucauuaugaaggacggacggaaacuggucgugccuugccgcccccaagacgagcuuaucggcagagcucggauuagccagggggccggauggucucugaaggaaaccgcuugucucggcaaggccuacgcgcagauguggucccugauguauuuucaucgcagagaucugcggcucgccagcaaugcuaucugcucugccguuccugugcacuggguccccacaucccgcacgaccuggagcauccaugcccaccaucaauggaugacaaccgaggacaugcugacaguguggaacagagucuggauugaagauaauccuuggauggaggacaaaacccccgugacgaccugggagaacguuccguaccuugggaagcgggaagaucagugguguggcucccugaucggacucacaagcagagcuaccugggcccagaauauuccuacagcgauccagcaagugcgcucucugauuggcaacgaggaguuccuugacuacaugcccagcaugaaacgguuuagaaaggaggaggaauccgagggggcuaucugguga

SEQ ID NO: 20558 - RNA, 9873 nt, Artificial Sequence
  derived and/or modified CDS sequence (opt5) from DENV-3__JN183884__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugaaaaugaagaacaaagccuggauggugcauagacagugguuuuucgaucucccccugccguggacaagcggcgccaccacagaaaccccuacguggaaucggaaggagcuucuggucacauuuaaaaacgcucacgcgaagaagcaagaaguggucgugcucgggucucaggagggagccaugcacaccgcucugacaggcgccaccgaaauccagaauuccgggggcaccagcauuuucgccggacaucugaaaugucgccucaagauggacaaacuggagcuuaagggcaugucuuacgcuaugugcacaaacacguuuguucugaaaaaggagguguccgaaacccagcacgggacaauccucaucaaggucgaguacaaaggagaagaugugcccuguaagauuccuuucagcaccgaggacggccaagggaaagcccauaacggaagacugaucacagcgaaucccguugugaccaagaaagaggaacccgucaacauugaggcugaaccuccguucggcgaguccaauaucgugauugggaucggcgauaacgcccugaagaucaauugguauaagaaaggaucuagcauuggcaagauguuugaagccacggcucggggggccagacgcauggcuauccuuggagacacagccugggauuucggcuccguggggggaguucucaacagccugggcaaaaugguccaccagauuuuugggucugcguacaccgcccuguucuccggcgugagcugggugaugaagaucggaauuggcguccuccugaccuggaucgggcuuaauucuaaaaacacaagcauguccuuuucuugcauugcuaucggaaucauuacccuguaucucggcgccgugguucaggcugacauggggugugugaucaauuggaagggaaaggagcugaaaugcggcagcgggauuuucgucacaaacgaggugcauacguggaccgaacaguacaaguuucaagccgauucccccaaacggcuggcgacagccaucgcuggcgccugggagaauggaguuuguggcauuagaagcaccacacgcauggaaaaccuucucuggaagcagaucgcuaaugagcugaacuauauccugugggaaaauaacauuaaacucaccguggucgugggggacaucauuggaguucuggagcagggcaagcggacgcuuaccccucagcccauggagcugaaauacucuuggaagacaugggggaaggccaaaaucgugaccgccgaaacacaaaacuccagcuucauuaucgauggaccuaauacccccgagugcccgucugucuccagagcuuggaacgugugggaaguggaggacuauggcuuuggcgucuucacaaccaauaucuggcucaagcugcgcgaaguuuacacgcagcugugugaccaccggcuuaugagcgcggccgugaaagaugagagagcugugcacgccgacaugggguacuggauugagucccagaagaacggaucuuggaaacucgaaaaggccagccugaucgaggucaagacaugcaccuggccuaaaucccauacccuguggucuaauggcgugcucgaaagcgauaugauuauccccaagucccuggcugggccuauuagccagcacaaccaucgccccggauaucacacacaaaccgccggcccuuggcaccuugggaaacuggagcucgacuuuaauuacugcgagggaacgacaguugugaucaccgaaaacuguggcacacggggccccucucugagaaccacaaccgucuccgggaagcugauccaugaguggugcugucgcagcugcacgcuuccgccucuccgguauaugggagaagauggcuguugguacgggauggagauuagacccaucucugaaaaagaggagaauauggugaagucccugguuagcgcgggaucuggcaagguggacaacuucaccauggggguccugugccucgcuauucuguuugaagaggugaugcggggaaaauucggcaagaaacacaugaucgccggcguuuucuuuacauucgugcuucugcucagcgggcagauuaccuggcgcgauauggcccauacacugaucaugauuggauccaaugcuagcgacagaaugggcaugggggucaccuaucuggcccuuaucgcgacguuuaagauccagcccuuccuggcucucggauuuuuccugcggaaacucacaucuagagaaaaccugcuucugggcguggggcucgccauggccaccacacugcaacugccugaggauauugaacagauggcuaauggaaucgcccuuggccugauggcucucaagcugauuacccaguuugagaccuaccagcucuggacagcccugaucucccuuacguguagcaacaccauuuucacacugaccguggcguggcgcacagccacccucauccuggcuggcgucucccugcuuccgguuugccaaucuagcuccaugcggaagacggacuggcugcccauggccguggcugccaugggggugccuccccucccucuguuuaucuucggacucaaagauacacugaagagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaaccagcgccgaucugacaguugaaaaagccgcugacaucaccugggaggaagaggccgaacagacaggcgugucccacaaccucaugauuacggucgacgaugacggcaccaugcggaucaaggaugacgagacagagaauauccugaccgugcuucugaaaacagcgcugcucauugucagcgggaucuuuccguacucuauuccugcuacccugcuuguguggcauacguggcagaagcagacccaacgcuccggaguucugugggaugugcccagcccucccgaaacacagaaagccgagcucgaagagggcgucuacagaaucaagcagcaggggauuuucggaaagacccaagugggcguuggggugcagaaagagggagucuuucacacaauguggcacgugacccggggcgccgugcugacauauaacggcaagcgccucgaaccgaauugggcuucuguuaaaaaggaccugaucuccuacgggggaggcuggagacuuagcgcccaguggcaaaaaggggaggaaguccaggugauugcgguggagccuggaaagaaccccaagaauuuccagacgaugccuggcaccuuccagacaaccaccggggaaaucggagcuaucgcccuggauuuuaaacccggcacaucuggcucccccauuaucaaccgggaggggaaggucgugggacuguauggcaaugggguugugacgaaaaacggaggcuacgucagcgggauugcccaaaccaaugcugagccugacggcccgacacccgaacucgaggaagagauguucaagaaacgcaaccugaccaucauggaucuucauccuggauccggcaagacaagaaaguaucugcccgccauugugcgggaagcuaucaaacgcagacuccggacccugauccucgccccuacgagaguuguggcggccgagauggaggaagcucugaaggggcuucccauucgcuaccagacaaccgccaccaaaagcgagcacacaggacgggaaaucgucgaccugaugugccaugcuaccuuuacaaugagacugcucucuccugugcgcguuccgaauuauaaccugauuaucauggaugaggcccacuucaccgaccccgccagcauugcugcgcggggcuacaucuccacgagaguggggaugggagaagccgcugccaucuuuaugacagccaccccucccggcacagcugaugccuucccucagucuaaugcgcccauucaggacgaggagcgcgacaucccggaacggagcuggaacuccgggaaugaguggauuaccgauuuugcuggcaagacggucugguucgugccuucuaucaaagccggaaacgacauugccaacugucuuagaaagaauggcaagaaagugauccaacugagccgcaagaccuuugauacagaauaccagaaaaccaagcucaacgacugggauuucgucguuacaaccgacauuuccgagaugggggcuaauuuuaaagccgaucgggugaucgaccccagacggugccugaagcccgugauccugacagauggaccugagcgcgucauucucgcgggccccaugccugugaccgccgcuucugccgcucagagacgggggcgcguuggaagaaacccgcagaaggaaaaugaccaauauaucuucacgggccagccccuuaacaaugaugaggaccaugcccacuggacagaagcuaaaaugcugcuggacaacauuaauaccccugaggggaucauucccgcccucuucgaaccugagcgggagaagagcgcggccaucgauggcgaauacagacugaaaggagagucccgcaagaccuuuguggaacuuaugcggagaggcgaccugcccgucuggcucgcucacaaaguggccagcgaggggaucaaguauacagaucgcaaauggugcuucgacggacagcggaacaaucagauucuggaagagaacauggauguugagaucuggaccaaggaaggcgagaagaaaaagcugagaccgcgcuggcucgacgcucggacauacucugauccucuugcccugaaagaauuuaaggaguucgccgcugggagaaaauccauugcgcuggaccucgugacggaaaucggacgcguccccagccaucuggcccacagaacccggaaugcucuugauaaccuggugaugcuccauacaucugagcacggcggccgcgccuauagacacgccgucgaggaacugccugagaccauggaaacacugcuccuucuggggcugaugauucuccugaccggaggcgcuaugcuuuuucugaucuccgggaagggaaucggcaagacgagcauugggcucaucugugugauugccuccucuggaaugcuguggauggcggagaucccccugcaauggauugccagcgcuaucguucucgaguucuuuaugauggugcuucugauuccugaacccgagaaacagcggaccccgcaggacaaucaacuggccuacguggucaucggcauccucacacuggcugccauuaucgcggccaacgaaaugggccuucuggagaccacaaagcgcgaucucgggauguccaaagaaccuggaguugugagccccaccucuuaucuggacguggaucugcaucccgcuuccgccuggacgcucuacgcugucgccacaaccgugauuacaccuaugcuuagacacaccaucgagaauagcaccgcuaacguuucucuggccgcgauugccaaccaggcugugguccugaugggccucgacaagggguggccgaucagcaaaauggaccugggagugccccuucuggcccucggcugcuacucccaggucaauccucugacacugacggcugccgugcuccuucugaucacccauuaugccauuaucgggcccggacugcaggcgaaggcuacacgggaggcccaaaagagaaccgcugccggcauuaugaaaaacccuacaguugauggcaucaugaccauugaccucgaucccgugaucuacgacucuaaguucgaaaaacagcuggggcaggucaugcuucuggugcucugugccguucagcugcugcucaugcgcacgagcugggcucuuugcgaggcccugacacuggcgaccggaccuaucaccacacucugggaaggcuccccggggaaguuuuggaauaccacaauugccgugucuauggcuaacaucuuccggggaagcuaucuggccggcgcugggcuugccuuuuccauuaugaaaagcgucggaacgggcaagagaggcaccgggucucaaggagagacacugggcgaaaaguggaaaaagaaacucaaucagcugucccgcaaggauuucgaccuguacaaaaagagcgggaucaccgagguggaucggacagaggcgaaagaaggacucaagagaggcgagauuacccaccaugccgugucccgggggucugcuaagcuucagugguuuguugaacgcaacauggucauccccgagggaagagugauugaccugggcuguggccgggggggauggagcuauuacugcgccggccugaaaaaggugacggaaguccgcggguauaccaaaggaggcccugggcacgaggagcccguuccuauguccacauacggauggaauaucgugaagcucaugucuggcaaagauguguucuaccugcccccggaaaagugugacacccuucugugcgauaucggcgagagcuccccuagccccacagucgaagagucuagaaccauucgggugcucaagaugguugagcccuggcugaaaaacaaucaguucuguaucaaggugcugaacccuuauaugcccacagucauugaacaccucgagcgccuucaaagaaaacaugggggaaugcuggugcggaauccucugucccgcaacagcacccacgaaauguacuggaucucuaauggcacggggaacauuguugcuuccgugaauauggucagcagacuccugcuuaaccgguuuacaaugacccauagacgcccgaccaucgagaaggacguggaucugggagccggcacacggcacgugaacgcugaacccgagacgccuaauauggacgucaucggggagagaauuaaacgcaucaaggaagagcacaacucuaccuggcauuaugacgaugaaaaucccuacaagacaugggccuaucacggaagcuacgagguuaaagcgaccggcuccgccucuagcaugauuaacggcguggugaagcuccugacaaaaccuugggacgucgugcccaugguuacccagauggcuaugacagauaccacgccguucgggcagcaacggguguuuaaggaaaaagucgacaccagaacaccucgcuccaugcccggaacccggagagugaugggcaucacagccgaguggcuguggcgcacccucgggcggaauaagaagccuagacugugcacgcgcgaggaauucacaaaaaagguucggaccaacgcugccaugggagccguguuuacagaggaaaaucagugggauagcgcgaaagcugccgucgaggacgaagauuucuggaagcuuguggacagagagcgcgagcugcauaaacucggcaaguguggguccugcguuuauaacaugaugggcaaaagagaaaagaagcugggagaguuuggcaaagccaaggggucucgggcuauuugguacauguggcuuggagcccgcuaccuggaauucgaggcucucggcuuucugaaugaggaucacugguucagcagagaaaacuccuauucugggguggagggagaaggccugcauaaacucggguacauccugcgggacaucagcaagauucccggcggagccauguaugcggaugacaccgccggcugggacacgagaaucaccgaggaugaccuucacaaugaagagaaaauuacacagcagauggauccugagcaccggcaacuggcuaacgccaucuuuaagcucaccuaccagaauaaggucgugaaaguccagcgccccacaccgaccgggacagugauggacauuaucuccagaaaggaucagcggggaucuggccaaguugggaccuauggacugaacacguucacaaauauggaagcucagcuuauccgccagauggagggcgaaggggugcugagcaaagccgaccucgagaacccucaucugcccgaaaagaaaauuacccaguggcuggagaccaagggcgucgagagacucaagcggauggcgaucuccggagaugacugcguggugaaacccauugaugaccgcuuugccaacgcucugcuugcccugaaugauaugggcaagguuagaaaagacaucccucaauggcagccgagcaagggguggcacgauuggcagcaggugcccuucuguucucaucacuuccacgaacucauuaugaaagacggacggaagcuggucgugccuugccgcccccaagacgagcuuaucggcagagcucggauuucccagggggccggauggagccugaaggaaacagcuugucucggcaaagccuacgcgcagauguggucucugauguauuuucaucgcagagaucugcggcucgccuccaacgcuaucugcagcgccguuccugugcacuggguccccaccucucgcacaacgugguccauccaugcccaccaucaauggaugaccacagaggacaugcugaccguguggaauagagucuggauugaagauaacccuuggauggaggacaagacacccgugaccacgugggagaauguuccguaccuugggaaacgggaagaucagugguguggcagccugaucggacucaccuccagagcuacaugggcccagaacauuccuaccgcgauccagcaagugcgcagccugauuggcaaugaggaauuccuugacuacaugcccucuaugaagcgguuuagaaaagaggaggaaagcgagggggcuaucugguga

SEQ ID NO: 20559 - RNA, 9873 nt, Artificial Sequence
  derived and/or modified CDS sequence (opt5) from DENV-3__HQ541785__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggcgagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucucucucaaggauacccugaaaagacgcagcuggccccuuaaugagggagucauggccgugggccugguuuccauucuggcuucuagccuccugagaaacgacgugccuauggcggggccccuugucgccggaggccugcucaucgcuuguuaugugauuaccgggacauccgccgaucugaccguugaaaaggccgcugacaucacaugggaggaagaggccgaacagacgggagugagccacaaccucaugauugcggucgacgaugacggcaccaugcggaucaaagaugacgagacagagaauauccugaccgugcuucugaagacagcucugcucauugucucuggcaucuuuccguacuccauuccugccacccugcuuguguggcauacguggcagaaacagacccaacgcagcgggguucugugggaugugcccucuccucccgaaacacagaaggccgagcucgaagagggagucuacagaaucaaacagcagggcauuuucgggaagacccaagugggaguuggcgugcagaaggagggggucuuucacacaauguggcacgugacccggggagcugugcugacauauaacggcaaacgccucgaaccgaauugggccuccguuaagaaagaccugaucagcuacggcgggggauggagacuuucugcgcaguggcaaaagggcgaggaaguccaggugauugcuguggagccugggaaaaaccccaagaauuuccagacgaugccuggaaccuuccagacaaccaccggcgaaaucggggccaucgcccuggauuuuaagcccggaacauccggcagccccauuaucaaccgggagggcaaagucguggggcuguauggaaauggcguugugacgaagaacgggggauacgucuccggcauugcucaaaccaaugccgagccugacgggccgacacccgaacucgaggaagagauguucaaaaagcgcaaccugaccaucauggaucuucauccuggcagcggaaaaacaagaaaguaucugcccgcuauugugcgggaagccaucaagcgcagacuccggacccugauccucgcgccuacgagaguuguggccgcugagauggaggaagcccugaaaggccuucccauucgcuaccagacaaccgcuaccaagucugagcacacagggcgggaaaucgucgaccugaugugccaugccaccuuuacaaugagacugcucagcccugugcgcguuccgaauuauaaccugauuaucauggaugaggcccacuucaccgaccccgcuuccauugcggcccggggauacaucucuacgagagugggcaugggggaagcugccgccaucuuuaugacagcuaccccucccggaacagccgaugcguucccucagagcaaugcucccauucaggacgaggagcgcgacaucccggaacgguccuggaacucuggcaaugaguggauuaccgauuuugccgggaaaacggucugguucgugccuagcaucaaggccggcaacgacauugcuaacugucuucgcaaaaauggaaagaaggugauccaacuguccagaaaaaccuuugauacagaauaccagaagaccaaacucaacgacugggauuucgucguuacaaccgacauuucugagaugggcgccaauuuuaaggcggaucgggugaucgaccccagacggugccugaaacccgugauccugacagaugggccugagcgcgucauucucgccggacccaugccugugaccgcugccagcgcugcccagagacggggccgcguugggagaaacccgcagaaggaaaaugaccaauauaucuucacgggacagccccuuaacaaugaugaggaccaugcucacuggacagaagccaagaugcugcuggacaacauuaauaccccugagggcaucauucccgcccucuucgaaccugagcgggagaaauccgccgcuaucgauggggaauacagacugaagggcgagagccgcaaaaccuuuguggaacuuaugcggagaggagaccugcccgucuggcucgcccacaagguggcuucugagggcaucaaauauacagaucgcaaguggugcuucgacgggcagcggaacaaucagauucuggaagagaacauggauguugagaucuggaccaaagaaggagagaagaagaaacugagaccgcgcuggcucgacgcccggacauacuccgauccucuugcccugaaggaauuuaaagaguucgcugcgggcagaaagagcauugcccuggaccucgugacggaaaucgggcgcguccccucucaucuggcucacagaacccggaaugcccuugauaaccuggugaugcuccauacauccgagcacggaggccgcgccuauagacacgcugucgaggaacugccugagaccauggaaacacugcuccuucugggccugaugauucuccugaccgggggagccaugcuuuuucugaucagcggcaaagggaucggaaagacguccauuggccucaucugugugauuaccucuagcgggaugcuguggauggcggagaucccccugcaauggauugccuccgcuaucguucucgaguucuuuaugauggugcuucugauuccugaacccgagaagcagcggacaccgcaggacaaucaacuggccuacguggucaucggaauccucacccuggcugccauuaucgcggccaacgaaaugggccuucuggagacaaccaaacgcgaucucggcaugagcaaggaaccugggguugugucucccacguccuaucuggacguggaucugcaucccgcuagcgccuggacacucuacgcugucgccaccacagugauuaccccuaugcuuagacacaccaucgaaaauucuacagcuaacguuagccuggccgcgauugccaaccaggcugugguccugaugggacucgacaaaggcuggccgaucuccaagauggaccugggggugccccuucuggcccucggaugcuacucucaggucaauccucugacgcugaccgcugccgugcuccuucugaucacacauuaugccauuaucggccccgggcugcaggcgaaagcuacccgggaggcccaaaagagaacagcugccggaauuaugaagaacccuaccguugauggcaucaugacgauugaccucgaucccgugaucuacgacagcaaauucgaaaagcagcugggccaggucaugcuucuggugcucugugccguucagcugcugcucaugcgcacauccugggcucuuugcgaggcccugacccuggcgaccgggccuaucacaacccucugggaaggaucuccgggcaaauuuuggaauacaacgauugccgugagcauggcuaacaucuuccggggguccuaucuggccggagcuggccuugccuuuagcauuaugaagucugucgggaccggaaaaagaggcacaggcucccaaggggagacccugggagaaaaguggaagaaaaagcucaaucagcugagccgcaaagauuucgaccuguacaagaaauccggcaucacagagguggaucggaccgaggcgaaggaagggcucaaaagaggagagauuacgcaccaugccgugucucggggcagcgcuaaacuucagugguuuguugaacgcaacauggucauccccgaggggagagugauugaccugggauguggccggggcgggugguccuauuacugcgccggacugaagaaagugaccgaaguccgcggcuauacaaaagggggaccuggccacgaggagcccguuccuaugucuaccuacggguggaauaucgugaaacucaugagcggaaaggauguguucuaccugcccccggaaaaaugugacacacuucugugcgauaucggcgaguccagcccuucucccaccgucgaagaguccagaacaauucgggugcucaagaugguugagcccuggcugaagaacaaucaguucuguaucaaagugcugaacccuuauaugcccaccgucauugaacaccucgagcgccuucaaagaaagcauggcgggaugcuggugcggaauccucugagccgcaacucuacgcacgaaauguacuggaucuccaauggaacaggcaacauuguugcuagcgugaauauggucucuagacuccugcuuaaccgguuuaccaugacccauagacgcccgacaaucgagaaagacguggaucugggggccggaacgcggcacgugaacgcugaacccgagaccccuaauauggacgucaucggcgagagaauuaagcgcaucaaagaagaacacaacagcacauggcauuaugacgaugaaaaucccuacaagaccugggccuaucacggguccuacgagguuaaggcgacaggaucugccagcuccaugauuaacggcguggugaaacuccugaccaagccuugggacgucgugcccaugguuacacagauggcuaugaccgauacgaccccguucggccagcaacggguguuuaaagaaaaggucgacacaagaaccccucgcagcaugcccgggacacggagagugaugggaaucaccgccgaguggcuguggcgcacgcucggccggaauaaaaagccuagacugugcacacgcgaggaguucaccaagaaaguucggacaaacgcugccaugggggccguguuuaccgaggaaaaucagugggauuccgcgaaggcugccgucgaggacgaagauuucuggaaacuuguggacagagagcgcgagcugcauaagcucggaaaauguggcucuugcguuuauaacaugauggggaagagagagaagaagcugggcgaguuuggaaaggccaaaggcagccgggcuauuugguacauguggcuuggggcccgcuaccuggaguucgaggcucucggauuucugaaugaggaucacugguucuccagagaaaacucuuauagcggcguggagggggaaggacugcauaagcucggcuacauccugcgggacaucuccaaaauucccgggggcgccauguaugcggaugacacggccggaugggacaccagaaucacagaggaugaccuucacaaugaagagaagauuacccagcagauggauccugagcaccggcaacuggcuaacgccaucuuuaaacucacauaccagaauaaggucgugaagguccagcgccccaccccgacaggcaccgugauggacauuaucucuagaaaagaucagcgggggagcggacaaguuggcacguaugggcugaacacauucaccaauauggaagcucagcuuauccgccagauggagggagaaggcgugcuguccaaggccgaccucgagaacccucaucugcccgagaagaagauuacccaguggcuggagacaaaaggggucgagagacucaagcggauggcgaucagcggcgaugacugcguggugaagcccauugaugaccgcuuugccaacgcucugcuugcccugaaugauaugggaaaaguuagaaaggacaucccucaauggcagccgucuaaaggcuggcacgauuggcaacaggugcccuucuguucccaucacuuccacgaacucauuaugaaggacgggcggaaacuggucgugccuugccgcccccaagacgagcuuaucggacgggcucggauuagccagggcgccggguggucucugaaggaaaccgcuugucucggaaaggccuacgcgcagauguggucccugauguauuuucaucgcagagaucugcggcucgccagcaacgcuaucugcucugccguuccugugcacuggguccccacaucccgcacgaccuggagcauccaugcccaccaucaauggaugacaaccgacgauaugcugacaguguggaauagagucuggauugaggacaacccuuggauggaagauaaaacccccgugacgaccugggagaauguuccguaccuuggcaagcgggaggaccaguggugugggucccugaucggccucacaagcagagcuaccugggcccagaacauuccuacagcgauccagcaagugcgcucucugauuggaaaugaagaguuccuugauuacaugcccagcaugaaacgguuuagaaaggaagaggaguccgaaggcgcuaucugguga

SEQ ID NO: 20560 - RNA, 9873 nt, Artificial Sequence
  derived and/or modified CDS sequence (opt5) from DENV-3__HM181975__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucgugcugcuuaugcugguuaccccuucuaugacaaugagaugugugggagucggcaaccgggacuuuguggaagggcucagcggagcuaccuggguggaugucguucuggagcacggcgggugcgugaccacaauggccaagaauaaacccacgcuggacaucgagcuccagaagaccgaagcuacacaacuggccacccuucgcaaacuguguauugagggaaagaucacaaacauuaccacggauuccagaugcccuacacagggcgaagcgacccucccggaggaacaggaccagaauuauguguguaaacacaccuacgucgaucggggcugggggaacggaugcggccuguucgggaagggaagccuugugacaugcgccaaguuucaaugucuggagcccaucgagggcaaaguugugcagcaugaaaaucucaaguauaccgucauuaucacagugcacacgggggaccagcaucagguuggaaacgagacccaaggcgugacagcugaaaucaccccucaggccucuacaaccgaggcuauucugcccgaauacggcacgcuggggcucgagugcuccccucgcaccggacuggacuucaaugagaugauccuucugacaaugaaaaacaaggccuggaugguccacagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcauacagcucugaccggcgccaccgaaauucaaaauuccgggggcacaagcaucuucgccggacaccugaagugucgccucaaaauggacaagcuggagcuuaaaggcaugucuuaugcuaugugcacgaacaccuuugugcugaagaaagaggucuccgaaacacagcaugggaccauucucaucaagguggaguacaagggagaagauguucccuguaaaaucccuuucagcacagaggacggccaagggaaggcccacaacggaagacugauuaccgcgaaucccguggucacgaaaaaggaggaacccgugaacaucgaggcugaaccuccguucggcgaguccaauauugugaucgggauuggcgauaacgcccugaaaaucaauugguacaagaagggaucuagcaucggcaaaauguuugaagccacagcuagaggggccagacgcauggcuauucuuggagacaccgccugggauuucggcuccguugggggaguccucaacagccugggcaagauggugcaucagaucuuugggucugcguauaccgcccuguucuccggcgugagcugggucaugaaaauuggaaucggcgugcuccugacauggauugggcuuaauucuaagaacaccagcauguccuuuucuugcaucgcuauuggaaucaucacacuguaccucggcgccguugugcaggcugacauggggugugucauuaauuggaaaggaaaggagcugaagugcggcagcgggaucuucgugacgaacgagguucacaccuggacagaacaguauaaauuucaagccgauucccccaagcggcuggcgaccgccauugcuggcgccugggagaauggaguguguggcaucagaagcacaacccgcauggaaaaccuucucuggaaacagauugcuaaugagcugaacuacauccugugggaaaauaacaucaagcucacggucgugguuggggacauuaucggagugcuggagcagggcaaacggacccuuacaccucagcccauggagcugaaguauucuuggaaaaccugggggaaggccaagauugucacagccgaaacccaaaacuccagcuucaucauugauggaccuaauacacccgagugcccgucuguguccagagcuuggaacgugugggaagucgaggacuacggcuuuggcguuuucaccacgaauaucuggcucaaacugcgcgaaguguauacacagcugugugaccaccggcuuaugagcgcggccgugaaggaugagagagcuguccaugccgacaugggguacuggaucgagucccagaaaaacggaucuuggaagcucgaaaaagccagccugauugaggugaagaccugcaccuggccuaagucccacacacuguggucuaauggcguucucgaaagcgauaugaucauucccaaaucccuggcugggccuaucagccagcauaaccaccgccccggauaccacacccaaacggccggcccuuggcaucuugggaagcuggagcucgacuuuaauuauugcgagggaacaaccguggucauuacagaaaacuguggcacccggggccccucucugagaacaaccacgguguccgggaaacugauccacgaguggugcugucgcagcugcacccuuccgccucuccgguacaugggagaagauggcuguugguaugggauggagaucagacccauuucugaaaaggaggagaauaugguuaaaucccuggugagcgcgggaucuggcaaggucgacaacuucacaaugggggugcugugccucgcuauccuguuugaagagguuaugcggggaaaguucggcaaaaagcauaugauugccggcguguucuuuaccuucguccuucugcucagcgggcagaucacauggcgcgauauggcccacacccugauuaugaucggauccaaugcuagcgacagaaugggcaugggggugacguaccuggcccuuauugcgacauuuaaaauccagcccuuccuggcucucggauuuuuccugcggaagcucaccucuagagaaaaccugcuucugggcguggggcucgccauggccacaacccugcaacugccugaggauaucgaacagauggcuaauggaauugcccuuggccugauggcucucaaacugaucacccaguuugagauuuaucagcucuggacagcccugaucucccuuacguguagcaacaccauuuucacacugaccgucgcguggcgcacagccacccucauccuggcuggcguuucccugcuuccgaugugccaaucuagcuccaugcggaagacggacuggcugcccauggccguggcugccaugggggugccuccccucccucuguuuaucuucucucucaaggauacacugaaaagacgcagcuggccccuuaaugagggagucauggccgugggccugguuuccauucuggcuucuagccuccugagaaacgacgugccuauggcggggccccuugucgccggaggccugcucaucgcuuguuacgugauuaccgggaccuccgccgaucugacaguugaaaaggccgcugacaucaccugggaggaagaggccgaacagacaggagugagccauaaccucaugauuacggucgacgaugacggcaccaugcggaucaaagaugacgagacagagaauauccugaccgugcuucugaagacagcgcugcucauugucucuggcaucuuuccguauuccauuccugcuacccugcuuguguggcacacguggcagaaacagacccaacgcagcgggguucugugggaugugcccucuccucccgaaacacagaaggccgagcucgaagagggagucuacagaaucaaacagcagggcauuuucgggaagacccaagugggaguuggcgugcagaaggagggggucuuucacacaauguggcaugugacccggggagccgugcugacauacaacggcaaacgccucgaaccgaauugggcuuccguuaagaaagaccugaucagcuauggcgggggauggagacuuucugcccaguggcaaaagggcgaggaaguccaggugauugcgguggagccugggaaaaaccccaagaauuuccagacgaugccuggaaccuuccagacaaccaccggcgaaaucggggcuaucgcccuggauuuuaagcccggaacauccggcagccccauuaucaaccgggagggcaaagucguggggcuguacggaaauggcguugugacgaagaacgggggauaugucuccggcauugcccaaaccaaugcugagccugacgggccgacacccgaacucgaggaagagauguucaaaaagcgcaaccugaccaucauggaucuucacccuggcagcggaaaaacaagaaaguaccugcccgccauugugcgggaagcuaucaagcgcagacuccggacccugauccucgccccuacgagaguuguggcggccgagauggaggaagcucugaaaggccuucccauucgcuaucagacaaccgccaccaagucugagcauacagggcgggaaaucgucgaccugaugugccacgcuaccuuuacaaugagacugcucagcccugugcgcguuccgaauuacaaccugauuaucauggaugaggcccauuucaccgaccccgccuccauugcugcgcggggauauaucucuacgagagugggcaugggggaagccgcugccaucuuuaugacagccaccccucccggaacagcugaugccuucccucagagcaaugcgcccauucaggacgaggagcgcgacaucccggaacgguccuggaacucuggcaaugaguggauuaccgauuuugcugggaaaacggucugguucgugccuagcaucaaggccggcaacgacauugccaacugucuucgcaaaaauggaaagaaggugauccaacuguccagaaaaaccuuugauacagaauaccagaagaccaaacucaacgacugggauuucgucguuacaaccgacauuucugagaugggcgcuaauuuuaaggccgaucgggugaucgaccccagacggugccugaaacccgugauccugacagaugggccugagcgcgucauucucgcgggacccaugccugugaccgccgcuagcgccgcucagagacggggccgcguugggagaaacccgcagaaggaaaaugaccaauacaucuucacgggacagccccuuaacaaugaugaggaccacgcccacuggacagaagcuaagaugcugcuggacaacauuaauaccccugagggcaucauucccgcccucuucgaaccugagcgggagaaauccgcggccaucgauggggaauauagacugaagggcgagagccgcaaaaccuuuguggaacuuaugcggagaggagaccugcccgucuggcucgcucauaagguggccucugagggcaucaaauacacagaucgcaaguggugcuucgacgggcagcggaacaaucagauucuggaagagaacauggauguugagaucuggaccaaagaaggagagaagaagaaacugagaccgcgcuggcucgacgcucggacauauuccgauccucuugcccugaaggaauuuaaagaguucgccgcuggcagaaagagcauugcgcuggaccucgugacggaaaucgggcgcguccccucucaccuggcccauagaacccggaaugcucuugauaaccuggugaugcuccacacauccgagcacggaggccgcgccuacagacaugccgucgaggaacugccugagaccauggaaacacugcuccuucugggccugaugauucuccugaccgggggagcuaugcuuuuucugaucagcggcaaagggaucggaaagacguccauuggccucaucugugugauugccucuagcgggaugcuguggauggcggagaucccccugcaauggauugccuccgcuaucguucucgaguucuuuaugauggugcuucugauuccugaacccgagaagcagcggaccccgcaggacaaucaacuggccuauguggucaucggaauccucacacuggcugccauuaucgcggccaacgaaaugggccuucuggagaccacaaaacgcgaucucggcaugagcaaggaaccugggguugugucucccaccuccuaccuggacguggaucugcaccccgcuagcgccuggacgcucuaugcugucgccacaaccgugauuacaccuaugcuuagacauaccaucgaaaauucuaccgcuaacguuagccuggccgcgauugccaaccaggcugugguccugaugggacucgacaaaggcuggccgaucuccaagauggaccugggggugccccuucuggcccucggaugcuacucucaggucaauccucugacacugacggcugccgugcuccuucugaucacccacuacgccauuaucggccccgggcugcaggcgaaagcuacacgggaggcccaaaagagaaccgcugccggaauuaugaagaacccuacaguugauggcaucaugaccauugaccucgaucccgugaucuaugacagcaaauucgaaaagcagcugggccaggucaugcuucuggugcucuguguugugcagcugcugcucaugcgcacguccugggcccuuugcgaggcucugacacuggccaccgggccuaucaccacacucugggaaggaucuccgggcaaauuuuggaauaccacaauugcggucagcauggccaacaucuuccggggguccuaccuggcuggagccggccuugcuuuuagcauuaugaagucuguggggacgggaaaaagaggcaccggcucccaaggggagacacugggagaaaaguggaagaaaaagcucaaucagcugagccgcaaagauuucgaccuguauaagaaauccggcaucaccgagguggaucggacagaggccaaggaagggcucaaaagaggagagauuacccaucacgcgguuucucggggcagcgccaaacuucagugguuugucgaacgcaacauggugauccccgaggggagagugauugaccugggauguggccggggcgggugguccuacuauugcgcuggacugaagaaagucacggaaguucgcggcuacaccaaagggggaccuggccacgaggagcccgugccuaugucuacauauggguggaauaucgugaaacucaugagcggaaaggaugucuucuaccugcccccggaaaaaugugacacccuucugugcgauaucggcgaguccagcccuucucccacaguggaagaguccagaaccauucggguucucaagaugguggagcccuggcugaagaacaaucaguucuguaucaaaguccugaacccuuacaugcccacagugauugaacaucucgagcgccuucaaagaaagcacggcgggaugcugguucggaauccucugagccgcaacucuacccaugaaauguauuggaucuccaauggaacgggcaacauuguggccagcgucaauauggugucuagacuccugcuuaaccgguuuacaaugauccacagacgcccgaccaucgagaaagacguggaucugggggcuggaacccggcacgucaacgccgaacccgagacaccuaauauggacguuauuggcgagagaaucaagcgcauuaaagaagaacacaacagcacguggcacuacgacgaugaaaaucccuauaagaccugggcuuaccauggguccuaugaggugaaggccacaggaucugcgagcuccaugaucaacggcguggucaaacuccugaccaagccuugggacgugguucccauggugacacagauggccaugaccgauacaaccccguucggccagcaacgggucuuuaaagaaaagguggacacgagaaccccucgcagcaugcccgggacacggagaguuaugggaauuaccgcugaguggcuguggcgcacacucggccggaauaaaaagccuagacugugcacccgcgaggaguucacgaagaaagugcggacaaacgccgcuaugggggccgucuuuaccgaggaaaaucagugggauuccgccaaggcggcuguggaggacgaagauuucuggaaacuuguugacagagagcgcgagcugcacaagcucggaaaauguggcucuugcguguacaacaugauggggaagagagagaagaagcugggcgaguuuggaaaggccaaaggcagccgggccaucugguauauguggcuuggggcucgcuaccuggaguucgaggcccucggauuucugaaugaggaucauugguucuccagagaaaacucuuacagcggcgucgagggggaaggacugcacaagcucggcuauauccugcgggacauuuccaaaauccccgggggcgcuauguacgccgaugacacagcgggaugggacaccagaauuacggaggaugaccuucacaaugaagagaagaucacccagcagauggauccugagcaucggcaacuggccaacgcuauuuuuaaacucacauaucagaauaagguggucaaggugcagcgccccaccccgacaggcaccguuauggacaucaucucuagaaaagaucagcgggggagcggacaagugggcacauacgggcugaacaccuucacgaauauggaagcccagcuuauucgccagauggagggagaaggcguccuguccaaggcugaccucgagaacccucaucugcccgagaagaagaucacacaguggcuggagaccaaagggguggagagacucaagcggauggccauuagcggcgaugacugcgugguuaagcccaucgaugaccgcuuugcgaacgcccugcuugcucugaaugauaugggaaaagugagaaaggacauuccucaauggcagccgucuaaaggcuggcaugauuggcagcagguccccuucuguucccaccacuuccaugaacucaucaugaaggacgggcggaaacuggugguuccuugccgcccccaagacgagcuuauuggacgggcccggaucagccagggcgcuggguggucucugaaggaaaccgccugucucggaaaggcuuaugcccagauguggucccugauguacuuucaccgcagagaucugcggcucgcgagcaacgccaucugcucugcugugccuguccauugggugcccacaucccgcaccacauggagcauucacgcccaucaccaauggaugacgaccgaggacaugcugacagucuggaauagaguguggaucgaagauaacccuuggauggaggacaaaacccccguuacaaccugggagaaugugccguaucuuggcaagcgggaagaucaguggugugggucccugauuggccucacgagcagagccaccugggcucagaacaucccuacagccauucagcaaguccgcucucugaucggaaaugaggaguuccuugacuacaugcccagcaugaaacgguuuagaaaggaggaggaauccgagggcgcgaucugguga

SEQ ID NO: 20561 - RNA, 9873 nt, Artificial Sequence
  derived and/or modified CDS sequence (opt5) from DENV-3__HM631864__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcucggggggccagacgcauggcuauccuuggagacaccgccugggauuucggcuccguggggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagaaagcugugcacgccgacaugggguacuggauugagucccagaagaacggaucuuggaaacucgaaaaggccagccugaucgaggucaagaccugcaccuggccuaaaucccauacacuguggucuaauggcgugcucgaaagcgauaugauuauccccaagucccuggcugggccuauuagccagcacaaccauagacccggauaucacacccaaacggccggcccuuggcaccuugggaaacuggagcucgacuuuaauuacugcgagggaacaaccguugugaucacagaaaacuguggcacccgcggccccucucugcggacaaccacggucuccgggaagcugauccaugaguggugcuguagaagcugcacccuuccgccucuccgcuauaugggagaagauggcuguugguacgggauggagauucggcccaucucugaaaaagaggagaauauggugaagucccugguuagcgcgggaucuggcaagguggacaacagcacaauggggguccugugccucgcuauucuguucgaagaggugaugagaggaaaauuuggcaagaaacacaugaucgccggcguuuucuucaccuuugugcuucugcucuccgggcagauuacauggcgggauauggcccauacccugaucaugauuggaagcaaugcuucugaccgcaugggcaugggggucacguaucuggcccuuaucgcgacauucaagauccagcccuuucuggcucucggauucuuucugagaaaacucaccucccgggaaaaccugcuucugggcguggggcucgccauggccacaacccugcaacugccugaggauauugaacagauggcuaauggaaucgcccuuggccugauggcucucaagcugauuacccaguucgagacauaccagcucuggacggcccugaucagccuuaccuguuccaacacaauuuuuacccugacaguggcguggagaaccgccacgcucauccuggcuggcgucucucugcuuccgguuugccaaagcuccucuaugcgcaagacagacuggcugcccauggccguggcugccaugggggugccuccccucccucuguucaucuuuagccucaaagauacccugaagcggagauccuggccccuuaaugagggagucauggccgugggccugguuucuauucuggcuagcucccuccugcgcaacgacgugccuauggcggggccccuugucgccggaggccugcucaucgcuuguuaugugauuaccgggacaagcgccgaucugaccguugaaaaagccgcugacaucacaugggaggaagaggccgaacagacgggagugucucacaaccucaugauugcggucgacgaugacggcaccaugagaaucaaggaugacgagacagagaauauccugaccgugcuucugaaaacagcucugcucauugucuccggcaucuucccguacagcauuccugccacccugcuuguguggcauacguggcagaagcagacccaacggucugggguucugugggaugugcccuccccucccgaaacacagaaagccgagcucgaagagggagucuaccgcaucaagcagcagggcauuuuugggaagacccaagugggaguuggcgugcagaaagagggggucuuccacacaauguggcacgugaccagaggagcugugcugacauauaacggcaagcggcucgaaccgaauugggccagcguuaaaaaggaccugaucucuuacggcgggggauggcgccuuuccgcgcaguggcaaaaaggcgaggaaguccaggugauugcuguggagccugggaagaaccccaagaauuuucagacgaugccuggaaccuuccagacaaccaccggcgaaaucggggccaucgcccuggauuucaaacccggaacaagcggcucccccauuaucaacagagagggcaaggucguggggcuguauggaaauggcguugugacgaaaaacgggggauacgucagcggcauugcucaaaccaaugccgagccugacgggccgacacccgaacucgaggaagagauguuuaagaaacggaaccugaccaucauggaucuucauccuggcucuggaaagacacgcaaguaucugcccgcuauugugagagaagccaucaaacggcgccucagaacccugauccucgcgccuacgcggguuguggccgcugagauggaggaagcccugaagggccuucccauuagauaccagacaaccgcuaccaaaagcgagcacacagggcgcgaaaucgucgaccugaugugccaugccaccuucacaaugcggcugcucuccccugugagaguuccgaauuauaaccugauuaucauggaugaggcccacuuuaccgaccccgcuucuauugcggcccgcggauacaucagcacgcgggugggcaugggggaagcugccgccaucuucaugacagcuaccccucccggaacagccgaugcguuuccucaguccaaugcucccauucaggacgaggagagagacaucccggaacgcucuuggaacagcggcaaugaguggauuaccgauuucgccgggaagacggucugguuugugccuuccaucaaagccggcaacgacauugcuaacugucuucggaagaauggaaagaaagugauccaacugucuagaaagaccuucgauacagaauaccagaaaaccaagcucaacgacugggauuuugucguuacaaccgacauuagcgagaugggcgccaauuucaaagcggaucgcgugaucgacccccggagaugccugaagcccgugauccugacagaugggccugagcgggucauucucgccggacccaugccugugaccgcugccuccgcugcccagcgcagaggccggguugggcgcaacccgcagaaggaaaaugaccaauauaucuuuacgggacagccccuuaacaaugaugaggaccaugcucacuggacagaagccaaaaugcugcuggacaacauuaauaccccugagggcaucauucccgcgcucuucgaaccugagagagagaagagcgccgcuaucgauggggaauaccggcugaaaggcgagucuagaaagaccuucguggaacuuaugcgccggggagaccugcccgucuggcucgcccacaaaguggcuuccgagggcaucaaguauacagauagaaaauggugcuuugacgggcagcgcaacaaucagauucuggaagagaacauggauguugagaucuggaccaaggaaggagagaagaaaaagcugcggccgagauggcucgacgcccgcacauacagcgauccucuugcccugaaagaauucaaggaguuugcugcgggccggaaaucuauugcccuggaccucgugacggaaaucgggagaguccccucccaucuggcucaccgcaccagaaaugcccuugauaaccuggugaugcuccauacaagcgagcacggaggccgggccuaucgccacgcugucgaggaacugccugagaccauggaaacacugcuccuucugggccugaugauucuccugaccgggggagccaugcuuuuccugaucuccggcaaggggaucggaaagacgucuauuggccucaucugugugauugcgagcuccgggaugcuguggauggccgagaucccccugcaauggauugcuagcgccaucguucucgaguuuuucaugauggugcuucugauuccugaacccgagaaacagagaaccccgcaggacaaucaacuggcuuacguggucaucggaauccucacacuggccgcgguuauugccgcuaacgaaaugggccuucuggagaccacaaagcgggaucucggcaugucuaaagaaccugggguggugucccccaccagcuaucuggacgucgaucugcaucccgccucugcuuggacgcucuacgccguggcuacaaccguuaucacaccuaugcuucgccacaccauugagaauagcaccgccaacgugucccuggcggccaucgcuaaccaggccgucgugcugaugggacucgacaagggcuggccgauuucuaaaauggaccugggggucccccuucuggcucucggaugcuacagccaggugaauccucugacacugacggccgccguucuccuucugaucacccauuaugcgaucauuggccccgggcugcaggcuaaggccacaagagaggcucaaaagcggaccgccgccggaaucaugaaaaacccuacaguggauggcauuaugaccaucgaccucgaucccgucauuuacgacuccaaguuugaaaaacagcugggccaggugaugcuucugguucucugugcugugcagcugcugcucaugagaacgucuugggcccuuugcgaggcgcugacacuggccaccgggccuaucaccacacucugggaaggaagcccgggcaaguucuggaauaccacaaucgcugucuccauggccaacauuuuucgcgggagcuaucuggcuggagccggccuugcguucucuaucaugaaauccguggggacgggaaagcggggcaccggcagccaaggggagacacugggagaaaaguggaaaaagaaacucaaucagcuguccagaaaggauuuugaccuguacaaaaagucuggcauuaccgagguggaucgcacagaggccaaagaagggcucaagcggggagagaucacccaccaugcuguuagcagaggcuccgccaagcuucagugguucgucgaacggaacauggugauucccgaggggcgcgugaucgaccugggauguggcagaggcggguggucuuauuacugcgcuggacugaaaaaggucacggaaguucggggcuauaccaaagggggaccuggccacgaggagcccgugccuaugagcacauacggguggaauauugugaagcucauguccggaaaagaugucuuuuaccugcccccggaaaagugugacacccuucugugcgauaucggcgagagcucuccuucccccacaguggaagagagccgcaccaucagaguucucaagaugguggagcccuggcugaaaaacaaucaguucuguauuaagguccugaacccuuauaugcccacagugaucgaacaccucgagcggcuucaacgcaaacauggcgggaugcugguuagaaauccucugucucggaacuccacccacgaaauguacuggauuagcaauggaacgggcaacaucguggccucugucaauauggugagccgccuccugcuuaacagauucacaaugacccaucggagaccgaccauugagaaggacguggaucugggggcuggaacacgccacgucaacgccgaacccgagacgccuaauauggacguuaucggcgagcggaucaaaagaauuaaggaagagcacaacuccaccuggcauuaugacgaugaaaaucccuacaagacaugggcguaucacgggucuuacgaggugaaagccaccggaagcgcuuccagcaugaucaacggcguggucaagcuccugacaaaaccuugggacgugguucccauggugacccagauggccaugacagauaccacgccguuuggccagcaacgcgucuucaaggaaaaaguggacacccggacaccuagauccaugcccgggacccgccggguuaugggaauuacagcugaguggcuguggagaacccucggccgcaauaagaagccucggcugugcacgagagaggaauuuacaaaaaaggugcgcaccaacgccgccaugggggcggucuucacagaggaaaaucagugggauucugcuaaagccgccguggaggacgaagauuuuuggaagcuuguugaccgggagagagagcugcauaaacucggaaaguguggcagcugcguguauaacaugauggggaaacgcgaaaagaagcugggcgaguucggaaaagcuaagggcuccagagccaucugguacauguggcuuggggcucgguaccuggaauuugaggcccucggauuccugaaugaggaucacugguuuucucgcgaaaacagcuauuccggcgucgagggggaaggacugcauaaacucggcuacauucugagagacaucucuaagauccccgggggcgcgauguaugccgaugacaccgcuggaugggacacgcggauuaccgaggaugaccuucacaaugaagagaaaaucacacagcagauggauccugagcacagacaacuggccaacgcuauuuucaagcucaccuaccagaauaagguggucaaagugcagcggcccacaccgaccggcacaguuauggacaucauuagccgcaaggaucagagaggguccggacaagugggcaccuaugggcugaacacguuuacaaauauggaagcccagcuuauccggcagauggagggagaaggcguccugagcaaagcggaccucgagaacccucaucugcccgaaaagaaaaucacccaguggcuggagaccaaggggguggagcgccucaagagaauggccauuucuggcgaugacugcgugguuaaacccaucgaugaccgguucgcuaacgcccugcuugcucugaaugauaugggaaaggugcgcaaagacauuccucaauggcagccguccaagggcuggcacgauuggcagcagguccccuuuuguagccaucacuuccacgaacucaucaugaaagacgggagaaagcuggugguuccuugccggccccaagacgagcuuauuggacgcgccagaaucucucagggcgcuggguggucccugaaggaaacagccugucucggaaaagcguacgcccagauguggagccugauguauuuccaucggcgcgaucugagacucgcuucuaacgccauuugcuccgccgugccuguccacugggugcccaccagccggacaacgugguccauccaugcucaccaucaauggaugaccacagacgauaugcugaccgucuggaaucgcguguggaucgaggacaacccuuggauggaagauaagacacccguuaccacgugggagaaugugccguaccuuggcaaaagagaggaccaguggugugggagccugauuggccucaccucucgggccacaugggcgcagaacaucccuaccgcuauucagcaagucagaagccugaucggaaaugaagaguuucuugauuacaugcccuccaugaagcgcuuccggaaagaagaggagucugaaggcgccauuugguga

SEQ ID NO: 20562 - RNA, 9873 nt, Artificial Sequence
  derived and/or modified CDS sequence (opt5) from DENV-3__HM631859__SS-prME
accagccugugccucaugaugauccugcccgccgcucuugccuuccaccugacaucccgggacggagaaccucggaugauuguggggaagaacgaacgcggaaagucucuccuguuuaagacggcgagcggcaucaauauguguacccuuauugcuauggaucugggggaaaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaccucagcccauggagcugaaguauucuuggaaaaccugggggaaggccaagaucgugacagccgaaacccaaaacuccagcuucauuaucgauggaccuaauacacccgagugcccgucugucuccagagcuuggaacgugugggaaguggaggacuacggcuuuggcgucuucaccacgaauaucuggcucaaacugcgcgaaguuuauacacagcugugugaccaccggcuuaugagcgcggccgugaaggaugagagagcugugcaugccgacaugggguacuggauugagucccagaaaaacggaucuuggaagcucgaaaaagccagccugaucgaggucaagaccugcaccuggccuaagucccacacacuguggucuaauggcgugcucgaaagcgauaugauuauccccaaaucccuggcugggccuauuagccagcauaaccaccgccccggauaccacacccaaacggccggcccuuggcaucuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcauaugaucgccggcguuuucuuuaccuucgugcuucugcucagcgggcagauuacauggcgcgauauggcccacacccugaucaugauuggauccaaugcuagcgacagaaugggcaugggggucacguaccuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagaucuaucagcucuggacagcccugauuucccuuacguguagcaacaccaucuucacacugaccguggcguggcgcacagccacccucauccuggcuggcgucucccugcuuccgaugugccaaucuagcuccaugcggaagacggacuggcugcccauggccguugcugccaugggggugccuccccucccucuguuuauuuucucucucaaggauacacugaaaagacgcagcuggccccuuaaugagggagugauggccgucggccugguguccauccuggcuucuagccuccugagaaacgacguuccuauggcggggccccuuguggccggaggccugcucauugcuuguuacgucaucaccgggaccuccgccgaucugacaguggaaaaggccgcugacauuaccugggaggaagaggccgaacagacaggaguuagccauaaccucaugaucacgguggacgaugacggcaccaugcggaucaaagaugacgagacagagaauauucugaccguccuucugaagacagcgcugcucaucgugucuggcauuuuuccguauuccaucccugcuacccugcuugucuggcacacguggcagaaacagacccaacgcagcggggugcugugggauguucccucuccucccgaaacacagaaggccgagcucgaagagggaguguacagaauuaaacagcagggcaucuucgggaagacccaagucggagugggcguucagaaggaggggguguuucacacaauguggcaugucacccggggagccgugcugacauacaacggcaaacgccucgaaccgaauugggcuuccgugaagaaagaccugauuagcuauggcgggggauggagacuuucugcccaguggcaaaagggcgaggaaguucaggucaucgcgguggagccugggaaaaaccccaagaauuuccagacgaugccuggaaccuuccagacaaccaccggcgaaaucggggcuauugcccuggauuuuaagcccggaacauccggcagccccaucauuaaccgggagggcaaaguggucgggcuguacggaaauggcgugguuacgaagaacgggggauauguguccggcaucgcccaaaccaaugcugagccugacgggccgacacccgaacucgaggaagagauguucaaaaagcgcaaccugaccauuauggaucuucacccuggcagcggaaaaacaagaaaguaccugcccgccaucguccgggaagcuaucaagcgcagacuccggacccugauucucgccccuacgagagugguugcggccgagauggaggaagcucugaaaggccuucccauccgcuaucagacaaccgccaccaagucugagcauacagggcgggaaauuguggaccugaugugccacgcuaccuuuacaaugagacugcucagcccuguccgcgugccgaauuacaaccugaucauuauggaugaggcccauuucaccgaccccgccuccaucgcugcgcggggauauaucucuacgagaguuggcaugggggaagccgcugccauuuuuaugacagccaccccucccggaacagcugaugccuucccucagagcaaugcgcccauccaggacgaggagcgcgacauuccggaacgguccuggaacucuggcaaugaguggaucaccgauuuugcugggaaaacggugugguucgucccuagcauuaaggccggcaacgacaucgccaacugucuucgcaaaaauggaaagaaggugauucaacuguccagaaaaaccuuugauacagaauaccagaagaccaaacucaacgacugggauuucguggucacaaccgacaucucugagaugggcgcuaauuuuaaggccgaucggguuaucgaccccagacggugccugaaacccgugauucugacagaugggccugagcgcgugauccucgcgggacccaugccugucaccgccgcuagcgccgcucagagacggggccgcguggggagaaacccgcagaaggaaaaugaccaauacauuuucacgggacagccccuuaacaaugaugaggaccacgcccacuggacagaagcuaagaugcugcuggacaacaucaauaccccugagggcauuauccccgcccucuucgaaccugagcgggagaaauccgcggccaucgauggggaauauagacugaagggcgagagccgcaaaaccuuuguugaacuuaugcggagaggagaccugcccguguggcucgcucauaaggucgccucugagggcauuaaauacacagaucgcaaguggugcuucgacgggcagcggaacaaucagauccuggaagagaacauggauguggagauuuggaccaaagaaggagagaagaagaaacugagaccgcgcuggcucgacgcucggacauauuccgauccucuugcccugaaggaauuuaaagaguucgccgcuggcagaaagagcaucgcgcuggaccucguuacggaaauugggcgcgugcccucucaccuggcccauagaacccggaaugcucuugauaaccuggucaugcuccacacauccgagcacggaggccgcgccuacagacaugccguggaggaacugccugagaccauggaaacacugcuccuucugggccugaugauccuccugaccgggggagcuaugcuuuuucugaucagcggcaaagggauuggaaagacguccaucggccucauuugugucaucgccucuagcgggaugcuguggauggcggagauuccccugcaauggaucgccuccgcuauugugcucgaguucuuuaugaugguucuucugaucccugaacccgagaagcagcggaccccgcaggacaaucaacuggccuauguggugaucggcauucucacacuggcugccaucauugcggccaacgaaaugggccuucuggagaccacaaaacgcgaucucggcaugagcaaggaaccuggggucguuucucccaccuccuaccuggacguggaucugcaccccgcuagcgccuggacgcucuaugcuguggccacaaccgucaucacaccuaugcuuagacauaccauugaaaauucuaccgcuaacgugagccuggccgcgaucgccaaccaggcuguugugcugaugggacucgacaaaggcuggccgaucuccaagauggaccugggggucccccuucuggcccucggaugcuacucucaggugaauccucugacacugacggcugccguccuccuucugauuacccacuacgccaucauuggccccgggcugcaggcgaaagcuacacgggaggcccaaaagagaaccgcugccggaaucaugaagaacccuacaguggauggcauuaugaccaucgaccucgaucccguuaucuaugacagcaaauucgaaaagcagcugggccaggugaugcuucugguccucugugugguucagcugcugcucaugcgcacguccugggcccuuugcgaggcucugacacuggccaccgggccuauuaccacacucugggaaggaucuccgggcaaauuuuggaauaccacaaucgcggugagcauggccaacauuuuccggggguccuaccuggcuggagccggccuugcuuuuagcaucaugaagucugucgggacgggaaaaagaggcaccggcucccaaggggagacacugggagaaaaguggaagaaaaagcucaaucagcugagccgcaaagauuucgaccuguauaagaaauccggcauuaccgagguggaucggacagaggccaaggaagggcucaaaagaggagagaucacccaucacgcggugucucggggcagcgccaaacuucagugguuuguugaacgcaacauggucauucccgaggggagagugaucgaccugggauguggccggggcgggugguccuacuauugcgcuggacugaagaaagugacggaaguccgcggcuacaccaaagggggaccuggccacgaggagcccguuccuaugucuacauauggguggaauaucgugaaacucaugagcggaaaggauguguucuaccugcccccggaaaaaugugacacccuucugugcgauauuggcgaguccagcccuucucccacagucgaagaguccagaaccauccgggugcucaagaugguugagcccuggcugaagaacaaucaguucuguauuaaagugcugaacccuuacaugcccacagucaucgaacaucucgagcgccuucaaagaaagcacggcgggaugcuggugcggaauccucugagccgcaacucuacccaugaaauguauuggauuuccaauggaacgggcaacaucguugccagcgugaauauggucucuagacuccugcuuaaccgguuuacaaugacccacagacgcccgaccaucgagaaagacguggaucugggggcuggaacacggcacgugaacgccgaacccgagacgccuaauauggacgucauuggcgagagaaucaagcgcauuaaagaggaacacaacagcaccuggcacuacgacgaugaaaaucccuauaagacaugggcuuaccauggguccuaugagguuaaggccaccggaucugcgagcuccaugaucaacggcguggugaaacuccugacaaagccuugggacgucgugcccaugguuacccagauggccaugacagauaccacgccguucggccagcaacggguguuuaaagaaaaggucgacaccagaacaccucgcagcaugcccgggacccggagagugaugggaauuacagcugaguggcuguggcgcacccucggccggaauaaaaagccuagacugugcacgcgcgaggaguucacaaagaaaguucggaccaacgccgcuaugggggccguguuuacagaggaaaaucagugggauuccgccaaggcggcugucgaggacgaagauuucuggagacuuguggaccgcgagagagagcugcacaaacucggaaaguguggcucuugcguuuacaacaugauggggaaacgggaaaagaaacugggcgaguuuggaaaggccaagggcagccgcgccaucugguauauguggcuuggggcuagauaccuggaguucgaggcccucggauuucugaaugaggaucauugguucucccgggaaaacucuuacagcggcguggagggggaaggacugcacaaacucggcuauauccugagagacauuuccaagauccccgggggcgcuauguacgccgaugacaccgcgggaugggacacgcggauuaccgaggaugaccuucacaaugaagagaaaaucacacagcagauggauccugagcaucgccaacuggccaacgcuauuuuuaagcucaccuaucagaauaaagucgugaagguccagagacccacaccgaccggcacagugauggacaucaucucucggaaggaucagcgcgggagcggacaaguuggcaccuacgggcugaacacguucacaaauauggaagcccagcuuauuagacagauggagggagaaggcgugcuguccaaagcugaccucgagaacccucaucugcccgaaaagaaaaucacccaguggcuggagaccaagggggucgagcggcucaaacgcauggccauuagcggcgaugacugcguggugaagcccaucgaugacagauuugcgaacgcccugcuugcucugaaugauaugggaaagguucggaaagacauuccucaauggcagccgucuaagggcuggcaugauuggcaacaggugcccuucuguucccaccacuuccaugaacucaucaugaaagacgggcgcaagcuggucgugccuugcagaccccaagacgagcuuauuggacgggcccgcaucagccagggcgcuggguggucucugaaagaaacagccugucucggaaaggcuuaugcccagauguggucccugauguacuuucacagacgggaucugcgccucgcgagcaacgccaucugcucugcuguuccugugcauuggguccccaccuccagaacaacguggagcauucacgcccaucaccaauggaugaccacagaggacaugcugaccguguggaaucgggucuggaucgaagauaacccuuggauggaggacaagacacccgugaccacgugggagaauguuccguaucuuggcaaaagagaagaucaguggugugggucccugauuggccucaccagccgcgccacaugggcucagaacaucccuaccgccauucagcaagugcggucucugaucggaaaugaggaguuccuugacuacaugcccagcaugaagagauuucgcaaagaggaggaauccgagggcgcgaucugguga

SEQ ID NO: 20563 - RNA, 9870 nt, Artificial Sequence
  derived and/or modified CDS sequence (opt5) from DENV-3__HM631856__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcucggggggccagacgcauggcuauccuuggagacaccgccugggauuucggcuccguggggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacaugggguguguggucaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccaaggagcugaaauacucuuggaagaccugggggaaggccaaaauugucacagccgaaacccaaaacuccagcuucaucauugauggaccuaauacacccgagugcccgucuguguccagagcuuggaacgugugggaagucgaggacuauggcuuuggcguuuucaccacgaauaucuggcucaagcugcgcgaaguguacacacagcugugugaccaccggcuuaugagcgcggccgugaaagaugagagagcuguccacgccgacaugggguacuggaucgagucccagaagaacggaucuuggaaacucgaaaaggccagccugauugaggugaagaccugcaccuggccuaaaucccauacacuguggucuaauggcguucucgaaagcgauaugaucauucccaagucccuggcugggccuaucagccagcacaaccaucgccccggauaucacacccaaacggccggcccuuggcaccuugggaaacuggagcucgacuuuaauuacugcgagggaacaaccguggucauuacagaaaacuguggcacccggggccccucucugagaacaaccacgguguccgggaagcugauccaugaguggugcugucgcagcugcacccuuccgccucuccgguauaugggagaagauggcuguugguacgggauggagaucagacccauuucugaaaaagaggagaauaugguuaagucccuggugagcgcgggaucuggcaaggucgacaacuucacaaugggggugcugugccucgcuauccuguuugaagagguuaugcggggaaaauucggcaagaaacacaugauugccggcguguucuuuaccuucguccuucugcucagcgggcagaucacauggcgcgauauggcccauacccugauuaugaucggauccaaugcuagcgacagaaugggcaugggggugacguaucuggcccuuauugcgacauuuaagauccagcccuuccuggcucucggauuuuuccugcggaaacucaccucuagagaaaaccugcuucugggcguggggcucgccauggccacaacccugcaacugccugaggauaucgaacagauggcuaauggaauugcccuuggccugauggcucucaagcugaucacccaguuugagacauaccagcucuggacggcccugauuucccuuaccuguagcaacacaaucuucacccugacagucgcguggcgcaccgccacgcucauucuggcuggcguuucccugcuuccggugugccaaucuagcuccaugcggaagacagacuggcugcccauggccguggcugccaugggggucccuccccucccucuguuuaucuucucucucaaagauacccugaagagacgcagcuggccccuuaaugagggagugauggccguuggccugguguccauccuggcuucuagccuccugagaaacgacgucccuauggcggggccccuuguggccggaggccugcucauugcuuguuauguuaucaccgggacauccgccgaucugaccguggaaaaagccgcugacauuacaugggaggaagaggccgaacagacgggagucagccacaaccucaugaucaccguggacgaugacggcacaaugcggauuaaggaugacgagaccgagaauauccugacaguccuucugaaaaccgcgcugcucaucgugucuggcauuuuuccguacuccaucccugcuacgcugcuuguuuggcauaccuggcagaagcagacacaacgcagcggggugcugugggauguccccucuccucccgaaacccagaaagccgagcucgaagagggaguguacagaauuaagcagcagggcaucuucgggaagacacaaguuggagugggcguccagaaagaggggguguuucacaccauguggcacgugacacggggagccguucugacguauaacggcaagcgccucgaaccgaauugggcuuccgucaaaaaggaccugauuagcuacggcgggggauggagacuuucugcccaguggcaaaaaggcgaggaagugcaggugaucgcggucgagccugggaagaaccccaagaauuuccagaccaugccuggaacauuccagaccaccacaggcgaaauuggggcuaucgcccuggauuuuaaacccggaacguccggcagccccaucauuaaccgggagggcaaggugguugggcuguauggaaauggcguggucaccaaaaacgggggauacguguccggcaucgcccaaacaaaugcugagccugacgggccgacccccgaacucgaggaagagauguuccgcaagagaaaccugacaauuauggaucuucauccuggcagcggaaaaacccggaaguaucugcccgccaucguucgcgaagcuauuaagagacggcucagaacgcugauccucgccccuacacgcguggucgcggccgagauggaggaagcucugaaaggccuucccauccgguaccagaccaccgccacaaagucugagcacaccgggagagaaauuguggaccugaugugccaugcuacauuuaccaugcgccugcucagcccuguucgggugccgaauuauaaccugaucauuauggaugaggcccacuucacggaccccgccuccaucgcugcgagaggauacauuucuacacgcgucggcaugggggaagccgcugccaucuuuaugaccgccacaccucccggaaccgcugaugccuucccucagagcaaugcgcccauccaggacgaggagcgggacauuccggaaagauccuggaacucuggcaaugaguggaucacggauuuugcugggaaaaccgugugguucgugccuagcauuaaggccggcaacgacaucgccaacugucuucgcaaaaauggaaagaaggucauucaacugucccggaaaacauuugauaccgaauaccagaagacaaaacucaacgacugggauuucguugugaccacagacaucucugagaugggcgcuaauuuuaaggccgauagagugauugacccccggcgcugccugaaacccgucauccugaccgaugggccugagagagugauccucgcgggacccaugccuguuacggccgcuagcgccgcucagcggcgcggcagaguggggcggaacccgcagaaggaaaaugaccaauauauuuucacaggacagccccuuaacaaugaugaggaccaugcccacuggaccgaagcuaagaugcugcuggacaacaucaauaccccugagggcauuauccccgcccucuucgaaccugagagagagaaauccgcggccauugauggggaauaccgccugaagggcgagagccggaaaacauuugucgaacuuaugagacgcggagaccugcccguguggcucgcucacaagguugccucugagggcaucaaauauaccgaucggaaguggugcuucgacgggcagagaaacaaucagauccuggaagagaacauggauguggagauuuggacaaaagaaggagagaagaagaaacugcgcccgcgguggcucgacgcuagaacguacuccgauccucuugcccugaaggaauuuaaagaguucgccgcuggccgcaagagcaucgcgcuggaccucgucaccgaaauugggagagugcccucucaucuggcccaccggacacgcaaugcucuugauaaccuggucaugcuccauaccuccgagcacggaggcagagccuaucggcacgccguggaggaacugccugagacaauggaaacccugcuccuucugggccugaugauccuccugacggggggagcuaugcuuuuucugauuagcggcaaagggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaagcagcgcacaccgcaggacaaucaacuggccuacgucguuauuggaauccucacccuggcugccaucauugcggccaacgaaaugggccuucuggagacaaccaaaagagaucucggcaugagcaaggaaccugggguggugucucccacguccuaucuggacgucgaucugcaucccgcuagcgccuggacacucuacgcuguggccaccacaguuaucaccccuaugcuucggcacaccauugagaauucuacagcuaacgugagccuggccgcgaucgccaaccaggcugucgugcugaugggacucgacaaaggcuggccgauuuccaagauggaccugggggucccccuucuggcccucggaugcuacucucaggugaauccucugacgcugaccgcugccguucuccuucugaucacacauuaugccaucauuggccccgggcugcaggcgaaagcuaccagagaggcccaaaagcgcacagcugccggaaucaugaagaacccuaccguggauggcauuaugacgaucgaccucgaucccgucauuuacgacagcaaauucgaaaagcagcugggccaggugaugcuucugguucucugugccgugcagcugcugcucaugcggacauccugggcucuuugcgaggcccugacccuggcgaccgggccuaucacaacccucugggaaggaucuccgggcaaauuuuggaauacaacgaucgccgucagcauggcuaacauuuucagaggguccuaucuggccggagcuggccuugccuuuagcaucaugaagucuguggggaccggaaaacgcggcacaggcucccaaggggagacccugggagaaaaguggaagaaaaagcucaaucagcugagccggaaagauuucgaccuguacaagaaauccggcauuacagagguggauagaaccgaggcgaaggaagggcucaaacggggagagaucacgcaccaugccguuucucgcggcagcgcuaagcuucagugguuugucgaaagaaacauggugauucccgaggggcgggugaucgaccugggauguggccgcggcgggugguccuauuacugcgccggacugaagaaagucaccgaaguuagaggcuauacaaaggggggaccuggccacgaggagcccgugccuaugucuaccuacggguggaauauugugaaacucaugagcggaaaggaugucuucuaccugcccccggaaaaaugugacacacuucugugcgauaucggcgaguccagcccuucucccaccguggaagagucccggacaauccgcguucucaagaugguggagcccuggcugaagaacaaucaguucuguauuaaaguccugaacccuuauaugcccaccgugaucgaacaccucgagagacuucaacggaagcauggcgggaugcugguucgcaauccucugagcagaaacucuacgcacgaaauguacuggauuuccaauggaacaggcaacaucguggcuagcgucaauauggugucucggcuccugcuuaacagauuuaccaugacccaucgccggccgacaauugagaaagacguggaucugggggccggaacgagacacgucaacgcugaacccgagaccccuaauauggacguuaucggcgagcgcaucaagcggauuaaagaagagcacaacagcacauggcauuaugacgaugaaaaucccuacaagaccugggccuaucacggguccuacgaggugaaggcgacaggaucugccagcuccaugaucaacggcguggucaaacuccugaccaagccuugggacgugguucccauggugacacagauggcuaugaccgauacgaccccguucggccagcaaagagucuuuaaagaaaagguggacacacgcaccccucggagcaugcccgggacaagacgcguuaugggaauuaccgccgaguggcuguggcggacgcucggcagaaauaaaccucgccugugcacacgggaggaauucaccaagaaggugagaacaaacgcugccaugggggccgucuuuaccgaggaaaaucagugggauuccgcgaaagcugccguggaggacgaagauuucuggaagcuuguugaccgcgagagagagcugcauaaacucggaaaguguggcucuugcguguauaacaugauggggaaacgggaaaagaaacugggcgaguuuggaaaggccaagggcagccgcgcuaucugguacauguggcuuggggccagauaccuggaauucgaggcucucggauuucugaaugaggaucacugguucucccgggaaaacucuuauagcggcgucgagggggaaggacugcauaaacucggcuacauucugagagacaucuccaagauccccgggggcgccauguaugcggaugacacggccggaugggacacccggauuacagaggaugaccuucacaaugaagagaaaaucacccagcagauggauccugagcaccgccaacuggcuaacgccauuuuuaagcucacauaccagaauaaaguggucaaggugcagagacccaccccgacaggcaccguuauggacaucauuucucggaaggaucagcgcgggagcggacaagugggcacguaugggcugaacacauucaccaauauggaagcucagcuuaucagacagauggagggagaaggcguccuguccaaagccgaccucgagaacccucaucugcccgaaaagaaaaucacccaguggcuggagacaaaggggguggagcggcucaaacgcauggcgauuagcggcgaugacugcgugguuaagcccaucgaugacagauuugccaacgcucugcuugcccugaaugauaugggaaaggugcggaaagacauuccucaauggcagccgucuaagggcuggcacgauuggcagcagguccccuucuguucccaucacuuccacgaacucaucaugaaagacgggcgcaagcuggugguuccuugcagaccccaagacgagcuuauuggacgggcucgcaucagccagggcgccggguggucucugaaagaaaccgcuugucucggaaaggccuacgcgcagauguggucccugauguauuuucauagacgggaucugcgccucgccagcaacgcuauuugcucugccgugccuguccacugggugcccacauccagaacgaccuggagcauccaugcccaccaucaauggaugacaaccgaggacaugcugacagucuggaaucggguguggaucgaagauaacccuuggauggaggacaagacccccguuacgaccugggagaaugugccguaccuuggcaaaagagaagaucaguggugugggucccugauuggccucacaagccgcgcuaccugggcccagaacaucccuacagcgauucagcaaguccggucucugaucggaaaugaggaauuccuugacuacaugcccagcaugaagagauuucgcaaagaggaggaauccgagggcgcuauuugguga

SEQ ID NO: 20564 - RNA, 9873 nt, Artificial Sequence
  derived and/or modified CDS sequence (opt5) from DENV-3__HM756276__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucauguggggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacaugggguguguggucaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucuguguccagagcuuggaacgugugggaagucgaggacuauggcuuuggcguuuucaccacgaauaucuggcucaaacugcgcgaaguguacacacagcugugugaccaccggcuuaugagcgcggccgugaaggaugagagagcuguccacgccgacaugggguacuggaucgagucccagaaaaacggaucuuggaagcucgaaaaagccagccugauugaggugaagaccugcaccuggccuaagucccauacacuguggucuaauggcguucucgaaagcgauaugaucauucccaaaucccuggcugggccuaucagccagcacaaccaucgccccggauaucacacccaaacggccggcccuuggcaccuugggaagcuggagcucgacuuuaauuacugcgagggaacaaccguggucauuacagaaaacuguggcacccggggccccucucugagaacaaccacgguguccgggaaacugauccaugaguggugcugucgcagcugcacccuuccgccucuccgguauaugggagaagauggcuguugguacgggauggagaucagacccauuucugaaaaggaggagaauaugguuaaaucccuggugagcgcgggaucuggcaaggucgacaacuucacaaugggggugcugugccucgcuauccuguuugaagagguuaugcggggaaaguucggcaaaaagcacaugauugccggcguguucuuuaccuucguccuucugcucagcgggcagaucacauggcgcgauauggcccauacccugauuaugaucggauccaaugcuagcgacagaaugggcaugggggugacguaucuggcccuuauugcgacauuuaaaauccagcccuuccuggcucucggauuuuuccugcggaagcucaccucuagagaaaaccugcuucugggcguggggcucgccauggccacaacccugcaacugccugaggauaucgaacagauggcuaauggaauugcccuuggccugauggcucucaaacugaucacccaguuugagacauaccagcucuggacggcccugauuucccuuaccuguagcaacacaaucuucacccugacagucgcguggcgcaccgccacgcucauucuggcuggcguuucccugcuuccggugugccaaucuagcuccaugcggaagacagacuggcugcccauggccguggcugccaugggggucccuccccucccucuguuuaucuucucucucaaggauacccugaaaagacgcagcuggccccuuaaugagggagugauggccguuggccugguguccauccuggcuucuagccuccugagaaacgacgucccuauggcggggccccuuguggccggaggccugcucauugcuuguuauguuaucaccgggacauccgccgaucugaccguggaaaaggccgcugacauuacaugggaggaagaggccgaacagacgggagucagccacaaccucaugaucaccguggacgaugacggcacaaugcggauuaaagaugacgagaccgagaauauccugacaguccuucugaagaccgcgcugcucaucgugucuggcauuuuuccguacuccaucccugcuacgcugcuuguuuggcauaccuggcagaaacagacacaacgcagcggggugcugugggauguccccucuccucccgaaacccagaaggccgagcucgaagagggaguguacagaauuaaacagcagggcaucuucgggaagacacaaguuggagugggcguccagaaggaggggguguuucacaccauguggcacgugacacggggagccguucugacguauaacggcaaacgccucgaaccgaauugggcuuccgucaagaaagaccugauuagcuacggcgggggauggagacuuucugcccaguggcaaaagggcgaggaaguccaggugaucgcggucgagccugggaaaaaccccaagaauuuccagaccaugccuggaacauuccagaccaccacaggcgaaauuggggcuaucgcccuggauuuuaagcccggaacguccggcagccccaucauuaaccgggagggcaaagugguugggcuguauggaaauggcguggucaccaagaacgggggauacguguccggcaucgcccaaacaaaugcugagccugacgggccgacccccgaacucgaggaagagauguucaaaaagcgcaaccugacaauuauggaucuucauccuggcagcggaaaaaccagaaaguaucugcccgccaucguucgggaagcuauuaagcgcagacuccggacgcugauccucgccccuacaagaguggucgcggccgagauggaggaagcucugaaaggccuucccauccgcuaccagaccaccgccacaaagucugagcacaccgggcgggaaauuguggaccugaugugccaugcuacauuuaccaugagacugcucagcccuguucgcgugccgaauuauaaccugaucauuauggaugaggcccacuucacggaccccgccuccaucgcugcgcggggauacauuucuacaagagucggcaugggggaagccgcugccaucuuuaugaccgccacaccucccggaaccgcugaugccuucccucagagcaaugcgcccauccaggacgaggagcgcgacauuccggaacgguccuggaacucuggcaaugaguggaucacggauuuugcugggaaaaccgugugguucgugccuagcauuaaggccggcaacgacaucgccaacugucuucgcaaaaauggaaagaaggucauucaacuguccagaaaaacauuugauaccgaauaccagaagacaaaacucaacgacugggauuucguugugaccacagacaucucugagaugggcgcuaauuuuaaggccgaucgggugauugaccccagacggugccugaaacccgucauccugaccgaugggccugagcgcgugauccucgcgggacccaugccuguuacggccgcuagcgccgcucagagacggggccgcguggggagaaacccgcagaaggaaaaugaccaauauauuuucacaggacagccccuuaacaaugaugaggaccaugcccacuggaccgaagcuaagaugcugcuggacaacaucaauaccccugagggcauuauccccgcccucuucgaaccugagcgggagaaauccgcggccauugauggggaauacagacugaagggcgagagccgcaaaacauuugucgaacuuaugcggagaggagaccugcccguguggcucgcucacaagguugccucugagggcaucaaauauaccgaucgcaaguggugcuucgacgggcagcggaacaaucagauccuggaagagaacauggauguggagauuuggacaaaagaaggagagaagaagaaacugagaccgcgcuggcucgacgcucggacguacuccgauccucuugcccugaaggaauuuaaagaguucgccgcuggcagaaagagcaucgcgcuggaccucgucaccgaaauugggcgcgugcccucucaucuggcccacagaacacggaaugcucuugauaaccuggucaugcuccauaccuccgagcacggaggccgcgccuauagacacgccguggaggaacugccugagacaauggaaacccugcuccuucugggccugaugauccuccugacagggggagcuaugcuuuuucugauuagcggcaaagggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaagcagcggacaccgcaggacaaucaacuggccuacgucguuauuggaauccucacccuggcugccaucauugcggccaacgaaaugggccuucuggagacaaccaaacgcgaucucggcaugagcaaggaaccugggguggugucucccacguccuaucuggacgucgaucugcaucccgcuagcgccuggacacucuacgcuguggccaccacaguuaucaccccuaugcuuagacacaccauugaaaauucuacagcuaacgugagccuggccgcgaucgccaaccaggcugucgugcugaugggacucgacaaaggcuggccgauuuccaagauggaccugggggucccccuucuggcccucggaugcuacucucaggugaauccucugacgcugaccgcugccguucuccuucugaucacacauuaugccaucauuggccccgggcugcaggcgaaagcuacccgggaggcccaaaagagaacagcugccggaaucaugaagaacccuaccguggauggcauuaugacgaucgaccucgaucccgucauuuacgacagcaaauucgaaaagcagcugggccaggugaugcuucugguucucugugccgugcagcugcugcucaugcgcacauccugggcucuuugcgaggcccugacccuggcgaccgggccuaucacaacccucugggaaggaucuccgggcaaauuuuggaauacaacgaucgccgucagcauggcuaacauuuuccggggguccuaucuggccggagcuggccuugccuuuagcaucaugaagucuguggggaccggaaaaagaggcacaggcucccaaggggagacccugggagaaaaguggaagaaaaagcucaaucagcugagccgcaaagauuucgaccuguacaagaaauccggcauuacagagguggaucggaccgaggcgaaggaagggcucaaaagaggagagaucacgcaccaugccguuucucggggcagcgcuaaacuucagugguuugucgaacgcaacauggugauucccgaggggagagugaucgaccugggauguggccggggcgggugguccuauuacugcgccggacugaagaaagucaccgaaguucgcggcuauacaaaagggggaccuggccacgaggagcccgugccuaugucuaccuacggguggaauauugugaaacucaugagcggaaaggaugucuucuaccugcccccggaaaaaugugacacacuucugugcgauaucggcgaguccagcccuucucccaccguggaagaguccagaacaauccggguucucaagaugguggagcccuggcugaagaacaaucaguucuguauuaaaguccugaacccuuauaugcccaccgugaucgaacaccucgagcgccuucaaagaaagcauggcgggaugcugguucggaauccucugagccgcaacucuacgcacgaaauguacuggauuuccaauggaacaggcaacaucguggcuagcgucaauauggugucuagacuccugcuuaaccgguuuaccaugacccauagacgcccgacaauugagaaagacguggaucugggggccggaacgcggcacgucaacgcugaacccgagaccccuaauauggacguuaucggcgagagaaucaagcgcauuaaagaagaacacaacagcacauggcauuaugacgaugaaaaucccuacaagaccugggccuaucacggguccuacgaggugaaggcgacaggaucugccagcuccaugaucaacggcguggucaaacuccugaccaagccuugggacgugguucccauggugacacagauggcuaugaccgauacgaccccguucggccagcaacgggucuuuaaagaaaagguggacacaagaaccccucgcagcaugcccgggacacggagaguuaugggaauuaccgccgaguggcuguggcgcacgcucggccggaauaaaaagccuagacugugcacacgcgaggaguucaccaagaaagugcggacaaacgcugccaugggggccgucuuuaccgaggaaaaucagugggauuccgcgaaggcugccguggaggacgaagauuucuggaaacuuguugacagagagcgcgagcugcauaagcucggaaaauguggcucuugcguguauaacaugauggggaagagagagaagaagcugggcgaguuuggaaaggccaaaggcagccgggcuaucugguacauguggcuuggggcccgcuaccuggaguucgaggcucucggauuucugaaugaggaucacugguucuccagagaaaacucuuauagcggcgucgagggggaaggacugcauaagcucggcuacauucugcgggacaucuccaaaauccccgggggcgccauguaugcggaugacacggccggaugggacaccagaauuacagaggaugaccuucacaaugaagagaagaucacccagcagauggauccugagcaccggcaacuggcuaacgccauuuuuaaacucacauaccagaauaagguggucaaggugcagcgccccaccccgacaggcaccguuauggacaucauuucuagaaaagaucagcgggggagcggacaagugggcacguaugggcugaacacauucaccaauauggaagcucagcuuauccgccagauggagggagaaggcguccuguccaaggccgaccucgagaacccucaucugcccgagaagaagaucacccaguggcuggagacaaaagggguggagagacucaagcggauggcgauuagcggcgaugacugcgugguuaagcccaucgaugaccgcuuugccaacgcucugcuugcccugaaugauaugggaaaagugagaaaggacauuccucaauggcagccgucuaaaggcuggcacgauuggcagcagguccccuucuguucccaucacuuccacgaacucaucaugaaggacgggcggaaacuggugguuccuugccgcccccaagacgagcuuauuggacgggcucggaucagccagggcgccggguggucucugaaggaaaccgcuugucucggaaaggccuacgcgcagauguggucccugauguauuuucaucgcagagaucugcggcucgccagcaacgcuauuugcucugccgugccuguccacugggugcccacaucccgcacgaccuggagcauccaugcccaccaucaauggaugacaaccgaggacaugcugacagucuggaauagaguguggaucgaagauaacccuuggauggaggacaaaacccccguuacgaccugggagaaugugccguaccuuggcaagcgggaagaucaguggugugggucccugauuggccucacaagcagagcuaccugggcccagaacaucccuacagcgauucagcaaguccgcucucugaucggaaaugaggaguuccuugacuacaugcccagcaugaaacgguuuagaaaggaggaggaauccgagggcgcuauuugguga

SEQ ID NO: 20565 - RNA, 9873 nt, Artificial Sequence
  derived and/or modified CDS sequence (opt5) from DENV-3__HM756279__SS-prME
acaagccugugccucaugaugauccugcccgccgcucuugccuuccaccugacauccagagacggagaaccucggaugauuguggggaagaaugaacgcggaaaaucucuccuguuuaagacggcgagcggaaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggcggcaaguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauacagugaucgggauuggcgauaacgcccugaaaaucaauugguauaagaagggaucuagcaucggcaaaauguuugaagccaccgcuagaggggccagacgcauggcuauucuuggagacaccgccugggauuucggcuccgucgggggaguucucaacagccugggcaagaugguccaccagaucuuugggucugcguacacagcccuguucuccggcgugagcugggugaugaaaauuggaaucggcguccuccugaccuggauugggcuuaauucuaagaacacaagcauguccuuuucuugcaucgcuauuggaaucaucacgcuguaucucggcgccgugguucaggcugacauggggugugugauuaauuggaaaggaaaggagcugaagugcggcagcgggaucuucgucaccaacgaggugcauacauggaccgaacaguacaaauuucaagccgauucccccaagcggcuggcgacagccauugcuggcgccugggagaauggaguuuguggcaucagaagcaccacgcgcauggaaaaccuucucuggaaacagauugcuaaugagcugaacuauauccugugggaaaauaacaucaagcucaccguggucgugggggacauuaucggaguucuggagcagggcaaacggacacuuaccccucagcccauggagcugaaguacucuuggaaaacaugggggaaggccaagauugugaccgccgaaacacaaaacuccagcuucaucauugauggaccuaauacccccgagugcccgucugucuccagagcuuggaacgugugggaaguggaggacuauggcuuuggcgucuucacgacaaauaucuggcucaaacugcgcgaaguuuacacccagcugugugaccaccggcuuaugagcgcggccgugaaggaugagagagcugugcacgccgacaugggguacuggaucgagucccagaaaaacggaucuuggaagcucgaaaaagccagccugauugaggucaagaccugcacauggccuaagucccauacccuguggucuaauggcgugcucgaaagcgauaugaucauucccaaaucccuggcugggccuaucagccagcacaaccaucgccccggauaucacacgcaaacagccggcccuuggcaccuugggaagcuggagcucgacuuuaauuacugcgagggaaccacaguugugauuaccgaaaacuguggcacacggggccccucucugagaaccacgaccgucuccgggaaacugauccaugaguggugcugucgcagcugcacacuuccgccucuccgguauaugggagaagauggcuguugguacgggauggagaucagacccauuucugaaaaggaggagaauauggugaaaucccugguuagcgcgggaucuggcaagguggacaacuucaccauggggguccugugccucgcuauccuguuugaagaggugaugcggggaaaguucggcaaaaagcacaugauugccggcguuuucuuuacauucgugcuucugcucagcgggcagaucaccuggcgcgauauggcccauacgcugauuaugaucggauccaaugcuagcgacagaaugggcaugggggucacauaucuggcccuuauugcgaccuuuaaaauccagcccuuccuggcucucggauuuuuccugcggaagcucacaucuagagaaaaccugcuucugggcguggggcucgccauggccaccacccugcaacugccugaggauaucgaacagauggcuaauggaauugcccuuggccugauggcucucaaacugaucacacaguuugagacguaccagcucuggaccgcccugauuucccuuacauguagcaacaccaucuucacacugaccguggcguggcgcacggccacacucauucuggcuggcgucucccugcuuccgguuugccaaucuagcuccaugcggaagaccgacuggcugcccauggccguggcugccaugggggugccuccccucccucuguuuaucuucggacucaaggauacccugaaaagacgcucuuggccccuuaaugagggcgucauggccguggggcugguuagcauccuggcuuccucucuccugagaaacgacgugccuauggcgggaccccuugucgccggcgggcugcucauugcuuguuaugugaucacaggaaccagcgccgaucugacaguugaaaaggccgcugacauuacgugggaggaagaggccgaacagaccggcgugucccacaaccucaugaucacagucgacgaugacggcaccaugcggauuaaagaugacgagacagagaauauccugaccgugcuucugaagacggcgcugcucaucgucagcgggauuuuuccguacucuaucccugcuacccugcuuguguggcauacauggcagaaacagacccaacgcuccggaguucugugggaugugcccagcccucccgaaacacagaaggccgagcucgaagagggcgucuacagaauuaaacagcaggggaacuucugggagacccaagugggaguuggcgugcagaaggaaggggucuuucacacaauguggcacgugacgcggggagccgugcugaccuauaauggcaagcgccucgagccgaacugggcuucuguuaaaaaggaccugaucuccuacggcgggggauggagacuuagcgcccaguggcaaaaaggcgaagagguccaggugauugcgguggaaccugggaagaaucccaaaaacuuccagacaaugccuggaaccuuccagaccacaacgggcgagaucggggcuauugcccuggauuuuaagcccggaaccucuggcucccccaucaucaaucgggagggcaaggucguggggcuguauggaaacggcguugugaccaagaaugggggauacgucagcggcauugcccaaaccaacgcugaaccugacgggccgacacccgagcucgaagaggaaauguucaagaaacgcaaucugaccaucauggaucuucauccuggcuccggaaagacgagaaaauaucugcccgccauugugcgggaggcuaucaagcgcagacuccggacacugauucucgccccuaccagaguuguggcggccgagauggaagaggcucugaagggccuucccauccgcuaccagaccacagccaccaaaagcgaacacacagggcgggagaucgucgaccugaugugccaugcuaccuuuacgaugagacugcucucuccugugcgcguuccgaacuauaaucugauuaucauggaugaagcccacuucacagaccccgccagcauugcugcgcggggauacaucuccaccagagugggcaugggggaggccgcugccauuuuuaugacagccaccccucccggaacggcugaugccuucccucagucuaacgcgcccauccaggacgaggaacgcgacaucccggagcggagcuggaacuccggcaacgaauggauuaccgauuuugcugggaagacagucugguucgugccuucuaucaaagccggcaacgacauugccaauugucuuagaaagaacggcaaaaaggugauccaacugagccgcaagaccuuugauacagaguaccagaaaaccaagcucaaugacugggauuucgucguuacaaccgacauuuccgagaugggagcuaacuuuaaagccgaucgggugaucgaccccagacggugccugaagcccgugauucugacggaugggccugaacgcgucauccucgcgggacccaugccugugacagccgcuucugccgcucagagacggggccgcguugggagaaauccgcagaaagagaacgaccaauauaucuucaccggacagccccuuaauaacgaugaagaccaugcccacuggaccgaggcuaagaugcugcuggacaauauuaacacaccugaaggcaucauucccgcccucuucgagccugagcgggaaaagagcgcggccaucgauggggaguacagacugaaaggcgaaucccgcaagaccuuuguggagcuuaugcggagaggagaccugacagucuggcucgcucacaaaguggccagcgaaggcauuaaguauacggaucgcaaauggugcuucgacgggcagcggaauaaccagauccuggaggagaauauggauguugaaaucuggaccaaggagggagagaaaaagaagcugagaccccgcuggcucgacgcucggacauacucugauccgcuugcccugaaagaguuuaaggaguucgccgcuggcagaaaauccauugcgcuggaccucgugaccgagaucgggcgcgucccuagccaucuggcccacagaacacggaacgcucuugauaaucuggugaugcuccauaccucugagcacggaggccgcgccuauagacacgccgucgaagaacugcccgaaacgauggagacccugcuccuucugggccugaugauucuccugacagggggagcuaugcuuuuucugaucuccggcaaggggauuggaaaaaccagcaucggccucaucugugugauugccuccucugggaugcuguggauggcggagaucccucugcaauggauugccagcgcuaucguucucgaguucuuuaugauggugcuucugauucccgagccugaaaagcagcggacaccccaggacaaccaacuggccuacguggucaucggcauucucacccuggcugccaucaucgcggccaaugagaugggccuucuggaaacgacaaagcgcgaucucggcauguccaaagagccggggguugugagcccuaccucuuaucuggacguggaucugcaucccgcuuccgccuggacacucuacgcugucgccaccaccgugauuacacccaugcuuagacacacgaucgagaacagcaccgcuaacguuucucuggccgcgauugccaaucaggcugugguccugaugggacucgacaagggcuggccuaucagcaaaauggaccugggggugccgcuucuggcccucggaugcuacucccaggucaacccccugacacugaccgcugccgugcuccuucugauuacacauuaugccaucaucggcccugggcugcaggcgaaggcuacccgggaagcccagaaacggacggcugccggaauuaugaagaaucccacaguugauggcaucaugaccauugaccucgauccugugaucuacgacucuaaguucgagaaacagcugggccaggucaugcuucuggugcucugugccguucagcugcugcucaugcgcaccagcugggcucuuugcgaagcccugacacuggcgaccgggcccauuacaacgcucugggagggauccccuggcaaguuuuggaacaccacaaucgccgugucuauggcuaauaucuuccgggggagcuaucuggccggagcuggccuugccuuuuccauuaugaaaagcgucgggaccggaaagagaggcacaggcucucaaggggaaacccugggagagaaauggaagaagaaacucaaccagcugucccgcaaggauuucgaccuguacaaaaagagcggcaucacggagguggaucggaccgaagcgaaagaggggcucaagagaggagaaauuacacaccaugccgugucccggggcucugcuaaacuucagugguuuguugagcgcaauauggucaucccggaagggagagugauugaccugggauguggccggggcggguggagcuauuacugcgccggacugaagaaggugaccgagguccgcggcuauacaaaagggggacccggccacgaggaaccuguucccauguccaccuacggguggaacaucgugaagcucaugucuggaaaagauguguucuaccugccucccgagaagugugacacacuucugugcgauauuggcgaaagcuccccgagcccuaccgucgaggagucuagaacgauccgggugcucaaaaugguugaacccuggcugaagaauaaccaguucuguaucaaggugcugaaucccuauaugccuacagucauugagcaccucgaacgccuucaaagaaaacauggcgggaugcuggugcggaacccccugucccgcaauagcacccacgagauguacuggaucucuaacggaaccggcaauauuguugcuuccgugaacauggucagcagacuccugcuuaaccgguuuacaaugacgcauagacgcccuaccaucgaaaaggacguggaucugggggccggaacacggcacgugaaugcugagccggagacccccaacauggacgucauuggcgaaagaaucaaacgcaucaaggaggaacacaauucuacauggcauuaugacgaugagaacccuuacaaaaccugggccuaucacgggagcuacgaaguuaaggcgacaggauccgccucuagcaugauuaauggcguggugaagcuccugaccaaacccugggacgucgugccuaugguuacgcagauggcuaugaccgauacaacccccuucggccagcaacggguguuuaaggagaaagucgacacaagaaccccgcgcuccaugccugggacgcggagagugaugggaaucacagccgaguggcuguggcgcacccucggccggaacaagaaacccagacugugcacacgcgaagaguucaccaagaagguucggacgaaugcugccaugggggccguguuuaccgaagagaaccagugggauagcgcgaaagcugccgucgaagacgaggauuucuggaaacuuguggacagagagcgcgaacugcauaaacucggaaaguguggcuccugcguuuauaauaugauggggaaaagagagaagaaacugggcgaauuuggaaaggccaagggcucucgggcuauuugguacauguggcuuggggcccgcuaccuggaguucgaggcucucggauuucugaacgaagaucacugguucagcagagaaaauuccuauucuggcguggaaggggagggacugcauaaacucggcuacauccugcgggacauuagcaagaucccugggggcgccauguaugcggaugacacagccggaugggacaccagaaucacagaagaugaccuucacaacgaggagaaaauuacccagcagauggaucccgaacaccggcaacuggcuaaugccaucuuuaagcucacauaccagaacaaagucgugaagguccagcgcccuacccccacgggcacagugauggacauuaucuccagaaaggaucagcgggggucuggacaaguuggcaccuaugggcugaauaccuucacaaacauggaggcucagcuuauucgccagauggaaggagagggcgugcugagcaaagccgaccucgaaaacccgcaucugccugagaagaaaaucacccaguggcuggagacaaagggggucgaaagacucaaacggauggcgaucuccggcgaugacugcguggugaagcccauugaugaccgcuuugccaaugcucugcuugcccugaacgauaugggaaagguuagaaaagacaucccccaauggcagccuagcaagggcuggcacgauuggcaacaggugccguucuguucucaucacuuccacgagcucauuaugaaagacgggcggaagcuggucgugcccugccgcccucaagacgaacuuaucggcagagcucggauuucccagggcgccggguggagccugaaagagacggcuugucucggaaaggccuacgcgcagauguggucucugauguauuuucaucgcagagaucugcggcucgccuccaaugcuaucugcagcgccguucccgugcacugggucccuaccucucgcacaaccugguccauucaugcccaccaucaauggaugacaaccgaagacaugcugacgguguggaacagagucuggaucgaggauaaucccuggauggaggacaagaccccugugacaaccugggaaaacguucccuaccuuggcaaacgggaggaucaguggugugggagccugaucggccucacauccagagcuaccugggcccagaauauuccgacggcgauccagcaagugcgcagccugauuggaaacgaagaguuccuugacuacaugccuucuaugaagcgguuuagaaaagaggaagagagcgaaggcgcuaucugguga

SEQ ID NO: 20566 - RNA, 9873 nt, Artificial Sequence
  derived and/or modified CDS sequence (opt5) from DENV-3__HQ891025__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaaaaggccgcugacaucacaugggaggaagaggccgaacagacgggcgugucccacaaccucaugauuaccgucgacgaugacggcacaaugcggaucaaagaugacgagaccgagaauauccugacagugcuucugaagaccgcgcugcucauugucagcgggaucuuuccguacucuauuccugcuacgcugcuuguguggcauaccuggcagaaacagacacaacgcuccggaguucugugggaugugcccagcccucccgaaacccagaaggccgagcucgaagagggcgucuacagaaucaaacagcaggggauuuucggaaagacacaagugggcguuggggugcagaaggagggagucuuucacaccauguggcacgugacacggggcgccgugcugacguauaacggcaaacgccucgaaccgaauugggcuucuguuaagaaagaccugaucuccuacgggggaggcuggagacuuagcgcccaguggcaaaagggggaggaaguccaggugauugcgguggagccuggcaagaaccccaagaauuuccagaccaugccuggcacauuccagaccaccacaggggaaaucggagcuaucgcccuggauuuuaagcccggcacgucuggcucccccauuaucaaccgggaggggaaagucgugggacuguauggcaaugggguugugaccaagaacggaggcuacgucagcgggauugcccaaacaaaugcugagccugacggcccgacccccgaacucgaggaagagauguucaaaaagcgcaaccugacaaucauggaucuucauccuggauccggcaaaaccagaaaguaucugcccgccauugugcgggaagcuaucaagcgcagacuccggacgcugauccucgccccuacaagaguuguggcggccgagauggaggaagcucugaaagggcuucccauucgcuaccagaccaccgccacaaagagcgagcacaccggacgggaaaucgucgaccugaugugccaugcuacauuuaccaugagacugcucucuccugugcgcguuccgaauuauaaccugauuaucauggaugaggcccacuucacggaccccgccagcauugcugcgcggggcuacaucuccacaagaguggggaugggagaagccgcugccaucuuuaugaccgccacaccucccggcaccgcugaugccuucccucagucuaaugcgcccauucaggacgaggagcgcgacaucccggaacggagcuggaacuccgggaaugaguggauuacggauuuugcuggcaaaaccgucugguucgugccuucuaucaaggccggaaacgacauugccaacugucuucgcaaaaauggcaagaaggugauccaacugagcagaaaaacauuugauaccgaauaccagaagacaaaacucaacgacugggauuucgucguuaccacagacauuuccgagaugggggcuaauuuuaaggccgaucgggugaucgaccccagacggugccugaaacccgugauccugaccgauggaccugagcgcgucauucucgcgggccccaugccugugacggccgcuucugccgcucagagacgggggcgcguuggaagaaacccgcagaaggaaaaugaccaauauaucuucacaggccagccccuuaacaaugaugaggaccaugcccacuggaccgaagcuaagaugcugcuggacaacauuaauaccccugaggggaucauucccgcccucuucgaaccugagcgggagaaaagcgcggccaucgauggcgaauacagacugaagggagagucccgcaaaacauuuguggaacuuaugcggagaggcgaccugcccgucuggcucgcucacaagguggccagcgaggggaucaaauauaccgaucgcaaguggugcuucgacggacagcggaacaaucagauucuggaagagaacauggauguugagaucuggacaaaagaaggcgagaagaagaaacugagaccgcgcuggcucgacgcucggacguacucugauccucuugcccugaaggaauuuaaagaguucgccgcugggagaaaguccauugcgcuggaccucgugaccgaaaucggacgcguccccagccaucuggcccacagaacacggaaugcucuugauaaccuggugaugcuccauaccucugagcacggcggccgcgccuauagacacgccgucgaggaacugccugagacaauggaaacccugcuccuucuggggcugaugauucuccugacgggaggcgcuaugcuuuuucugaucuccgggaaaggaaucggcaagaccagcauugggcucaucugugugauugccuccucuggaaugcuguggauggcggagaucccccugcaauggauugccagcgcuaucguucucgaguucuuuaugauggugcuucugauuccugaacccgagaagcagcggacaccgcaggacaaucaacuggccuacguggucaucggcauccucacccuggcugccauuaucgcggccaacgaaaugggccuucuggagacaaccaaacgcgaucucgggauguccaaggaaccuggaguugugagccccacgucuuaucuggacguggaucugcaucccgcuuccgccuggacacucuacgcugucgccaccacagugauuaccccuaugcuuagacacaccaucgagaauagcacagcuaacguuucucuggccgcgauugccaaccaggcugugguccugaugggccucgacaaaggguggccgaucagcaagauggaccugggagugccccuucuggcccucggcugcuacucccaggucaauccucugacgcugaccgcugccgugcuccuucugaucacacauuaugccauuaucgggcccggacugcaggcgaaagcuacccgggaggcccaaaagagaacagcugccggcauuaugaagaacccuaccguugauggcaucaugacgauugaccucgaucccgugaucuacgacucuaaauucgaaaagcagcuggggcaggucaugcuucuggugcucugugccguucagcugcugcucaugcgcacaagcugggcucuuugcgaggcccugacccuggcgaccggaccuaucacaacccucugggaaggcuccccggggaaauuuuggaauacaacgauugccgugucuauggcuaacaucuuccggggaagcuaucuggccggcgcugggcuugccuuuuccauuaugaaaagcgucggaaccggcaaaagaggcacagggucucaaggagagacccugggcgaaaaguggaagaaaaagcucaaucagcugucccgcaaagauuucgaccuguacaagaaaagcgggaucacagagguggaucggaccgaggcgaaggaaggacucaaaagaggcgagauuacgcaccaugccgugucccgggggucugcuaaacuucagugguuuguugaacgcaacauggucauccccgagggaagagugauugaccugggcuguggcagagggggauggagcuauuacugcgccggccugaagaaagugaccgaaguccgcggguauacaaagggaggcccugggcacgaggagcccguuccuauguccaccuacggauggaauaucgugaaacucaugucuggcaaggauguguucuaccugcccccggaaaaaugugacacacuucugugcgauaucggcgagagcuccccuagccccaccgucgaagagucuagaacaauucgggugcucaagaugguugagcccuggcugaagaacaaucaguucuguaucaaagugcugaacccuuauaugcccaccgucauugaacaccucgagcgccuucaaagaaagcaugggggaaugcuggugcggaauccucugucccgcaacagcacgcacgaaauguacuggaucucuaauggcacagggaacauuguugcuuccgugaauauggucagcagacuccugcuuaaccgguuuaccaugacccauagacgcccgacaaucgagaaagacguggaucugggagccggcacgcggcacgugaacgcugaacccgagaccccuaauauggacgucaucggggagagaauuaagcgcaucaaagaagaacacaacucuacauggcauuaugacgaugaaaaucccuacaagaccugggccuaucacggaagcuacgagguuaaggcgacaggcuccgccucuagcaugauuaacggcguggugaaacuccugaccaagccuugggacgucgugcccaugguuacacagauggcuaugaccgauacgaccccguucgggcagcaacggguguuuaaagaaaaggucgacacaagaaccccucgcuccaugcccggaacacggagagugaugggcaucaccgccgaguggcuguggcgcacgcucgggcggaauaaaaagccuagacugugcacacgcgaggaguucaccaagaaaguucggacaaacgcugccaugggagccguguuuaccgaggaaaaucagugggauagcgcgaaggcugccgucgaggacgaagauuucuggaaacuuguggacagagagcgcgagcugcauaagcucggcaaauguggguccugcguuuauaacaugaugggcaagagagagaagaagcugggagaguuuggcaaggccaaagggucucgggcuauuugguacauguggcuuggagcccgcuaccuggaguucgaggcucucggcuuucugaaugaggaucacugguucagcagagaaaacuccuauucugggguggagggagaaggccugcauaagcucggguacauccugcgggacaucagcaaaauucccggcggagccauguaugcggaugacacggccggcugggacaccagaaucacagaggaugaccuucacaaugaagagaagauuacccagcagauggauccugagcaccggcaacuggcuaacgccaucuuuaaacucacauaccagaauaaggucgugaagguccagcgccccaccccgacagggaccgugauggacauuaucuccagaaaagaucagcggggaucuggccaaguugggacguauggacugaacacauucaccaauauggaagcucagcuuauccgccagauggagggcgaaggggugcugagcaaggccgaccucgagaacccucaucugcccgagaaaaagauuacccaguggcuggagacaaaaggcgucgagagacucaagcggauggcgaucuccggagaugacugcguggugaagcccauugaugaccgcuuugccaacgcucugcuugcccugaaugauaugggcaaaguuagaaaggacaucccucaauggcagccgagcaaaggguggcacgauuggcaacaggugcccuucuguucucaucacuuccacgaacucauuaugaaggacggacggaaacuggucgugccuugccgcccccaagacgagcuuaucggcagagcucggauuucccagggggccggauggagccugaaggaaaccgcuugucucggcaaggccuacgcgcagauguggucucugaugaacuuucaucgcagagaucugcggcucgccuccaaugcuaucugcagcgccguuccugugcacuggguccccacaucucgcacgaccugguccauccaugcccaccaucaauggaugacaaccgaggacaugcugacaguguggaacagagucuggauugaagauaauccuuggauggaggacaaaacccccgugacgaccugggagaacguuccguaucuugggaagcgggaagaucagugguguggcagccugaucggacucacauccagagcuaccugggcccagaauauuccuacagcgauccagcaagugcgcagccugauuggcaacgaggaguuccuugacuacaugcccucuaugaaacgguuuagaaaggaggaggaaagcgagggggcuaucugguga

SEQ ID NO: 20567 - RNA, 9873 nt, Artificial Sequence
  derived and/or modified CDS sequence (opt5) from DENV-3__HQ705617__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcucggggggccagacgcauggcuauccuuggagacaccgccugggauuucggcuccguggggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuucggauccagcccuuccuggcucucggauuuuuccugagaaaacucaccucucgcgaaaaccugcuucugggcguggggcucgccauggccacaacccugcaacugccugaggauauugaacagauggcuaauggaaucgcccuuggccugauggcucucaagcugauuacccaguuugagacauaccagcucuggacggcccugaucucccuuaccuguagcaacacaauuuucacccugacaguggcguggcggaccgccacgcucauccuggcuggcgucucccugcuuccgguuugccaaucuagcuccaugagaaaaacagacuggcugcccauggccguggcugccaugggggugccuccccucccucuguuuaucuucggacucaaggauacccugaagcgcagaucuuggccccuuaaugagggcgucauggccguggggcugguuagcauucuggcuuccucucuccugcggaacgacgugccuauggcgggaccccuugucgccggcgggcugcucaucgcuuguuaugugauuaccggaacaagcgccgaucugaccguugaaaaagccgcugacaucacaugggaggaagaggccgaacagacgggcgugucccacaaccucaugauuaccgucgacgaugacggcacaaugcgcaucaaggaugacgagaccgagaauauccugacagugcuucugaaaaccgcgcugcucauugucagcgggaucuuuccguacucuauuccugcuacgcugcuuguguggcauaccuggcagaagcagacacaaagauccggaguucugugggaugugcccagcccucccgaaacccagaaagccgagcucgaagagggcgucuaccggaucaagcagcaggggauuuucggaaaaacacaagugggcguuggggugcagaaggagggagucuuucacaccauguggcacgugacacgcggcgccgugcugacguauaacggcaagagacucgaaccgaauugggcuucuguuaaaaaggaccugaucuccuacgggggaggcuggcggcuuagcgcccaguggcaaaaaggggaggaaguccaggugauugcgguggagccuggaaagaaccccaaaaauuuccagaccaugccuggcacauuccagaccaccacaggggaaaucggagcuaucgcccuggauuuuaagcccggcacgucuggcucccccauuaucaaccgcgaggggaaggucgugggacuguauggcaaugggguugugaccaaaaacggaggcuacgucagcgggauugcccaaacaaaugcugagccugacggcccgacccccgaacucgaggaagagauguucaagaaaagaaaccugacaaucauggaucuucauccuggauccggcaagacccggaaauaucugcccgccauugugcgcgaagcuaucaagagacggcucagaacgcugauccucgccccuacacgcguuguggcggccgagauggaggaagcucugaaggggcuucccauucgguaccagaccaccgccacaaaaagcgagcacaccggaagagaaaucgucgaccugaugugccaugcuacauuuaccaugcgccugcucucuccugugcggguuccgaauuauaaccugauuaucauggaugaggcccacuucacggaccccgccagcauugcugcgagaggcuacaucuccacacgcguggggaugggagaagccgcugccaucuuuaugaccgccacaccucccggcaccgcugaugccuucccucagucuaaugcgcccauucaggacgaggagcgggacaucccggaaagaagcuggaacuccgggaaugaguggauuacggauuuugcuggcaagaccgucugguucgugccuucuaucaaagccggaaacgacauugccaacugucuucgcaagaauggcaaaaaggugauccaacugagccggaagacauuugauaccgaauaccagaaaacaaagcucaacgacugggauuucgucguuaccacagacauuuccgagaugggggcuaauuuuaaagccgauagagugaucgacccccggcgcugccugaagcccgugauccugaccgauggaccugagagagucauucucgcgggccccaugccugugacggccgcuucugccgcucagcggcgcgggagaguuggacggaacccgcagaaagaaaaugaccaauauaucuucacaggccagccccuuaacaaugaugaggaccaugcccacuggaccgaagcuaagaugcugcuggacaacauuaauaccccugaggggaucauucccgcccucuucgaaccugagagagagaagagcgcggccaucgauggcgaauaccgccugaaaggagagucccggaagacauuuguggaacuuaugagacgcggcgaccugcccgucuggcucgcucacaaaguggccagcgaggggaucaaguauaccgaucggaaauggugcuucgacggacagagaaacaaucagauucuggaagagaacauggauguugagaucuggacaaaggaaggcgagaaaaagaagcugcgcccgcgguggcucgacgcuagaacguacucugauccucuugcccugaaagaauuuaaggaguucgccgcugggcgcaaauccauugcgcuggaccucgugaccgaaaucggaagaguccccagccaucuggcccaccggacacgcaaugcucuugauaaccuggugaugcuccauaccucugagcacggcggcagagccuaucggcacgccgucgaggaacugccugagacaauggaaacccugcuccuucuggggcugaugauucuccugacgggaggcgcuaugcuuuuucugaucuccgggaagggaaucggcaaaaccagcauugggcucaucugugugauugccuccucuggaaugcuguggauggcggagaucccccugcaauggauugccagcgcuaucguucucgaguucuuuaugauggugcuucugauuccugaacccgagaagcagcgcacaccgcaggacaaucaacuggccuacguggucaucggcauccucacccuggcugccauuaucgcggccaacgaaaugggccuucuggagacaaccaagagagaucucgggauguccaaagaaccuggaguugugagccccacgucuuaucuggacguggaucugcaucccgcuuccgccuggacacucuacgcugucgccaccacagugauuaccccuaugcuucggcacaccaucgagaauagcacagcuaacguuucucuggccgcgauugccaaccaggcugugguccugaugggccucgacaagggguggccgaucagcaaaauggaccugggagugccccuucuggcccucggcugcuacucccaggucaauccucugacgcugaccgcugccgugcuccuucugaucacacauuaugccauuaucgggcccggacugcaggcgaaggcuaccagagaggcccaaaaacgcacagcugccggcauuaugaagaacccuaccguugauggcaucaugacgauugaccucgaucccgugaucuacgacucuaaguucgaaaaacagcuggggcaggucaugcuucuggugcucugugccguucagcugcugcucaugcggacaagcugggcucuuugcgaggcccugacccuggcgaccggaccuaucacaacccucugggaaggcuccccggggaaguuuuggaauacaacgauugccgugucuauggcuaacaucuucagaggaagcuaucuggccggcgcugggcuugccuuuuccauuaugaaaagcgucggaaccggcaagcgcggcacagggucucaaggagagacccugggcgaaaaauggaagaagaaacucaaucagcugucccggaaggauuucgaccuguacaaaaagagcgggaucacagagguggauagaaccgaggcgaaagaaggacucaagcggggcgagauuacgcaccaugccgugucccgcgggucugcuaaacuucagugguuuguugaaagaaacauggucauccccgagggacgggugauugaccugggcuguggccgcgggggauggagcuauuacugcgccggccugaagaaggugaccgaagucagaggguauacaaaaggaggcccugggcacgaggagcccguuccuauguccaccuacggauggaauaucgugaagcucaugucuggcaaagauguguucuaccugcccccggaaaagugugacacacuucugugcgauaucggcgagagcuccccuagccccaccgucgaagagucucggacaauucgcgugcucaaaaugguugagcccuggcugaagaacaaucaguucuguaucaaggugcugaacccuuauaugcccaccgucauugaacaccucgagagacuucaacggaaacaugggggaaugcuggugcgcaauccucuguccagaaacagcacgcacgaaauguacuggaucucuaauggcacagggaacauuguugcuuccgugaauauggucagccggcuccugcuuaacagauuuaccaugacccaucgccggccgacaaucgagaaggacguggaucugggagccggcacgagacacgugaacgcugaacccgagaccccuaauauggacgucaucggggagcgcauuaaacggaucaaggaagagcacaacucuacauggcauuaugacgaugaaaaucccuacaaaaccugggccuaucacggaagcuacgagguuaaggcgacaggcuccgccucuagcaugauuaacggcguggugaagcuccugaccaaaccuugggacgucgugcccaugguuacacagauggcuaugaccgauacgaccccguucgggcagcaaagaguguuuaaggaaaaagucgacacacgcaccccucgguccaugcccggaacaagacgcgugaugggcaucaccgccgaguggcuguggcggacgcucgggagaaauaagaaaccucgccugugcacacgggaggaauucaccaagaagguuagaacaaacgcugccaugggagccguguuuaccgaggaaaaucagugggauagcgcgaaagcugccgucgaggacgaagauuucuggaagcuuguggaccgcgagagagagcugcauaaacucggcaaguguggguccugcguuuauaacaugaugggcaaacgggaaaagaaacugggagaguuuggcaaggccaaggggucucgcgcuauuugguacauguggcuuggagccagauaccuggaauucgaggcucucggcuuucugaaugaggaucacugguucagccgggaaaacuccuauucugggguggagggagaaggccugcauaaacucggguacauccugagagacaucagcaagauucccggcggagccauguaugcggaugacacggccggcugggacacccggaucacagaggaugaccuucacaaugaagagaaaauuacccagcagauggauccugagcaccgccaacuggcuaacgccaucuuuaagcucacauaccagaauaaagucgugaagguccagagacccaccccgacagggaccgugauggacauuaucucccggaaggaucagcgcggaucuggccaaguugggacguauggacugaacacauucaccaauauggaagcucagcuuaucagacagauggagggcgaaggggugcugagcaaagccgaccucgagaacccucaucugcccgaaaagaaaauuacccaguggcuggagacaaagggcgucgagcggcucaaacgcauggcgaucuccggagaugacugcguggugaagcccauugaugacagauuugccaacgcucugcuugcccugaaugauaugggcaagguucggaaagacaucccucaauggcagccgagcaagggguggcacgauuggcagcaggugcccuucuguucucaucacuuccacgaacucauuaugaaagacggacgcaagcuggucgugccuugcagaccccaagacgagcuuaucggccgggcucgcauuucccagggggccggauggagccugaaagaaaccgcuugucucggcaaggccuacgcgcagauguggucucugauguauuuucauagacgggaucugcgccucgccuccaacgcuaucugcagcgccguuccugugcacuggguccccacaucuagaacgaccugguccauccaugcccaccaucaauggaugacaaccgaggacaugcugacaguguggaaucgggucuggauugaagauaacccuuggauggaggacaagacccccgugacgaccugggagaauguuccguaccuugggaaaagagaagaucagugguguggcagccugaucggacucacaucccgcgcuaccugggcccagaacauuccuacagcgauccagcaagugcggagccugauuggcaaugaggaauuccuugacuacaugcccucuaugaagagauuucgcaaagaggaggaaagcgagggggcuaucugguga

SEQ ID NO: 20568 - RNA, 9873 nt, Artificial Sequence
  derived and/or modified CDS sequence (opt5) from DENV-3__HQ705619__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgcuuacauggaaucggaaagagcugcucgucaccuuuaagaacgcucacgcgaaaaagcaagaaguggucgugcuggggucucaggagggagccaugcacacagcucugaccggcgccaccgaaauccagaauagcgggggcacaagcauuuucgccggacaucucaagugucgccugaaaauggacaaacuugagcugaaaggcaugucuuacgcuaugugcacgaacaccuuuguucucaagaaagagguguccgaaacacagcacgggaccauccugaucaaggucgaguacaagggagaagaugugccuuguaaaauucccuucagcacagaggacggccaagggaaggcccauaacggaagacugaucaccgcgaauccuguugugacgaaaaaggaggaacccgucaacauugaggcugaacccccuuucggcgaguccaauaucgugauugggaucggcgauaacgcccuuaaaaucaauugguauaagaagggaucuagcauuggcaaaauguuugaagccacagcuagaggggcuagacgcauggcuauccucggagacaccgccugggauuucggcuccgucgggggaguucugaacagccugggcaagaugguccaccagauuuuugggucugcguacaccgcccucuucuccggcgugagcugggugaugaaaaucggaauuggcguccugcuuacauggaucgggcucaauucuaagaacaccagcauguccuuuucuugcauugcuaucggaaucauuacacucuaucugggcgccgugguucaggcugacauggggugugugaucaauuggaaaggaaaggagcugaagugcggcagcgggauuuucgucacgaacgaggugcauaccuggacagaacaguacaaauuucaagccgauuccccgaagcggcuugcgaccgccaucgcuggcgccugggagaauggaguuuguggcauuagaagcacaacccgcauggaaaaccuccuguggaaacagaucgcuaaugagcugaacuauauccucugggaaaauaacauuaagcugacgguggucgugggggacaucauuggaguucuugagcagggcaaacggacccugacaccccagccuauggagcucaaguacucuuggaaaaccugggggaaggccaagaucgugacagccgaaacccaaaacuccagcuucauuaucgauggacccaauacaccugagugccccucugucuccagagcuuggaacgugugggaaguggaggacuauggcuuuggcgucuucaccacgaauaucuggcugaaacugcgcgaaguuuacacacagcuuugugaccaccggcucaugagcgcggccgugaaggaugagagagcugugcacgccgacaugggguacuggauugagucccagaaaaacggaucuuggaagcuggaaaaagccagccugaucgaggucaagaccugcaccuggccgaagucccauacacucuggucuaauggcgugcuggaaagcgauaugauuaucccuaaaucccuugcugggcccauuagccagcacaaccaucgcccuggauaucacacccaaacggccggccccuggcaccuggggaagcucgagcuggacuuuaauuacugcgagggaacaaccguugugaucacagaaaacuguggcacccggggcccuucucugagaacaaccacggucuccgggaaacuuauccaugaguggugcugucgcagcugcacccugcccccgcugcgguauaugggagaagauggcuguugguacgggauggagauuagaccuaucucugaaaaggaggagaauauggugaaaucccugguuagcgcgggaucuggcaagguggacaacuucacaauggggguccucugccuggcuauucuuuuugaagaggugaugcggggaaaguucggcaaaaagcacaugaucgccggcguuuucuuuaccuucgugcugcuccugagcgggcagauuacauggcgcgauauggcccauacccugaucaugauuggauccaaugcuagcgacagaaugggcaugggggucacguaucuugcccugaucgcgacauuuaaaauccagcccuuccucgcucugggauuuuuccuccggaagcugaccucuagagaaaaccuucugcucggcguggggcuggccauggccacaacccugcaacuucccgaggauauugaacagauggcuaauggaaucgcccugggccucauggcucugaaacucauuacccaguuugagacauaccagcuguggacggcccuuaucucccugaccuguagcaacacaauuuucacccucacaguggcguggcgcaccgccacgcugauccuggcuggcgucucccuucugccuguuugccaaucuagcuccaugcggaagacagacuggcucccgauggccguggcugccaugggggugcccccucugccccucuuuaucuucggacugaaggauacccuuaaaagacgcucuuggccucugaaugagggcgucauggccguggggcugguuagcauucucgcuuccucucugcuuagaaacgacgugcccauggcgggaccucuggucgccggcgggcuccugaucgcuuguuaugugauuaccggaacaagcgccgaucucaccguugaaaaggccgcugacaucacaugggaggaagaggccgaacagacgggcgugucccacaaccugaugauuaccgucgacgaugacggcacaaugcggaucaaagaugacgagaccgagaauauccuuacagugcugcugaagaccgcgcuccugauugucagcgggaucuuucccuacucuauuccggcuacgcuucugguguggcauaccuggcagaaacagacacaacgcuccggaguucucugggaugugccuucucccccugaaacccagaaggccgagcuggaagagggcgucuacagaaucaaacagcaggggauuuucggaaagacacaagugggcguuggggugcagaaggagggagucuuucacaccauguggcacgugacacggggcgccgugcucacguauaacggcaaacgccuggaacccaauugggcuuccguuaagaaagaccuuaucuccuacgggggaggcuggagacugagcgcccaguggcaaaagggggaggaaguccaggugauugcgguggagccgggcaagaacccuaagaauuuccagaccaugcccggcacauuccagaccaccacaggggaaaucggagcuaucgcccuggauuuuaagccuggcacgucuggcucccccauuaucaaccgggaggggaaagucgugggacucuauggcaaugggguugugaccaagaacggaggcuacgucagcgggauugcccaaacaaaugcugagcccgacggcccuaccccggaacuggaggaagagauguucaaaaagcgcaaccuuacaaucauggaucugcaucccggauccggcaaaaccagaaaguaucucccugccauugugcgggaagcuaucaagcgcagacugcggacgcucauccuggcccccacaagaguuguggcggccgagauggaggaagcucuuaaagggcugccuauucgcuaccagaccaccgccacaaagagcgagcacaccggacgggaaaucgucgaccugaugugccaugcuacauuuaccaugagacuccugucucccgugcgcguuccuaauuauaaccuuauuaucauggaugaggcccacuucacggacccggccagcauugcugcgcggggcuacaucuccacaagaguggggaugggagaagccgcugccaucuuuaugaccgccacacccccuggcaccgcugaugccuucccccagucuaaugcgccuauucaggacgaggagcgcgacauccccgaacggagcuggaacuccgggaaugaguggauuacggauuuugcuggcaaaaccgucugguucgugccgucuaucaaggccggaaacgacauugccaacugucugcgcaaaaauggcaagaaggugauccaacucagcagaaaaacauuugauaccgaauaccagaagacaaaacugaacgacugggauuucgucguuaccacagacauuuccgagaugggggcuaauuuuaaggccgaucgggugaucgacccuagacggugccugaaacccgugauccucaccgauggacccgagcgcgucauucuugcgggcccuaugcccgugacggccgcuucugccgcucagagacgggggcgcguuggaagaaacccucagaaggaaaaugaccaauauaucuucacaggccagccgcugaacaaugaugaggaccaugcccacuggaccgaagcuaagaugcugcucgacaacauuaauacccccgaggggaucauuccugcccuguucgaacccgagcgggagaaaagcgcggccaucgauggcgaauacagacuuaagggagagucccgcaaaacauuuguggaacugaugcggagaggcgaccucccugucuggcuggcucacaagguggccagcgaggggaucaaauauaccgaucgcaaguggugcuucgacggacagcggaacaaucagauucuggaagagaacauggauguugagaucuggacaaaagaaggcgagaagaagaaacucagaccccgcuggcuugacgcucggacguacucugauccgcuggcccugaaggaauuuaaagaguucgccgcugggagaaaguccauugcgcucgaccuggugaccgaaaucggacgcgucccuagccaucuugcccacagaacacggaaugcucuggauaaccucgugaugcugcauaccucugagcacggcggccgcgccuauagacacgccgucgaggaacugcccgagacaauggaaacccuccuucugcuggggcucaugauucugcuuacgggaggcgcuaugcuguuucucaucuccgggaaaggaaucggcaagaccagcauugggcugaucugugugauugccuccucuggaaugcuguggauggcggagaucccucuccaauggauugccagcgcuaucguucuugaguucuuuaugauggugcugcugauucccgaaccugagaagcagcggacaccccaggacaaucaacucgccuacguggucaucggcauccugacccuugcugccauuaucgcggccaacgaaaugggccugcucgagacaaccaaacgcgaucuggggauguccaaggaaccgggaguugugagcccuacgucuuaucuggacguggaucuccaucccgcuuccgccuggacacuuuacgcugucgccaccacagugauuacccccaugcugagacacaccaucgagaauagcacagcuaacguuucucuggccgcgauugccaaccaggcugugguccucaugggccuggacaaaggguggccuaucagcaagauggaccuuggagugccgcugcucgcccugggcugcuacucccaggucaauccccugacgcucaccgcugccgugcuucugcugaucacacauuaugccauuaucgggccuggacuccaggcgaaagcuacccgggaggcccaaaagagaacagcugccggcauuaugaagaaccccaccguugauggcaucaugacgauugaccuggauccugugaucuacgacucuaaauucgaaaagcagcuugggcaggucaugcugcucgugcugugugccguucagcugcuccuuaugcgcacaagcugggcucugugcgaggcccugacccucgcgaccggacccaucacaacccugugggaaggcuccccugggaaauuuuggaauacaacgauugccgugucuauggcuaacaucuuccggggaagcuaucuugccggcgcugggcuggccuuuuccauuaugaaaagcgucggaaccggcaaaagaggcacagggucucaaggagagacccucggcgaaaaguggaagaaaaagcugaaucagcugucccgcaaagauuucgaccucuacaagaaaagcgggaucacagagguggaucggaccgaggcgaaggaaggacuuaaaagaggcgagauuacgcaccaugccgugucccgggggucugcuaagcugcagugguuuguugaacgcaacauggucaucccggagggaagagugauugaccugggcuguggcagagggggauggagcuauuacugcgccggccucaagaaagugaccgaaguccgcggguauacaaagggaggccccgggcacgaggagccuguucccauguccaccuacggauggaauaucgugaaacugaugucuggcaaggauguguucuaccuuccucccgaaaaaugugacacacugcucugcgauaucggcgagagcuccccgagcccuaccgucgaagagucuagaacaauucgggugcugaagaugguugagcccuggcugaagaacaaucaguucuguaucaaagugcucaaccccuauaugccuaccgucauugaacaccuugagcgccugcaaagaaagcaugggggaaugcuggugcggaauccccucucccgcaacagcacgcacgaaauguacuggaucucuaauggcacagggaacauuguugcuuccgugaauauggucagcagacugcuucugaaccgguuuaccaugacccauagacgcccuacaaucgagaaagacguggaucucggagccggcacgcggcacgugaacgcugaaccggagacccccaauauggacgucaucggggagagaauuaagcgcaucaaagaagaacacaacucuacauggcauuaugacgaugaaaauccuuacaagaccugggccuaucacggaagcuacgagguuaaggcgacaggcuccgccucuagcaugauuaacggcguggugaaacugcugaccaagcccugggacgucgugccuaugguuacacagauggcuaugaccgauacgacccccuucgggcagcaacggguguuuaaagaaaaggucgacacaagaaccccgcgcuccaugccuggaacacggagagugaugggcaucaccgccgaguggcucuggcgcacgcuggggcggaauaaaaagcccagacuuugcacacgcgaggaguucaccaagaaaguucggacaaacgcugccaugggagccguguuuaccgaggaaaaucagugggauagcgcgaaggcugccgucgaggacgaagauuucuggaaacugguggacagagagcgcgagcuccauaagcugggcaaauguggguccugcguuuauaacaugaugggcaagagagagaagaaacuuggagaguuuggcaaggccaaagggucucgggcuauuugguacauguggcugggagcccgcuaccucgaguucgaggcucugggcuuucugaaugaggaucacugguucagcagagaaaacuccuauucugggguggagggagaaggccuccauaagcugggguacauccuucgggacaucagcaaaauuccuggcggagccauguaugcggaugacacggccggcugggacaccagaaucacagaggaugaccugcacaaugaagagaagauuacccagcagauggaucccgagcaccggcaacucgcuaacgccaucuuuaaacugacauaccagaauaaggucgugaagguccagcgcccuacccccacagggaccgugauggacauuaucuccagaaaagaucagcggggaucuggccaaguugggacguauggacuuaacacauucaccaauauggaagcucagcugauccgccagauggagggcgaaggggugcucagcaaggccgaccuggagaacccgcaucugccugagaagaagauuacccaguggcucgagacaaaaggcgucgagagacugaagcggauggcgaucuccggagaugacugcguggugaagcccauugaugaccgcuuugccaacgcccuucuggcccucaaugauaugggcaaaguuagaaaggacaucccccaauggcagccuagcaaaggguggcacgauuggcaacaggugccguucuguucucaucacuuccacgaacugauuaugaaggacggacggaaacuugucgugcccugccgcccucaagacgagcugaucggcagagcucggauuucccagggggccggauggagccucaaggaaaccgcuugucugggcaaggccuacgcgcagauguggucucugauguauuuucaucgcagagaucuccggcuggccuccaacgcuaucugcagcgccguucccgugcacugggucccuacaucucgcacgaccugguccauccaugcccaccaucaauggaugacaaccgaggacaugcuuacaguguggaauagagucuggauugaagauaaccccuggauggaggacaaaaccccugugacgaccugggagaauguucccuaccuggggaagcgggaagaucagugguguggcagccucaucggacugacauccagagcuaccugggcccagaacauuccgacagcgauccagcaagugcgcagccuuauuggcaaugaggaguuccuggacuacaugccuucuaugaaacgguuuagaaaggaggaggaaagcgagggggcuaucugguga

SEQ ID NO: 20569 - RNA, 9873 nt, Artificial Sequence
  derived and/or modified CDS sequence (opt5) from DENV-3__HQ705620__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucauguggggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggguggggcuuaauucuaagaacaccagcauguccuuuucuugcaucgcuauuggaaucaucacacuguaccucggcgccguugugcaggcugacauggggugugucauuaauuggaaaggaaaggagcugaagugcggcagcgggaucuucgugacgaacgagguucacaccuggacagaacaguauaaauuucaagccgauucccccaagcggcuggcgaccgccauugcuggcgccugggagaauggaguguguggcaucagaagcacaacccgcauggaaaaccuucucuggaaacagauugcuaaugagcugaacuacauccugugggaaaauaacaucaagcucacggucgugguuggggacauuaucggagugcuggagcagggcaaacggacccuuacaccucagcccauggagcugaaguauucuuggaaaaccugggggaaggccaagauugucacagccgaaacccaaaacuccagcuucaucauugauggaccuaauacacccgagugcccgucuguguccagagcuuggaacgugugggaagucgaggacuacggcuuuggcguuuucaccacgaauaucuggcucaaacugcgcgaaguguauacacagcugugugaccaccggcuuaugagcgcggccgugaaggaugagagagcuguccaugccgacaugggguacuggaucgagucccagaaaaacggaucuuggaagcucgaaaaagccagccugauugaggugaagaccugcaccuggccuaagucccacacacuguggucuaauggcguucucgaaagcgauaugaucauucccaaaucccuggcugggccuaucagccagcauaaccaccgccccggauaccacacccaaacggccggcccuuggcaucuugggaagcuggagcucgacuuuaauuauugcgagggaacaaccguggucauuacagaaaacuguggcacccggggccccucucugagaacaaccacgguguccgggaaacugauccacgaguggugcugucgcagcugcacccuuccgccucuccgguacaugggagaagauggcuguugguaugggauggagaucagacccauuucugaaaaggaggagaauaugguuaaaucccuggugagcgcgggaucuggcaaggucgacaacuucacaaugggggugcugugccucgcuauccuguuugaagagguuaugcggggaaaguucggcaaaaagcauaugauugccggcguguucuuuaccuucguccuucugcucagcgggcagaucacauggcgcgauauggcccacacccugauuaugaucggauccaaugcuagcgacagaaugggcaugggggugacguaccuggcccuuauugcgacauuuaaaauccagcccuuccuggcucucggauuuuuccugcggagacucaccucucgcgaaaaccugcuucugggcguggggcucgccauggccacaacccugcaacugccugaggauaucgaacagauggcuaauggaauugcccuuggccugauggcucucaagcugaucacccaguuugagacauaucagcucuggacggcccugauuucccuuaccuguagcaacacaaucuucacccugacagucgcguggcggaccgccacgcucauucuggcuggcguuucccugcuuccggugugccaaucuagcuccaugagaaaaacagacuggcugcccauggccguggcugccaugggggucccuccccucccucuguuuaucuucucucucaaggauacccugaagcgcagaagcuggccccuuaaugagggagugauggccguuggccugguguccauccuggcuucuagccuccugcggaacgacgucccuauggcggggccccuuguggccggaggccugcucauugcuuguuacguuaucaccgggacauccgccgaucugaccguggaaaaagccgcugacauuacaugggaggaagaggccgaacagacgggagucagccauaaccucaugaucaccguggacgaugacggcacaaugcgcauuaaggaugacgagaccgagaauauccugacaguccuucugaaaaccgcgcugcucaucgugucuggcauuuuuccguauuccaucccugcuacgcugcuuguuuggcacaccuggcagaagcagacacaaagaagcggggugcugugggauguccccucuccucccgaaacccagaaagccgagcucgaagagggaguguaccggauuaagcagcagggcaucuucgggaaaacacaaguuggagugggcguccagaaggaggggguguuucacaccauguggcaugugacacgcggagccguucugacguacaacggcaagagacucgaaccgaauugggcuuccgucaaaaaggaccugauuagcuauggcgggggauggcggcuuucugcccaguggcaaaaaggcgaggaaguccaggugaucgcggucgagccugggaagaaccccaaaaauuuccagaccaugccuggaacauuccagaccaccacaggcgaaauuggggcuaucgcccuggauuuuaagcccggaacguccggcagccccaucauuaaccgcgagggcaaggugguugggcuguacggaaauggcguggucaccaaaaacgggggauauguguccggcaucgcccaaacaaaugcugagccugacgggccgacccccgaacucgaggaagagauguucaagaaaagaaaccugacaauuauggaucuucacccuggcagcggaaagacccggaaauaccugcccgccaucguucgcgaagcuauuaagagacggcucagaacgcugauccucgccccuacacgcguggucgcggccgagauggaggaagcucugaagggccuucccauccgguaucagaccaccgccacaaaaucugagcauaccgggagagaaauuguggaccugaugugccacgcuacauuuaccaugcgccugcucagcccuguucgggugccgaauuacaaccugaucauuauggaugaggcccauuucacggaccccgccuccaucgcugcgagaggauauauuucuacacgcgucggcaugggggaagccgcugccaucuuuaugaccgccacaccucccggaaccgcugaugccuucccucagagcaaugcgcccauccaggacgaggagcgggacauuccggaaagauccuggaacucuggcaaugaguggaucacggauuuugcugggaagaccgugugguucgugccuagcauuaaagccggcaacgacaucgccaacugucuucgcaagaauggcaaaaaggucauucaacugucccggaagacauuugauaccgaauaccagaaaacaaagcucaacgacugggauuucguugugaccacagacaucucugagaugggagcuaauuuuaaagccgauagagugauugacccccggcgcugccugaagcccgucauccugaccgaugggccugagagagugauccucgcgggacccaugccuguuacggccgcuagcgccgcucagcggcgcggcagaguggggcggaacccgcagaaagaaaaugaccaauacauuuucacaggacagccccuuaacaaugaugaggaccacgcccacuggaccgaagcuaagaugcugcuggacaacaucaauaccccugagggcauuauccccgcccucuucgaaccugagagagagaaguccgcggccauugauggggaauaucgccugaaaggcgagagccggaagacauuugucgaacuuaugagacgcggagaccugcccguguggcucgcucauaaaguugccucugagggcaucaaguacaccgaucggaaauggugcuucgacgggcagagaaacaaucagauccuggaagagaacauggauguggagauuuggacaaaggaaggagagaaaaagaagcugcgcccgcgguggcucgacgcuagaacguauuccgauccucuugcccugaaagaauuuaaggaguucgccgcuggccgcaaaagcaucgcgcuggaccucgucaccgaaauugggagagugcccucucaccuggcccaucggacacgcaaugcucuugauaaccuggucaugcuccacaccuccgagcacggaggcagagccuaccggcaugccguggaggaacugccugagacaauggaaacccugcuccuucugggccugaugauccuccugacagggggagcuaugcuuuuucugauuagcggcaaggggaucggaaaaaccuccaucggccucauuuguguuaucgccucuagcgggaugcuguggauggcggagauuccccugcaauggaucgccuccgcuauugugcucgaguucuuuaugauggugcuucugaucccugaacccgagaagcagcgcacaccgcaggacaaucaacuggccuaugucguuauuggaauccucacccuggcugccaucauugcggccaacgaaaugggccuucuggagacaaccaagagagaucucggcaugagcaaagaaccugggguggugucucccacguccuaccuggacgucgaucugcaccccgcuagcgccuggacacucuaugcuguggccaccacaguuaucaccccuaugcuucggcauaccauugaaaauucuacagcuaacgugagccuggccgcgaucgccaaccaggcugucgugcugaugggacucgacaagggcuggccgauuuccaaaauggaccugggggucccccuucuggcccucggaugcuacucucaggugaauccucugacgcugaccgcugccguucuccuucugaucacacacuacgccaucauuggccccgggcugcaggcgaaggcuaccagagaggcccaaaaacgcacagcugccggaaucaugaagaacccuaccguggauggcauuaugacgaucgaccucgaucccgucauuuaugacagcaaguucgaaaaacagcugggccaggugaugcuucugguucucugugccgugcagcugcugcucaugcggacauccugggcucuuugcgaggcccugacccuggcgaccgggccuaucacaacccucugggaaggaucuccgggcaaguuuuggaauacaacgaucgccgucagcauggcuaacauuuucagaggguccuaccuggccggagcuggccuugccuuuagcaucaugaaaucuguggggaccggaaagcgcggcacaggcucccaaggggagacccugggagaaaaauggaagcggaagcucaaucagcugagcagaaaagauuucgaccuguauaagaaauccggcauuacagagguggaucggaccgaggcgaaggaagggcucaaacgcggagagaucacgcaucacgccguuucuagaggcagcgcuaaacuucagugguuugucgaacggaacauggugauucccgaggggcgcgugaucgaccugggauguggcagaggcgggugguccuacuauugcgccggacugaaaaaggucaccgaaguucggggcuacacaaaagggggaccuggccacgaggagcccgugccuaugucuaccuauggguggaauauugugaaacucaugagcggaaaggaugucuucuaccugcccccggaaaaaugugacacacuucugugcgauaucggcgaguccagcccuucucccaccguggaagagucccgcacaaucagaguucucaagaugguggagcccuggcugaaaaacaaucaguucuguauuaagguccugaacccuuacaugcccaccgugaucgaacaucucgagcggcuucaacgcaagcacggcgggaugcugguuagaaauccucugagccggaacucuacgcaugaaauguauuggauuuccaauggaacaggcaacaucguggcuagcgucaauauggugucuagacuccugcuuaaccgcuuuaccaugacccaccggagaccgacaauugagaaagacguggaucugggggccggaacgcgccacgucaacgcugaacccgagaccccuaauauggacguuaucggcgagcggaucaagagaauuaaagaagaacacaacagcacauggcacuacgacgaugaaaaucccuauaagaccugggccuaccauggguccuaugaggugaaagcgacaggaucugccagcuccaugaucaacggcguggucaagcuccugaccaagccuugggacgugguucccauggugacacagauggcuaugaccgauacgaccccguucggccagcaacgcgucuuuaaagaaaagguggacacacggaccccuagaagcaugcccgggacacgccggguuaugggaauuaccgccgaguggcuguggagaacgcucggccgcaauaaaaagccucggcugugcacaagagaggaguucaccaaaaaggugcgcacaaacgcugccaugggggccgucuuuaccgaggaaaaucagugggauuccgcgaaggcugccguggaggacgaagauuucuggaaacuuguugacagagagcgggagcugcacaagcucggaaaauguggcucuugcguguacaacaugauggggaagcgcgagaagaagcugggcgaguuuggaaaagccaagggcagcagagcuaucugguauauguggcuuggggcccgguaccuggaguucgaggcucucggauuucugaaugaggaucauugguucuccagagaaaacucuuacagcggcgucgagggggaaggacugcacaagcucggcuauauucugcgggacaucuccaaaauccccgggggcgccauguacgcggaugacacggccggaugggacacccgcauuacagaggaugaccuucacaaugaagagaagaucacccagcagauggauccugagcauagacaacuggcuaacgccauuuuuaaacucacauaucagaauaagguggucaaagugcagcggcccaccccgacaggcaccguuauggacaucauuucucgcaaggaucagagagggagcggacaagugggcacguacgggcugaacacauucaccaauauggaagcucagcuuauccggcagauggagggagaaggcguccuguccaaggccgaccucgagaacccucaucugcccgagaagaagaucacccaguggcuggagacaaaagggguggagcgccucaagagaauggcgauuagcggcgaugacugcgugguuaaacccaucgaugaccgguuugccaacgcucugcuugcccugaaugauaugggaaaggugcgcaaggacauuccucaauggcagccgucuaaaggcuggcaugauuggcagcagguccccuucuguucccaccacuuccaugaacucaucaugaaggacgggagaaaacuggugguuccuugccggccccaagacgagcuuauuggacgcgcuagaaucagccagggcgccggguggucucugaaggaaaccgcuugucucggaaaagccuaugcgcagauguggucccugauguacuuucaccggcgcgaucugagacucgccagcaacgcuauuugcucugccgugccuguccauugggugcccacaucccggacgaccuggagcauccacgcccaucaccaauggaugacaaccgaggacaugcugacagucuggaauagaguguggaucgaagauaacccuuggauggaggacaagacccccguuacgaccugggagaaugugccguaucuuggcaagcgcgaagaucaguggugugggucccugauuggccucacaagccgggcuaccugggcccagaacaucccuacagcgauucagcaagucagaucucugaucggaaaugaggaguuccuugacuacaugcccagcaugaaacgcuuucggaaggaggaggaauccgagggcgcuauuugguga

SEQ ID NO: 20570 - RNA, 9873 nt, Artificial Sequence
  derived and/or modified CDS sequence (opt5) from DENV-3__HQ705621__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaccucagcccauggagcugaaguauucuuggaaaaccugggggaaggccaagaucgugacagccgaaacccaaaacuccagcuucauuaucgauggaccuaauacacccgagugcccgucugucuccagagcuuggaacgugugggaaguggaggacuacggcuuuggcgucuucaccacgaauaucuggcucaaacugcgcgaaguuuauacacagcugugugaccaccggcuuaugagcgcggccgugaaggaugagagagcugugcaugccgacaugggguacuggauugagucccagaaaaacggaucuuggaagcucgaaaaagccagccugaucgaggucaagaccugcaccuggccuaagucccacacacuguggucuaauggcgugcucgaaagcgauaugauuauccccaaaucccuggcugggccuauuagccagcauaaccaccgccccggauaccacacccaaacggccggcccuuggcaucuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcauaugaucgccggcguuuucuuuaccuucgugcuucugcucagcgggcagauuacauggcgcgauauggcccacacccugaucaugauuggauccaaugcuagcgacagaaugggcaugggggucacguaccuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagaucuaucagcucuggacagcccugauuucccuuacguguagcaacaccaucuucacacugaccguggcguggcgcacagccacccucauccuggcuggcgucucccugcuuccgaugugccaaucuagcuccaugcggaagacggacuggcugcccauggccguugcugccaugggggugccuccccucccucuguuuauuuucucucucaaggauacacugaaaagacgcagcuggccccuuaaugagggagugauggccgucggccugguguccauccuggcuucuagccuccugagaaacgacguuccuauggcggggccccuuguggccggaggccugcucauugcuuguuacgucaucaccgggaccuccgccgaucugacaguggaaaaggccgcugacauuaccugggaggaagaggccgaacagacaggaguuagccauaaccucaugaucacgguggacgaugacggcaccaugcggaucaaagaugacgagacagagaauauucugaccguccuucugaagacagcgcugcucaucgugucuggcauuuuuccguauuccaucccugcuacccugcuugucuggcacacguggcagaaacagacccaacgcagcggggugcugugggauguucccucuccucccgaaacacagaaggccgagcucgaagagggaguguacagaauuaaacagcagggcaucuucgggaagacccaagucggagugggcguucagaaggaggggguguuucacacaauguggcaugucacccggggagccgugcugacauacaacggcaaacgccucgaaccgaauugggcuuccgugaagaaagaccugauuagcuauggcgggggauggagacuuucugcccaguggcaaaagggcgaggaaguucaggucaucgcgguggagccugggaaaaaccccaagaauuuccagacgaugccuggaaccuuccagacaaccaccggcgaaaucggggcuauugcccuggauuuuaagcccggaacauccggcagccccaucauuaaccgggagggcaaaguggucgggcuguacggaaauggcgugguuacgaagaacgggggauauguguccggcaucgcccaaaccaaugcugagccugacgggccgacacccgaacucgaggaagagauguucaaaaagcgcaaccugaccauuauggaucuucacccuggcagcggaaaaacaagaaaguaccugcccgccaucguccgggaagcuaucaagcgcagacuccggacccugauucucgccccuacgagagugguugcggccgagauggaggaagcucugaaaggccuucccauccgcuaucagacaaccgccaccaagucugagcauacagggcgggaaauuguggaccugaugugccacgcuaccuuuacaaugagacugcucagcccuguccgcgugccgaauuacaaccugaucauuauggaugaggcccauuucaccgaccccgccuccaucgcugcgcggggauauaucucuacgagaguuggcaugggggaagccgcugccauuuuuaugacagccaccccucccggaacagcugaugccuucccucagagcaaugcgcccauccaggacgaggagcgcgacauuccggaacgguccuggaacucuggcaaugaguggaucaccgauuuugcugggaaaacggugugguucgucccuagcauuaaggccggcaacgacaucgccaacugucuucgcaaaaauggaaagaaggugauucaacuguccagaaaaaccuuugauacagaauaccagaagaccaaacucaacgacugggauuucguggucacaaccgacaucucugagaugggcgcuaauuuuaaggccgaucggguuaucgaccccagacggugccugaaacccgugauucugacagaugggccugagcgcgugauccucgcgggacccaugccugucaccgccgcuagcgccgcucagagacggggccgcguggggagaaacccgcagaaggaaaaugaccaauacauuuucacgggacagccccuuaacaaugaugaggaccacgcccacuggacagaagcuaagaugcugcuggacaacaucaauaccccugagggcauuauccccgcccucuucgaaccugagcgggagaaauccgcggccaucgauggggaauauagacugaagggcgagagccgcaaaaccuuuguugaacuuaugcggagaggagaccugcccguguggcucgcucauaaggucgccucugagggcauuaaauacacagaucgcaaguggugcuucgacgggcagcggaacaaucagauccuggaagagaacauggauguggagauuuggaccaaagaaggagagaagaagaaacugagaccgcgcuggcucgacgcucggacauauuccgauccucuugcccugaaggaauuuaaagaguucgccgcuggcagaaagagcaucgcgcuggaccucguuacggaaauugggcgcgugcccucucaccuggcccauagaacccggaaugcucuugauaaccuggucaugcuccacacauccgagcacggaggccgcgccuacagacaugccguggaggaacugccugagaccauggaaacacugcuccuucugggccugaugauccuccugaccgggggagcuaugcuuuuucugaucagcggcaaagggauuggaaagacguccaucggccucauuugugucaucgccucuagcgggaugcuguggauggcggagauuccccugcaauggaucgccuccgcuauugugcucgaguucuuuaugaugguucuucugaucccugaacccgagaagcagcggaccccgcaggacaaucaacuggccuauguggugaucggcauucucacacuggcugccaucauugcggccaacgaaaugggccuucuggagaccacaaaacgcgaucucggcaugagcaaggaaccuggggucguuucucccaccuccuaccuggacguggaucugcaccccgcuagcgccuggacgcucuaugcuguggccacaaccgucaucacaccuaugcuuagacauaccauugaaaauucuaccgcuaacgugagccuggccgcgaucgccaaccaggcuguugugcugaugggacucgacaaaggcuggccgaucuccaagauggaccugggggucccccuucuggcccucggaugcuacucucaggugaauccucugacacugacggcugccguccuccuucugauuacccacuacgccaucauuggccccgggcugcaggcgaaagcuacacgggaggcccaaaagagaaccgcugccggaaucaugaagaacccuacaguggauggcauuaugaccaucgaccucgaucccguuaucuaugacagcaaauucgaaaagcagcugggccaggugaugcuucugguccucugugugguucagcugcugcucaugcgcacguccugggcccuuugcgaggcucugacacuggccaccgggccuauuaccacacucugggaaggaucuccgggcaaauuuuggaauaccacaaucgcggugagcauggccaacauuuuccggggguccuaccuggcuggagccggccuugcuuuuagcaucaugaagucugucgggacgggaaaaagaggcaccggcucccaaggggagacacugggagaaaaguggaagaaaaagcucaaucagcugagccgcaaagauuucgaccuguauaagaaauccggcauuaccgagguggaucggacagaggccaaggaagggcucaaaagaggagagaucacccaucacgcggugucucggggcagcgccaaacuucagugguuuguugaacgcaacauggucauucccgaggggagagugaucgaccugggauguggccggggcgggugguccuacuauugcgcuggacugaagaaagugacggaaguccgcggcuacaccaaagggggaccuggccacgaggagcccguuccuaugucuacauauggguggaauaucgugaaacucaugagcggaaaggauguguucuaccugcccccggaaaaaugugacacccuucugugcgauauuggcgaguccagcccuucucccacagucgaagaguccagaaccauccgggugcucaagaugguugagcccuggcugaagaacaaucaguucuguauuaaagugcugaacccuuacaugcccacagucaucgaacaucucgagcgccuucaaagaaagcacggcgggaugcuggugcggaauccucugagccgcaacucuacccaugaaauguauuggauuuccaauggaacgggcaacaucguugccagcgugaauauggucucuagacuccugcuuaaccgguuuacaaugacccacagacgcccgaccaucgagaaagacguggaucugggggcuggaacacggcacgugaacgccgaacccgagacgccuaauauggacgucauuggcgagagaaucaagcgcauuaaagaagaacauaacagcaccuggcaccaugacgaugaaaaucccuacaagacaugggcuuaucacggguccuacgagguuaaggccaccggaucugcgagcuccaugaucaacggcguggugaaacuccugacaaagccuugggacgucgugcccaugguuacccagauggccaugacagauaccacgccguucggccagcaacggguguuuaaagaaaaggucgacaccagaacaccucgcagcaugcccgggacccggagagugaugggaauuacagcugaguggcuguggcgcacccucggccggaauaaaaagccuagacugugcacgcgcgaggaguucacaaagaaaguucggaccaacgccgcuaugggggccguguuuacagaggaaaaucagugggauuccgccaaggcggcugucgaggacgaagauuucuggaaacuuguggacagagagcgcgagcugcauaagcucggaaaauguggcucuugcguuuauaacaugauggggaagagagagaagaagcugggcgaguuuggaaaggccaaaggcagccgggccaucugguacauguggcuuggggcucgcuaucuggaguucgaggcccucggauuucugaaugaggaucacugguucuccagagaaaacucuuacagcggcguggagggggaaggacugcacaagcucggcuacauccugcgggacauuuccaaaauccccgggggcgcuauguaugccgaugacaccgcgggaugggacacgagaauuaccgaggaugaccuucauaaugaagagaagaucacacagcagauggauccugagcaccggcaacuggccaacgcuauuuuuaaacucaccuaccagaauaaggucgugaagguccagcgccccacaccgaccggcacagugauggacaucaucucuagaaaagaucagcgggggagcggacaaguuggcaccuaugggcugaacacguucacaaauauggaagcccagcuuauucgccagauggagggagaaggcgugcuguccaaggcugaccucgagaacccucaucugcccgagaagaagaucacccaguggcuggagaccaaaggggucgagagacucaagcggauggccauuagcggcgaugacugcguggugaagcccaucgaugaccgcuuugcgaacgcccugcuugcucugaaugauaugggaaaaguuagaaaggacauuccucaauggcagccgucuaaaggcuggcacgauuggcaacaggugcccuucuguucccaccauuuccacgaacucaucaugaaggacgggcggaaacuggucgugccuugccgcccccaagacgagcuuauuggacgggcccggaucagccagggcgcuggguggucucugaaggaaacagccugucucggaaaggcuuacgcccagauguggucccugauguauuuucaucgcagagaucugcggcucgcgagcaacgccaucugcucugcuguuccugugcacuggguccccaccucccgcacaacguggagcauucaugcccaccaccaauggaugaccacagaggacaugcugaccguguggaauagagucuggaucgaagauaacccuuggauggaggacaaaacacccgugaccacgugggagaauguuccguaccuuggcaagcgggaagaucaguggugugggucccugauuggccucaccagcagagccacaugggcucagaacaucccuaccgccauucagcaagugcgcucucugaucggaaaugaggaguuccuugacuauaugcccagcaugaaacgguuuagaaaggaggaggaauccgagggcgcgaucugguga

SEQ ID NO: 20571 - RNA, 9873 nt, Artificial Sequence
  derived and/or modified CDS sequence (opt5) from DENV-3__HQ671176__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaccucagcccauggagcugaaguauucuuggaaaaccugggggaaggccaagaucgugacagccgaaacccaaaacuccagcuucauuaucgauggaccuaauacacccgagugcccgucugucuccagagcuuggaacgugugggaaguggaggacuacggcuuuggcgucuucaccacgaauaucuggcucaaacugcgcgaaguuuauacacagcugugugaccaccggcuuaugagcgcggccgugaaggaugagagagcugugcaugccgacaugggguacuggauugagucccagaaaaacggaucuuggaagcucgaaaaagccagccugaucgaggucaagaccugcaccuggccuaagucccacacacuguggucuaauggcgugcucgaaagcgauaugauuauccccaaaucccuggcugggccuauuagccagcauaaccaccgccccggauaccacacccaaacggccggcccuuggcaucuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcauaugaucgccggcguuuucuuuaccuucgugcuucugcucagcgggcagauuacauggcgcgauauggcccacacccugaucaugauuggauccaaugcuagcgacagaaugggcaugggggucacguaccuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagaucuaucagcucuggacagcccugauuucccuuacguguagcaacaccaucuucacacugaccguggcguggcgcacagccacccucauccuggcuggcgucucccugcuuccgaugugccaaucuagcuccaugcggaagacggacuggcugcccauggccguugcugccaugggggugccuccccucccucuguuuauuuucucucucaaggauacacugaaaagacgcagcuggccccuuaaugagggagugauggccgucggccugguguccauccuggcuucuagccuccugagaaacgacguuccuauggcggggccccuuguggccggaggccugcucauugcuuguuacgucaucaccgggaccuccgccgaucugacaguggaaaaggccgcugacauuaccugggaggaagaggccgaacagacaggaguuagccauaaccucaugaucacgguggacgaugacggcaccaugcggaucaaagaugacgagacagagaauauucugaccguccuucugaagacagcgcugcucaucgugucuggcauuuuuccguauuccaucccugcuacccugcuugucuggcacacguggcagaaacagacccaacgcagcggggugcugugggauguucccucuccucccgaaacacagaaggccgagcucgaagagggaguguacagaauuaaacagcagggcaucuucgggaagacccaagucggagugggcguucagaaggaggggguguuucacacaauguggcaugucacccggggagccgugcugacauacaacggcaaacgccucgaaccgaauugggcuuccgugaagaaagaccugauuagcuauggcgggggauggagacuuucugcccaguggcaaaagggcgaggaaguucaggucaucgcgguggagccugggaaaaaccccaagaauuuccagacgaugccuggaaccuuccagacaaccaccggcgaaaucggggcuauugcccuggauuuuaagcccggaacauccggcagccccaucauuaaccgggagggcaaaguggucgggcuguacggaaauggcgugguuacgaagaacgggggauauguguccggcaucgcccaaaccaaugcugagccugacgggccgacacccgaacucgaggaagagauguucaaaaagcgcaaccugaccauuauggaucuucacccuggcagcggaaaaacaagaaaguaccugcccgccaucguccgggaagcuaucaagcgcagacuccggacccugauucucgccccuacgagagugguugcggccgagauggaggaagcucugaaaggccuucccauccgcuaucagacaaccgccaccaagucugagcauacagggcgggaaauuguggaccugaugugccacgcuaccuuuacaaugagacugcucagcccuguccgcgugccgaauuacaaccugaucguuauggaugaggcccauuucaccgaccccgccuccauugcugcgcggggauauaucucuacgagagugggcaugggggaagccgcugccaucuuuaugacagccaccccucccggaacagcugaugccuucccucagagcaaugcgcccauucaggacgaggagcgcgacaucccggaacgguccuggaacucuggcaaugaguggauuaccgauuuugcugggaaaacggucugguucgugccuagcaucaaggccggcaacgacauugccaacugucuucgcaaaaauggaaagaaggugauccaacuguccagaaaaaccuuugauacagaauaccagaagaccaaacucaacgacugggauuucgucguuacaaccgacauuucugagaugggcgcuaauuuuaaggccgaucgggugaucgaccccagacggugccugaaacccgugauccugacagaugggccugagcgcgucauucucgcgggacccaugccugugaccgccgcuagcgccgcucagagacggggccgcguugggagaaacccgcagaaggaaaaugaccaauacaucuucacgggacagccccuuaacaaugaugaggaccacgcccacuggacagaagcuaagaugcugcuggacaacauuaauaccccugagggcaucauucccgcccucuucgaaccugagcgggagaaauccgcggccaucgauggggaauauagacugaagggcgagagccgcaaaaccuuuguggaacuuaugcggagaggagaccugcccgucuggcucgcucauaagguggccucugagggcaucaaauacacagaucgcaaguggugcuucgacgggcagcggaacaaucagauucuggaagagaacauggauguugagaucuggaccaaagaaggagagaagaagaaacugagaccgcgcuggcucgacgcucggacauauuccgauccucuugcccugaaggaauuuaaagaguucgccgcuggcagaaagagcauugcgcuggaccucgugacggaaaucgggcgcguccccucucaccuggcccauagaacccggaaugcucuugauaaccuggugaugcuccacacauccgagcacggaggccgcgccuacagacaugccgucgaggaacugccugagaccauggaaacacugcuccuucugggccugaugauucuccugaccgggggagcuaugcuuuuucugaucagcggcaaagggaucggaaagacguccauuggccucaucugugugauugccucuagcgggaugcuguggauggcggagaucccccugcaauggauugccuccgcuaucguucucgaguucuuuaugauggugcuucugauuccugaacccgagaagcagcggaccccgcaggacaaucaacuggccuauguggucaucggaauccucacacuggcugccauuaucgcggccaacgaaaugggccuucuggagaccacaaaacgcgaucucggcaugagcaaggaaccugggguugugucucccaccuccuaccuggacguggaucugcaccccgcuagcgccuggacgcucuaugcugucgccacaaccgugauuacaccuaugcuuagacauaccaucgaaaauucuaccgcuaacguuagccuggccgcgauugccaaccaggcugugguccugaugggacucgacaaaggcuggccgaucuccaagauggaccugggggugccccuucuggcccucggaugcuacucucaggucaauccucugacacugacggcugccgugcuccuucugaucacccacuacgccauuaucggccccgggcugcaggcgaaagcuacacgggaggcccaaaagagaaccgcugccggaauuaugaagaacccuacaguugauggcaucaugaccauugaccucgaucccgugaucuaugacagcaaauucgaaaagcagcugggccaggucaugcuucuggugcucugugccguucagcugcugcucaugcgcacguccugggcucuuugcgaggcccugacacuggcgaccgggccuaucaccacacucugggaaggaucuccgggcaaauuuuggaauaccacaauugccgugagcauggcuaacaucuuccggggguccuaccuggccggagcuggccuugccuuuagcauuaugaagucugucgggacgggaaaaagaggcaccggcucccaaggggagacacugggagaaaaguggaagaaaaagcucaaucagcugagccgcaaagauuucgaccuguauaagaaauccggcaucaccgagguggaucggacagaggcgaaggaagggcucaaaagaggagagauuacccaucacgccgugucucggggcagcgcuaaacuucagugguuuguugaacgcaacauggucauccccgaggggagagugauugaccugggauguggccggggcgggugguccuacuauugcgccggacugaagaaagugacggaaguccgcggcuacaccaaagggggaccuggccacgaggagcccguuccuaugucuacauauggguggaauaucgugaaacucaugagcggaaaggauguguucuaccugcccccggaaaaaugugacacccuucugugcgauaucggcgaguccagcccuucucccacagucgaagaguccagaaccauucgggugcucaagaugguugagcccuggcugaagaacaaucaguucuguaucaaagugcugaacccuuacaugcccacagucauugaacaucucgagcgccuucaaagaaagcacggcgggaugcuggugcggaauccucugagccgcaacucuacccaugaaauguauuggaucuccaauggaacgggcaacauuguugcuagcgugaauauggucucuagacuccugcuuaaccgguuuacaaugacccacagacgcccgaccaucgagaaagacguggaucugggggccggaacacggcacgugaacgcugaacccgagacgccuaauauggacgucaucggcgagagaauuaagcgcaucaaagaagaacacaacagcaccuggcacuacgacgaugaaaaucccuauaagacaugggccuaccauggguccuaugagguuaaggcgaccggaucugccagcuccaugauuaacggcguggugaaacuccugacaaagccuugggacgucgugcccaugguuacccagauggcuaugacagauaccacgccguucggccagcaacggguguuuaaagaaaaggucgacaccagaacaccucgcagcaugcccgggacccggagagugaugggaaucacagccgaguggcuguggcgcacccucggccggaauaaaaagccuagacugugcacgcgcgaggaguucacaaagaaaguucggaccaacgcugccaugggggccguguuuacagaggaaaaucagugggauuccgcgaaggcugccgucgaggacgaagauuucuggaaacuuguggacagagagcgcgagcugcacaagcucggaaaauguggcucuugcguuuacaacaugauggggaagagagagaagaagcugggcgaguuuggaaaggccaaaggcagccgggcuauuugguauauguggcuuggggcccgcuaccuggaguucgaggcucucggauuucugaaugaggaucauugguucuccagagaaaacucuuacagcggcguggagggggaaggacugcacaagcucggcuauauccugcgggacaucuccaaaauucccgggggcgccauguacgcggaugacaccgccggaugggacacgagaaucaccgaggaugaccuucacaaugaagagaagauuacacagcagauggauccugagcaucggcaacuggcuaacgccaucuuuaaacucaccuaucagaauaaggucgugaagguccagcgccccacaccgaccggcacagugauggacauuaucucuagaaaagaucagcgggggagcggacaaguuggcaccuacgggcugaacacguucacaaauauggaagcucagcuuauccgccagauggagggagaaggcgugcuguccaaggccgaccucgagaacccucaucugcccgagaagaagauuacccaguggcuggagaccaaaggggucgagagacucaagcggauggcgaucagcggcgaugacugcguggugaagcccauugaugaccgcuuugccaacgcucugcuugcccugaaugauaugggaaaaguuagaaaggacaucccucaauggcagccgucuaaaggcuggcaugauuggcaacaggugcccuucuguucccaccacuuccaugaacucauuaugaaggacgggcggaaacuggucgugccuugccgcccccaagacgagcuuaucggacgggcucggauuagccagggcgccggguggucucugaaggaaacagcuugucucggaaaggccuaugcgcagauguggucccugauguacuuucaccgcagagaucugcggcucgccagcaacgcuaucugcucugccguuccugugcauuggguccccaccucccgcacaacguggagcauccacgcccaucaccaauggaugaccacagaggacaugcugaccguguggaauagagucuggauugaagauaacccuuggauggaggacaaaacacccgugaccacgugggagaauguuccguaucuuggcaagcgggaagaucaguggugugggucccugaucggccucaccagcagagcuacaugggcccagaacauuccuaccgcgauccagcaagugcgcucucugauuggaaaugaggaguuccuugacuacaugcccagcaugaaacgguuuagaaaggaggaggaauccgagggcgcuaucugguga

SEQ ID NO: 20572 - RNA, 9873 nt, Artificial Sequence
  derived and/or modified CDS sequence (opt5) from DENV-3__HQ705609__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcucggggggccagacgcauggcuauccuuggagacaccgccugggauuucggcuccguggggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacaugggguguguggucaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccaaggagcugaaauacucuuggaagaccugggggaaggccaaaauugucacagccgaaacccaaaacuccagcuucaucauugauggaccuaauacacccgagugcccgucuguguccagagcuuggaacgugugggaagucgaggacuauggcuuuggcguuuucaccacgaauaucuggcucaagcugcgcgaaguguacacacagcugugugaccaccggcuuaugagcgcggccgugaaagaugagagagcuguccacgccgacaugggguacuggaucgagucccagaagaacggaucuuggaaacucgaaaaggccagccugauugaggugaagaccugcaccuggccuaaaucccauacacuguggucuaauggcguucucgaaagcgauaugaucauucccaagucccuggcugggccuaucagccagcacaaccaucgccccggauaucacacccaaacggccggcccuuggcaccuugggaaacuggagcucgacuuuaauuacugcgagggaacaaccguggucauuacagaaaacuguggcacccggggccccucucugagaacaaccacgguguccgggaagcugauccaugaguggugcugucgcagcugcacccuuccgccucuccgguauaugggagaagauggcuguugguacgggauggagaucagacccauuucugaaaaagaggagaauaugguuaagucccuggugagcgcgggaucuggcaaggucgacaacuucacaaugggggugcugugccucgcuauccuguuugaagagguuaugcggggaaaauucggcaagaaacacaugauugccggcguguucuuuaccuucguccuucugcucagcgggcagaucacauggcgcgauauggcccauacccugauuaugaucggauccaaugcuagcgacagaaugggcaugggggugacguaucuggcccuuauugcgacauuuaagauccagcccuuccuggcucucggauuuuuccugcggaaacucaccucuagagaaaaccugcuucugggcguggggcucgccauggccacaacccugcaacugccugaggauaucgaacagauggcuaauggaauugcccuuggccugauggcucucaagcugaucacccaguuugagacauaccagcucuggacggcccugauuucccuuaccuguagcaacacaaucuucacccugacagucgcguggcgcaccgccacgcucauucuggcuggcguuucccugcuuccggugugccaaucuagcuccaugcggaagacagacuggcugcccauggccguggcugccaugggggucccuccccucccucuguuuaucuucucucucaaagauacccugaagagacgcagcuggccccuuaaugagggagugauggccguuggccugguguccauccuggcuucuagccuccugagaaacgacgucccuauggcggggccccuuguggccggaggccugcucauugcuuguuauguuaucaccgggacauccgccgaucugaccguggaaaaagccgcugacauuacaugggaggaagaggccgaacagacgggagucagccacaaccucaugaucaccguggacgaugacggcacaaugcggauuaaggaugacgagaccgagaauauccugacaguccuucugaaaaccgcgcugcucaucgugucuggcauuuuuccguacuccaucccugcuacgcugcuuguuuggcauaccuggcagaagcagacacaacgcagcggggugcugugggauguccccucuccucccgaaacccagaaagccgagcucgaagagggaguguacagaauuaagcagcagggcaucuucgggaagacacaaguuggagugggcguccagaaagaggggguguuucacaccauguggcacgugacacggggagccguucugacguauaacggcaagcgccucgaaccgaauugggcuuccgucaaaaaggaccugauuagcuacggcgggggauggagacuuucugcccaguggcaaaaaggcgaggaagugcaggugaucgcggucgagccugggaagaaccccaagaauuuccagaccaugccuggaacauuccagaccaccacaggcgaaauuggggcuaucgcccuggauuuuaaacccggaacguccggcagccccaucauuaaccgggagggcaaggugguugggcuguauggaaauggcguggucaccaaaaacgggggauacguguccggcaucgcccaaacaaaugcugagccugacgggccgacccccgaacucgaggaagagauguucaagaaacgcaaccugacaauuauggaucuucauccuggcagcggaaagaccagaaaguaucugcccgccaucguucgggaagcuauuaaacgcagacuccggacgcugauccucgccccuacaagaguggucgcggccgagauggaggaagcucugaagggccuucccauccgcuaccagaccaccgccacaaaaucugagcacaccgggcgggaaauuguggaccugaugugccaugcuacauuuaccaugagacugcucagcccuguucgcgugccgaauuauaaccugaucauuauggaugaggcccacuucacggaccccgccuccaucgcugcgcggggauacauuucuacaagagucggcaugggggaagccgcugccaucuuuaugaccgccacaccucccggaaccgcugaugccuucccucagagcaaugcgcccauccaggacgaggagcgcgacauuccggaacgguccuggaacucuggcaaugaguggaucacggauuuugcugggaagaccgugugguucgugccuagcauuaaagccggcaacgacaucgccaacugucuuagaaagaauggaaagaaagucauucaacugucccgcaagacauuugauaccgaauaccagaaaacaaagcucaacgacugggauuucguugugaccacagacaucucugagaugggcgcuaauuuuaaagccgaucgggugauugaccccagacggugccugaagcccgucauccugaccgaugggccugagcgcgugauccucgcgggacccaugccuguuacggccgcuagcgccgcucagagacggggccgcguggggagaaacccgcagaaggaaaaugaccaauauauuuucacaggacagccccuuaacaaugaugaggaccaugcccacuggaccgaagcuaaaaugcugcuggacaacaucaauaccccugagggcauuauccccgcccucuucgaaccugagcgggagaaguccgcggccauugauggggaauacagacugaaaggcgagagccgcaagacauuugucgaacuuaugcggagaggagaccugcccguguggcucgcucacaaaguugccucugagggcaucaaguauaccgaucgcaaauggugcuucgacgggcagcggaacaaucagauccuggaagagaacauggauguggagauuuggacaaaggaaggagagaagaaaaagcugagaccgcgcuggcucgacgcucggacguacuccgauccucuugcccugaaagaauuuaaggaguucgccgcuggcagaaaaagcaucgcgcuggaccucgucaccgaaauugggcgcgugcccucucaucuggcccacagaacacggaaugcucuugauaaccuggucaugcuccauaccuccgagcacggaggccgcgccuauagacacgccguggaggaacugccugagacaauggaaacccugcuccuucugggccugaugauccuccugacggggggagcuaugcuuuuucugauuagcggcaaggggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaaacagcggacaccgcaggacaaucaacuggccuacgucguuauuggaauccucacccuggcugccaucauugcggccaacgaaaugggccuucuggagacaaccaagcgcgaucucggcaugagcaaagaaccugggguggugucucccacguccuaucuggacgucgaucugcaucccgcuagcgccuggacacucuacgcuguggccaccacaguuaucaccccuaugcuuagacacaccauugagaauucuacagcuaacgugagccuggccgcgaucgccaaccaggcugucgugcugaugggacucgacaagggcuggccgauuuccaaaauggaccugggggucccccuucuggcccucggaugcuacucucaggugaauccucugacgcugaccgcugccguucuccuucugaucacacauuaugccaucauuggccccgggcugcaggcgaaggcuacccgggaggcccaaaagagaacagcugccggaaucaugaaaaacccuaccguggauggcauuaugacgaucgaccucgaucccgucauuuacgacagcaaguucgaaaaacagcugggccaggugaugcuucugguucucugugccgugcagcugcugcucaugcgcacauccugggcucuuugcgaggcccugacccuggcgaccgggccuaucacaacccucugggaaggaucuccgggcaaguuuuggaauacaacgaucgccgucagcauggcuaacauuuuccggggguccuaucuggccggagcuggccuugccuuuagcaucaugaaaucuguggggaccggaaagagaggcacaggcucccaaggggagacccugggagaaaaguggaaaaagaaacucaaucagcugagccgcaaggauuucgaccuguacaaaaaguccggcauuacagagguggaucggaccgaggcgaaagaagggcucaagagaggagagaucacgcaccaugccguuucucggggcagcgcuaagcuucagugguuugucgaacgcaacauggugauucccgaggggagagugaucgaccugggauguggccggggcgggugguccuauuacugcgccggacugaaaaaggucaccgaaguucgcggcuauacaaaagggggaccuggccacgaggagcccgugccuaugucuaccuacggguggaauauugugaagcucaugagcggaaaagaugucuucuaccugcccccggaaaagugugacacacuucugugcgauaucggcgaguccagcccuucucccaucguggaagaguccagaaccauucggguucucaagaugguggagcccuggcugaaaaacaaucaguucuguaucaagguccugaacccuuauaugcccacagugauugaacaccucgagcgccuucaaagaaaacauggcgggaugcugguucggaauccucugagccgcaacucuacccacgaaauguacuggaucuccaauggaacgggcaacauuguggcuagcgucaauauggugucuagacuccugcuuaaccgguuuacaaugacccauagacgcccgaccaucgagaaggacguggaucugggggccggaacacggcacgucaacgcugaacccgagacgccuaauauggacguuaucggcgagagaauuaaacgcaucaaggaagagcacaacagcaccuggcauuaugacgaugaaaaucccuacaagacaugggccuaucacggguccuacgaggugaaagcgaccggaucugccagcuccaugauuaacggcguggucaagcuccugacaaaaccuugggacgugguucccauggugacccagauggcuaugacagauaccacgccguucggccagcaacgggucuuuagagaaaagguggacacccgcacaccucggagcaugcccgggaccagacgcguuaugggaaucacagccgaguggcuguggcggacccucggcagaaauaaaaagccucgccugugcacgcgggaggaauucacaaagaaagugagaaccaacgcugccaugggggccgucuuuacagaggaaaaucagugggauuccgcgaaggcugccguggaggacgaagauuucuggaaacuuguugaccgcgagagagagcugcauaagcucggaaaauguggcucuugcguguauaacaugauggggaagcgggaaaaaaagcugggcgaguuuggaaaggccaaaggcagccgcgcuauuugguacauguggcuuggggccagauaccuggaauucgaggcucucggauuucugaaugaggaucacugguucucccgggaaaacucuuauagcggcgucgagggggaaggacugcauaagcucggcuacauccugagagacaucuccaaaauucccgggggcgccauguaugcggaugacaccgccggaugggacacgcggaucaccgaggaugaccuucacaaugaagagaagauuacacagcagauggauccugagcaccgccaacuggcuaacgccaucuuuaaacucaccuaccagaauaagguggucaaggugcagagacccacaccgaccggcacaguuauggacauuaucucucggaaagaucagcgcgggagcggacaagugggcaccuaugggcugaacacguucacaaauauggaagcucagcuuaucagacagauggagggagaaggcguccuguccaaggccgaccucgagaacccucaucugcccgaaaaaaagauuacccaguggcuggagaccaaagggguggagcggcucaagcgcauggcgaucagcggcgaugacugcgugguuaagcccauugaugacagauuugccaacgcucugcuugcccugaaugauaugggaaaagugcggaaggacaucccucaauggcagccgucuaaaggcuggcacgauuggcagcagguccccuucuguucccaucacuuccacgaacucauuaugaaggacgggcgcaaacuggugguuccuugcagaccccaagacgagcuuaucggacgggcucgcauuagccagggcgccggguggucucugaaggaaacagcuugucucggaaaggccuacgcgcagauguggucccugauguauuuucauagacgggaucugcgccucgccagcaacgcuaucugcucugccgugccuguccacugggugcccaccuccagaacaacguggagcauccaugcccaccaucaauggaugaccacagaggacaugcugaccgucuggaaucggguguggauugaagauaacccuuggauggaggacaaaacacccguuaccacgugggagaaugugccguaccuuggcaagagagaagaucaguggugugggucccugaucggccucaccagccgcgcuacaugggcccagaacauuccuaccgcgauccagcaaguccggucucugauuggaaaugaggaauuccuugacuacaugcccagcaugaaaagauuucgcaaggaggaggaauccgagggcgcuaucugguga

SEQ ID NO: 20573 - RNA, 9873 nt, Artificial Sequence
  derived and/or modified CDS sequence (opt5) from DENV-3__HQ705610__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcucggggggccagacgcauggcuauccuuggagacaccgccugggauuucggcuccguggggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacaauuuggucuaauggcgugcuggaaagcgauaugaucauucccaaaucccucgcugggccuaucagccagcacaaccaucgccccggauaucacacccaaacggccggcccuuggcaccuggggaagcuugagcuggacuuuaauuacugcgagggaacaaccguugugaucacagaaaacuguggcacccggggccccucucucagaacaaccacggucuccgggaaacugauucaugaguggugcugucgcagcugcacccugccgccucuucgguauaugggagaagauggcuguugguacgggauggagaucagacccauuucugaaaaggaggagaauauggugaaaucccucguuagcgcgggaucuggcaagguggacaacuucacaauggggguccugugccuggcuauccucuuugaagaggugaugcggggaaaguucggcaaaaagcacaugauugccggcguuuuccugaccuuugugcuucugcucagcgggcagaucacauggaaagauauggcccauacccugauuaugaucggauccaaugcuagcgaccgcaugggcaugggggucacguaucuggcccuuaucgcgacauucaagauucagcccuuucuggcucucggauucuuucugagaaaacucaccucucgggaaaaccugcuucugggcguggggcucgccauggccacaacccugcaacugccugaggauaucgaacagauggcuaauggaauugcccuuggccugauggcucucaagcugaucacccaguucgagacauaccagcucuggacggcccugauuucccuuaccuguagcaacacaaucuccacccugacaguggcguggagaaccgccacgcucauccuggcuggcgucucucugcuuccgguuugccaaagcuccucuaugcgcaagacagacuggcugcccauggccguggcugccaugggggugccuccccucccucuguuuauuuucagccucaaagauacccugaagcggagauccuggccccuuaaugagggagucauggccgugggccugguuucuauccuggcuagcucccuccugcgcaacgacgugccuauggcggggccccuugucgccggaggccugcucauugcuuguuaugugaucaccgggacaagcgccgaucugaccguugaaaaagccgcugacauuacaugggaggaagaggccgaacagacgggagugucucacaaccucaugaucaccgucgacgaugacggcacaaugagaaucaaggaugacgagaccgagaauauucugacagugcuucugaaaaccgcgcugcucaucgucuccggcauuuuuccguacagcaucccugcuacgcugcuuguguggcauaccuggcagaagcagacacaacggucugggguucugugggaugugcccuccccucccgaaacccagaaagccgagcucgaagagggagucuaccgcauuaagcagcagggcaucuucgggaagacacaagugggaguuggcgugcagaaagagggggucuuucacaccauguggcacgugacaagaggagccgugcugacguauaacggcaagcggcucgaaccgaauugggcuagcguuaaaaaggaccugauuucuuacggcgggggauggcgccuuuccgcccaguggcaaaaaggcgaggaaguccaggugaucgcgguggagccugggaagaaccccaagaauuuccagaccaugccuggaacauuucagaccaccacaggcgaaaucggggcuauugcccuggauuucaaacccggaacgagcggcucccccaucauuaacagagagggcaaggucguggggcuguauggaaauggcguugugaccaaaaacgggggauacgucagcggcaucgcccaaacaaaugcugagccugacgggccgacccccgaacucgaggaagagauguucaagaaacggaaccugacaauuauggaucuucauccuggcucuggaaagacccgcaaguaucugcccgccaucgugagagaagcuaucaaacggcgccucagaacgcugauucucgccccuacacggguuguggcggccgagauggaggaagcucugaagggccuucccaucagauaccagaccaccgccacaaaaagcgagcacaccgggcgcgaaauugucgaccugaugugccaugcuacauuuaccaugcggcugcucuccccugugagaguuccgaauuauaaccugaucauuauggaugaggcccacuucacggaccccgccucuaucgcugcgcgcggauacaucagcacacgggugggcaugggggaagccgcugccauuuuuaugaccgccacaccucccggaaccgcugaugccuucccucaguccaaugcgcccauccaggacgaggagagagacauuccggaacgcucuuggaacagcggcaaugaguggaucacggauuuugcugggaagaccgucugguucgugccuuccauuaaagccggcaacgacaucgccaacugucuucggaagaauggaaagaaagugauucaacugucuagaaagacauuugauaccgaauaccagaaaacaaagcucaacgacugggauuucgucguuaccacagacaucagcgagaugggcgcuaauuuuaaagccgaucgcgugaucgacccccggagaugccugaagcccgugauucugaccgaugggccugagcgggucauccucgcgggacccaugccugugacggccgcuuccgccgcucagcgcagaggccggguugggcgcaacccgcagaaggaaaaugaccaauauauuuucacaggacagccccuuaacaaugaugaggaccaugcccacuggaccgaagcuaaaaugcugcuggacaacaucaauaccccugagggcauuauccccgcccucuuugaaccugagagagagaagagcgcggccaucgauggggaauaccggcugaaaggcgagucuagaaagacauucguggaacuuaugcgccggggagaccugcccgucuggcucgcucacaaaguggccuccgagggcauuaaguauaccgauagaaaauggugcuucgacgggcagcgcaacaaucagauccuggaagagaacauggauguugagauuuggacaaaggaaggagagaagaaaaagcugcggccgagauggcucgacgcucgcacguacagcgauccucuugcccugaaagaauuuaaggaguucgccgcuggccggaaaucuaucgcgcuggaccucgugaccgaaauugggagaguccccucccaucuggcccaccgcacaagaaaugcucuugauaaccuggugaugcuccauaccagcgagcacggaggccgggccuaucgccacgccgucgaggaacugccugagacaauggaaacccugcuccuucugggccugaugauccuccugacggggggagcuaugcuuuuucugaucuccggcaaggggauuggaaagaccucuaucggccucauuugugugaucgccagcuccgggaugcuguggauggcggagauuccccugcaauggaucgccagcgcuauuguucucgaguucuuuaugauggugcuucugaucccugaacccgagaaacagagaacaccgcaggacaaucaacuggccuacguggucaucggaauucucacccuggcugccaucauugcggccaacgaaaugggccuucuggagacaaccaagcgggaucucggcaugucuaaagaaccugggguugugucccccacgagcuaucuggacguggaucugcaucccgcuucugccuggacacucuacgcugucgccaccacagugaucaccccuaugcuucgccacaccauugagaauagcacagcuaacguuucccuggccgcgaucgccaaccaggcugugguccugaugggacucgacaagggcuggccgaucucuaaaauggaccugggggugccccuucuggcccucggaugcuacagccaggucaauccucugacgcugaccgcugccgugcuccuucugauuacacauuaugccaucauuggccccgggcugcaggcgaaggcuaccagagaggcccaaaagcggacagcugccggaaucaugaaaaacccuaccguugauggcauuaugacgaucgaccucgaucccgugaucuacgacuccaaguucgaaaaacagcugggccaggucaugcuucuggugcucuguguugugcagcugcugcucaugagaacaucuugggcccuuugcgaggcucugacccuggccaccgggccuauuacaacccucugggaaggaagcccgggcaaguuuuggaauacaacgaucgcggucuccauggccaacauuuuccgcgggagcuaucuggcuggagccggccuugcuuuuucuaucaugaaauccguggggaccggaaagcggggcacaggcagccaaggggagacccugggagaaaaguggaaaaagaaacucaaucagcuguccagaaaggauuucgaccuguacaaaaagucuggcauuacagagguggaucgcaccgaggccaaagaagggcucaagcggggagagaucacgcaccaugcgguuagcagaggcuccgccaagcuucagugguuugucgaacggaacauggugauucccgaggggcgcgugaucgaccugggauguggcagaggcggguggucuuauuacugcgcuggacugaaaaaggucaccgaaguucggggcuauacaaaagggggaccuggccacgaggagcccgugccuaugagcaccuacggguggaauaucgugaagcucauguccggaaaagaugucuucuaccugcccccggaaaagugugacacacuucugugcgauauuggcgagagcucuccuucccccaccguggaagagagccgcacaaucagaguucucaagaugguggagcccuggcugaaaaacaaucaguuuuguauuaagguccugaacccuuauaugcccaccgugaucgaacaccucgagcggcuucaacgcaaacauggcgggaugcugguuagaaauccucugucucggaacuccacgcacgaaauguacuggauuagcaauggaacaggcaacaucguggccucugucaauauggugagccgccuccugcuuaacagauucaccaugacccaucggagaccgacaaucgagaaggacguggaucugggggcuggaacgcgccacgucaacgccgaacccgagaccccuaauauggacguuauuggcgagcggaucaaaagaauuaaggaagagcacaacuccacauggcauuaugacgaugaaaaucccuacaagaccugggcuuaucacgggucuuacgaggugaaagccacaggaagcgcguccagcaugaucaacggcguggucaagcuccugaccaaaccuugggacgugguucccauggugacacagauggccaugaccgauacgaccccguucggccagcaacgcgucuuuaaggaaaaaguggacacacggaccccuagauccaugcccgggacacgccggguuaugggaauuaccgcugaguggcuguggagaacgcucggccgcaauaagaagccucggcugugcacaagagaggaauucaccaaaaaggugcgcacaaacgccgcuaugggggccgucuuuaccgaggaaaaucagugggauucugccaaagcggcuguggaggacgaagauuucuggaagcuuguugaccgggagagagagcugcauaaacucggaaaguguggcagcugcguguauaacaugauggggaaacgcgaaaagaagcugggcgaguuuggaaaagccaagggcuccagagccaucugguacauguggcuuggggcucgguaccuggaauucgaggcccucggauuucugaaugaggaucacugguucucucgcgaaaacagcuauuccggcgucgagggggaaggacugcauaaacucggcuacauccugagagacauuucuaagauccccgggggcgcuauguaugccgaugacacggcgggaugggacacccggauuacagaggaugaccuucacaaugaagagaaaaucacccagcagauggauccugagcacagacaacuggccaacgcuauuuuuaagcucacauaccagaauaagguggucaaagugcagcggcccaccccgacaggcaccguuauggacaucaucagccgcaaggaucagagaggguccggacaagugggcacguaugggcugaacacauucaccaauauggaagcccagcuuauucggcagauggagggagaaggcguccugagcaaagcugaccucgagaacccucaucugcccgaaaagaaaaucacccaguggcuggagacaaaggggguggagcgccucaagagaauggccauuucuggcgaugacugcgugguuaaacccaucgaugaccgguuugcgaacgcccugcuugcucugaaugauaugggaaaggugcgcaaagacauuccucaauggcagccguccaagggcuggcacgauuggcagcagguccccuucuguagccaucacuuucacgaacucaucaugaaagacgggagaaagcuggugguuccuugccggccccaagacgagcuuauuggacgcgccagaaucucucagggcgcuggguggucccugaaggaaaccgccugucucggaaaagcuuacgcccagauguggagccugauguauuuccaucggcgcgaucugagacucgcgucuaacgccaucugcuccgcugugccuguccacugggugcccacaagccggacgaccugguccauucaugcccaccaucaauggaugacaaccgaggacaugcugacagucuggaaucgcguguggaucgaagauaacccuuggauggaggacaagacccccguuacgaccugggagaaugugccguaccuuggcaaaagagaagaucaguggugugggagccugauuggccucacaucucgggccaccugggcucagaacaucccuacagccauucagcaagucagaagccugaucggaaaugaggaauuccuugacuacaugcccuccaugaagcgcuuucggaaagaggaggaaucugagggcgcgaucugguga

SEQ ID NO: 20574 - RNA, 9873 nt, Artificial Sequence
  derived and/or modified CDS sequence (opt5) from DENV-3__HQ705611__SS-prME
accagccugugccucaugaugauccugcccgccgcucuugccuuccaccugacaucccgggacggagaaccucggaugauuguggggaagaacgaacgcggaaagucucuccuguuuaagacggcgagcggcaucaauauguguacccuuauugcuauggaucugggggaaaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaaaaggccgcugacaucacaugggaggaagaggccgaacagacgggcgugucccacaaccucaugauuaccgucgacgaugacggcacaaugcggaucaaagaugacgagaccgagaauauccugacagugcuucugaagaccgcgcugcucauugucagcgggaucuuuccguacucuauuccugcuacgcugcuuguguggcauaccuggcagaaacagacacaacgcuccggaguucugugggaugugcccagcccucccgaaacccagaaggccgagcucgaagagggcgucuacagaaucaaacagcaggggauuuucggaaagacacaagugggcguuggggugcagaaggagggagucuuucacaccauguggcacgugacacggggcgccgugcugacguauaacggcaaacgccucgaaccgaauugggcuucuguuaagaaagaccugaucuccuacgggggaggcuggagacuuagcgcccaguggcaaaagggggaggaaguccaggugauugcgguggagccuggcaagaaccccaagaauuuccagaccaugccuggcacauuccagaccaccacaggggaaaucggagcuaucgcccuggauuuuaagcccggcacgucuggcucccccauuaucaaccgggaggggaaagucgugggacuguauggcaaugggguugugaccaagaacggaggcuacgucagcgggauugcccaaacaaaugcugagccugacggcccgacccccgaacucgaggaagagauguucaaaaagcgcaaccugacaaucauggaucuucauccuggauccggcaaaaccagaaaguaucugcccgccauugugcgggaagcuaucaagcgcagacuccggacgcugauccucgccccuacaagaguuguggcggccgagauggaggaagcucugaaagggcuucccauucgcuaccagaccaccgccacaaagagcgagcacaccggacgggaaaucgucgaccugaugugccaugcuacauuuaccaugagacugcucucuccugugcgcguuccgaauuauaaccugauuaucauggaugaggcccacuucacggaccccgccagcauugcugcgcggggcuacaucuccacaagaguggggaugggagaagccgcugccaucuuuaugaccgccacaccucccggcaccgcugaugccuucccucagucuaaugcgcccauucaggacgaggagcgcgacaucccggaacggagcuggaacuccgggaaugaguggauuacggauuuugcuggcaaaaccgucugguucgugccuucuaucaaggccggaaacgacauugccaacugucuucgcaaaaauggcaagaaggugauccaacugagcagaaaaacauuugauaccgaauaccagaagacaaaacucaacgacugggauuucgucguuaccacagacauuuccgagaugggggcuaauuuuaaggccgaucgggugaucgaccccagacggugccugaaacccgugauccugaccgauggaccugagcgcgucauucucgcgggccccaugccugugacggccgcuucugccgcucagagacgggggcgcguuggaagaaacccgcagaaggaaaaugaccaauauaucuucacaggccagccccuuaacaaugaugaggaccaugcccacuggaccgaagcuaagaugcugcuggacaacauuaauaccccugaggggaucauucccgcccucuucgaaccugagcgggagaaaagcgcggccaucgauggcgaauacagacugaagggagagucccgcaaaacauuuguggaacuuaugcggagaggcgaccugcccgucuggcucgcucacaagguggccagcgaggggaucaaauauaccgaucgcaaguggugcuucgacggacagcggaacaaucagauucuggaagagaacauggauguugagaucuggacaaaagaaggcgagaagaagaaacugagaccgcgcuggcucgacgcucggacguacucugauccucuugcccugaaggaauuuaaagaguucgccgcugggagaaaguccauugcgcuggaccucgugaccgaaaucggacgcguccccagccaucuggcccacagaacacggaaugcucuugauaaccuggugaugcuccauaccucugagcacggcggccgcgccuauagacacgccgucgaggaacugccugagacaauggaaacccugcuccuucuggggcugaugauucuccugacgggaggcgcuaugcuuuuucugaucuccgggaaaggaaucggcaagaccagcauugggcucaucugugugauugccuccucuggaaugcuguggauggcggagaucccccugcaauggauugccagcgcuaucguucucgaguucuuuaugauggugcuucugauuccugaacccgagaagcagcggacaccgcaggacaaucaacuggccuacguggucaucggcauccucacccuggcugccauuaucgcggccaacgaaaugggccuucuggagacaaccaaacgcgaucucgggauguccaaggaaccuggaguugugagccccacgucuuaucuggacguggaucugcaucccgcuuccgccuggacacucuacgcugucgccaccacagugauuaccccuaugcuuagacacaccaucgagaauagcacagcuaacguuucucuggccgcgauugccaaccaggcugugguccugaugggccucgacaaaggguggccgaucagcaagauggaccugggagugccccuucuggcccucggcugcuacucccaggucaauccucugacgcugaccgcugccgugcuccuucugaucacacauuaugccauuaucgggcccggacugcaggcgaaagcuacccgggaggcccaaaagagaacagcugccggcauuaugaagaacccuaccguugauggcaucaugacgauugaccucgaucccgugaucuacgacucuaaauucgaaaagcagcuggggcaggucaugcuucuggugcucugugccguucagcugcugcucaugcgcacaagcugggcucuuugcgaggcccugacccuggcgaccggaccuaucacaacccucugggaaggcuccccggggaaauuuuggaauacaacgauugccgugucuauggcuaacaucuuccggggaagcuaucuggccggcgcugggcuugccuuuuccauuaugaaaagcgucggaaccggcaaaagaggcacagggucucaaggagagacccugggcgaaaaguggaagaaaaagcucaaucagcugucccgcaaagauuucgaccuguacaagaaaagcgggaucacagagguggaucggaccgaggcgaaggaaggacucaaaagaggcgagauuacgcaccaugccgugucccgggggucugcuaaacuucagugguuuguugaacgcaacauggucauccccgagggaagagugauugaccugggcuguggcagagggggauggagcuauuacugcgccggccugaagaaagugaccgaaguccgcggguauacaaagggaggcccugggcacgaggagcccguuccuauguccaccuacggauggaauaucgugaaacucaugucuggcaaggauguguucuaccugcccccggaaaaaugugacacacuucugugcgauaucggcgagagcuccccuagccccaccgucgaagagucuagaacaauucgggugcucaagaugguugagcccuggcugaagaacaaucaguucuguaucaaagugcugaacccuuauaugcccaccgucauugaacaccucgagcgccuucaaagaaagcaugggggaaugcuggugcggaauccucugucccgcaacagcacgcacgaaauguacuggaucucuaauggcacagggaacauuguugcuuccgugaauauggucagcagacuccugcuuaaccgguuuaccaugacccauagacgcccgacaaucgagaaagacguggaucugggagccggcacgcggcacgugaacgcugaacccgagaccccuaauauggacgucaucggggagagaauuaagaaaaucaaggaagaacacaacucuacauggcauuaugacgaugaaaaucccuacaagaccugggccuaucacggaagcuacgagguuaaagcgacaggcuccgccucuagcaugauuaacggcguggugaagcuccugaccaaaccuugggacgucgugcccaugguuacacagauggcuaugaccgauacgaccccguucgggcagcaacgcguguuuaaggaaaaagucgacacacggaccccuagauccaugcccggaacacgccgggugaugggcaucaccgccgaguggcuguggagaacgcucgggcgcaauaagaagccucggcugugcacaagagaggaguucaccaaaaagguucgcacaaacgcugccaugggagccguguuuaccgaggaaaaucagugggauagcgcgaaagcugccgucgaggacgaagauuucuggaaacuuguggaccgggagagagagcugcauaaacucggcaaguguggguccugcguuuauaacaugaugggcaaacgcgaaaagaagcugggagaguuuggcaaagccaaggggucuagagcuauuugguacauguggcuuggagcccgguaccuggaguucgaggcucucggcuuucugaaugaggaucacugguucagccgcgaaaacuccuauucugggguggagggagaaggccugcauaaacucggguacauccugagagacaucagcaagauucccggcggagccauguaugcggaugacacggccggcugggacacccggaucacagaggaugaccuucacaaugaagagaaaauuacccagcagauggauccugagcacagacaacuggcuaacgccaucuuuaagcucacauaccagaauaaggucgugaaaguccagcggcccaccccgacagggaccgugauggacauuaucucccgcaaggaucagagaggaucuggccaaguugggacguauggacugaacacauucaccaauauggaagcucagcuuauccggcagauggagggcgaaggggugcugagcaaagccgaccucgagaacccucaucugcccgaaaagaaaauuacccaguggcuggagacaaagggcgucgagcgccucaagagaauggcgaucuccggagaugacugcguggugaaacccauugaugaccgguuugccaacgcucugcuugcccugaaugauaugggcaagguucgcaaagacaucccucaauggcagccgagcaagggguggcacgauuggcaacaggugcccuucuguucucaucacuuccacgaacucauuaugaaagacggaagaaagcuggucgugccuugccggccccaagacgagcuuaucggccgcgcuagaauuucccagggggccggauggagccugaaggaaaccgcuugucucggcaaagccuacgcgcagauguggucucugauguauuuucaucggcgcgaucugagacucgccuccaacgcuaucugcagcgccguuccugugcacuggguccccacaucucggacgaccugguccauccaugcccaccaucaauggaugacaaccgaggacaugcugacaguguggaaucgcgucuggauugaagauaacccuuggauggaggacaagacccccgugacgaccugggagaauguuccguaccuugggaaaagagaagaucagugguguggcagccugaucggacucacaucccgggcuaccugggcccagaacauuccuacagcgauccagcaagugagaagccugauuggcaaugaggaguuccuugacuacaugcccucuaugaagcgcuuucggaaagaggaggaaagcgagggggcuaucugguga

SEQ ID NO: 20575 - RNA, 9873 nt, Artificial Sequence
  derived and/or modified CDS sequence (opt5) from DENV-3__HQ705612__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaaaaggccgcugacacaacgugggaggaagaggccgaacagaccggcgugucccacaaccucaugaucacagucgacgaugacggcaccaugcggauuaaagaugacgagacagagaauauccugaccgugcuucugaagacggcgcugcucaucgucagcgggauuuuuccguacucuaucccugcuacccugcuuguguggcauacauggcagaaacagacccaacgcuccggaguucugugggaugugcccagcccucccgaaacacagaaggccgagcucgaagagggcgucuacagaauuaaacagcaggggaucuucggaaagacccaagugggcguuggggugcagaaggagggagucuuucacacaauguggcacgugacgcggggcgccgugcugacccauaacggcaaacgccucgaaccgaauugggcuucuguuaagaaagaccugauuuccuaugggggaggcuggagacuuagcgcccaguggcaaaagggggaggaaguccaggugaucgcgguggagccuggcaagaaccccaagaauuuccagacaaugccuggcaccuuccagaccacaacgggggaaauuggagcuaucgcccuggauuuuaagcccggcaccucuggcucccccaucauuaaccgggaggggaaagucgugggacuguacggcaaugggguugugacaaagaacggaggcuaugucagcgggaucgcccaaaccaaugcugagccugacggcccgacacccgaacucgaggaagagauguucaaaaagcgcaaccugaccauuauggaucuucacccuggauccggcaaaacgagaaaguaccugcccgccaucgugcgggaagcuauuaagcgcagacuccggacacugauccucgccccuaccagaguuguggcggccgagauggaggaagcucugaaagggcuucccauccgcuaucagaccacagccaccaagagcgagcauacaggacgggaaauugucgaccugaugugccacgcuaccuuuacgaugagacugcucucuccugugcgcguuccgaauuacaaccugaucauuauggaugaggcccauuucacagaccccgccagcaucgcugcgcggggcuauauuuccaccagaguggggaugggagaagccgcugccaucuuuaugacagccaccccucccggcacggcugaugccuucccucagucuaaugcgcccauccaggacgaggagcgcgacauuccggaacggagcuggaacuccgggaaugaguggaucaccgauuuugcuggcaaaacagucugguucgugccuucuauuaaggccggaaacgacaucgccaacugucuucgcaaaaauggcaagaaggugauucaacugagcagaaaaaccuuugauacagaauaccagaagaccaaacucaacgacugggauuucgucguuacaaccgacaucuccgagaugggggcuaauuuuaaggccgaucgggugauugaccccagacggugccugaaacccgugauccugacggauggaccugagcgcgucauccucgcgggccccaugccugugacagccgcuucugccgcucagagacgggggcgcguuggaagaaacccgcagaaggaaaaugaccaauacauuuucaccggccagccccuuaacaaugaugaggaccacgcccacuggaccgaagcuaagaugcugcuggacaacaucaauacaccugaggggauuauccccgcccucuucgaaccugagcgggagaaaagcgcggccauugauggcgaauauagacugaagggagagucccgcaaaaccuuuguggaacuuaugcggagaggcgaccugcccgucuggcucgcucauaagguggccagcgaggggaucaaauacacagaucgcaaguggugcuucgacggacagcggaacaaucagauccuggaagagaacauggauguugagauuuggacgaaagaaggcgagaagaagaaacugagaccgcgcuggcucgacgcucggaccuauucugauccucuugcccugaaggaauuuaaagaguucgccgcugggagaaaguccaucgcgcuggaccucgugacagaaauuggacgcguccccagccaccuggcccauagaacccggaaugcucuugauaaccuggugaugcuccacacaucugagcacggcggccgcgccuacagacaugccgucgaggaacugccugagaccauggaaacgcugcuccuucuggggcugaugauccuccugaccggaggcgcuaugcuuuuucugauuuccgggaaaggaaucggcaagacaagcaucgggcucauuugugugaucgccuccucuggaaugcuguggauggcggagauuccccugcaauggaucgccagcgcuauuguucucgaguucuuuaugauggugcuucugaucccugaacccgagaagcagcggaccccgcaggacaaucaacuggccuauguggucauuggcauccucacacuggcugccaucauugcggccaacgaaaugggccuucuggagaccacgaaacgcgaucucgggauguccaaggaaccuggaguugugagccccacaucuuaccuggacguggaucugcaccccgcuuccgccuggacccucuaugcugucgccacaaccgugaucaccccuaugcuuagacauacaauugagaauagcacggcuaacguuucucuggccgcgaucgccaaccaggcugugguccugaugggccucgacaaaggguggccgauuagcaagauggaccugggagugccccuucuggcccucggcugcuacucccaggucaauccucugacccugacagcugccgugcuccuucugaucacccacuacgccaucauugggcccggacugcaggcgaaagcuacacgggaggcccaaaagagaaccgcugccggcaucaugaagaacccuacgguugauggcauuaugacaaucgaccucgaucccgugauuuaugacucuaaauucgaaaagcagcuggggcaggucaugcuucuggugcucugugccguucagcugcugcucaugcgcaccagcugggcucuuugcgaggcccugacccuggcgacaggaccuaucaccacacucugggaaggcuccccggggaaauuuuggaauacgaccaucgccgugucuauggcuaacauuuuccggggaagcuaccuggccggcgcugggcuugccuuuuccaucaugaaaagcgucggaacaggcaaaagaggcaccgggucucaaggagagacacugggcgaaaaguggaagaaaaagcucaaucagcugucccgcaaagauuucgaccuguauaagaaaagcgggauuaccgagguggaucggacggaggcgaaggaaggacucaaaagaggcgagaucacccaucacgccgugucccgggggucugcuaaacuucagugguuuguugaacgcaacauggucauucccgagggaagagugaucgaccugggcuguggcagagggggauggagcuacuauugcgccggccugaagaaagugacagaaguccgcggguacaccaagggaggcccugggcacgaggagcccguuccuauguccacauauggauggaauauugugaaacucaugucuggcaaggauguguucuaccugcccccggaaaaaugugacacccuucugugcgauaucggcgagagcuccccuagccccacagucgaagagucuagaaccauccgggugcucaagaugguugagcccuggcugaagaacaaucaguucuguauuaaagugcugaacccuuacaugcccacggucaucgaacaucucgagcgccuucaaagaaagcacgggggaaugcuggugcggaauccucugucccgcaacagcacacaugaaauguauuggauuucuaauggcaccgggaacaucguugcuuccgugaauauggucagcagacuccugcuuaaccgguuuaccaugacacacagacgcccgacgauugagaaagacguggaucugggagccggcacccggcacgugaacgcugaacccgagacaccuaauauggacgucaucggggagagaaucaagcgcauuaaagaagaacacaacucuaccuggcacuacgacgaugaaaaucccuauaagacaugggccuaccauggaagcuaugagguuaaggcgaccggcuccgccucuagcaugaucaacggcguggugaaacuccugacaaagccuugggacgucgugcccaugguuacccagauggcuaugacggauaccacaccguucgggcagcaacggguguuuaaagaaaaggucgacaccagaacaccucgcuccaugcccggaacccggagagugaugggcauuacggccgaguggcuguggcgcacacucgggcggaauaaaaagccuagacugugcacccgcgaggaguucacaaagaaaguucggaccaacgcugccaugggagccguguuuacggaggaaaaucagugggauagcgcgaaggcugccgucgaggacgaagauuucuggaaacuuguggacagagagcgcgagcugcacaagcucggcaaauguggguccugcguuuacaacaugaugggcaagagagagaagaagcugggagaguuuggcaaggccaaagggucucgggcuaucugguauauguggcuuggagcccgcuaccuggaguucgaggcucucggcuuucugaaugaggaucauugguucagcagagaaaacuccuacucugggguggagggagaaggccugcacaagcucggguauauucugcgggacaucagcaaaauccccggcggagccauguacgcggaugacaccgccggcugggacacaagaauuaccgaggaugaccuucacaaugaagagaagaucacacagcagauggauccugagcaucggcaacuggcuaacgccauuuuuaaacucaccuaucagaauaaggucgugaagguccagcgccccacaccgaccgggacggugauggacaucauuuccagaaaagaucagcggggaucuggccaaguugggacauacggacugaacaccuucaccaauauggaagcucagcuuauccgccagauggagggcgaaggggugcugagcaaggccgaccucgagaacccucaucugcccgagaaaaagaucacacaguggcuggagaccaaaggcgucgagagacucaagcggauggcgauuuccggagaugacugcguggugaagcccaucgaugaccgcuuugccaacgcucugcuugcccugaaugauaugggcaaaguuagaaaggacauuccucaauggcagccgagcaaaggguggcaugauuggcaacaggugcccuucuguucucaccacuuccaugaacucaucaugaaggacggacggaaacuggucgugccuugccgcccccaagacgagcuuauuggcagagcucggaucucccagggggccggauggagccugaaggaaacagcuugucucggcaaggccuaugcgcagauguggucucugauguacuuucaccgcagagaucugcggcucgccuccaacgcuauuugcagcgccguuccugugcauuggguccccacgucucgcaccacaugguccauccacgcccaucaccaauggaugaccacagaggacaugcugaccguguggaauagagucuggaucgaagauaacccuuggauggaggacaaaacgcccgugaccacaugggagaauguuccguaucuugggaagcgggaagaucagugguguggcagccugauuggacucaccuccagagcuacaugggcccagaacaucccuaccgcgauucagcaagugcgcagccugaucggcaaugaggaguuccuugacuacaugcccucuaugaaacgguuuagaaaggaggaggaaagcgagggggcuauuugguga

SEQ ID NO: 20576 - RNA, 9873 nt, Artificial Sequence
  derived and/or modified CDS sequence (opt5) from DENV-3__HQ705613__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaaaaggccgcugacaucacaugggaggaagaggccgaacagacgggcgugucccacaaccucaugauuaccgucgacgaugacggcacaaugcggaucaaagaugacgagaccgagaauauccugacagugcuucugaagaccgcgcugcucauugucagcgggaucuuuccguacucuauuccugcuacgcugcuuguguggcauaccuggcagaaacagacacaacgcuccggaguucugugggaugugcccagcccucccgaaacccagaaggccgagcucgaagagggcgucuacagaaucaaacagcaggggauuuucggaaagacacaagugggcguuggggugcagaaggagggagucuuucacaccauguggcacgugacacggggcgccgugcugacguauaacggcaaacgccucgaaccgaauugggcuucuguuaagaaagaccugaucuccuacgggggaggcuggagacuuagcgcccaguggcaaaagggggaggaaguccaggugauugcgguggagccuggcaagaaccccaagaauuaucagaccaugccuggcacauuccagaccaccacaggggaaaucggagcuaucgcccuggauuucaagcccggcacgucuggcucccccauuaucaaccgggaggggaaagucgugggacuguacggcaaugggguugugaccaagaacggaggcuaugucagcgggauugcccaaacaaaugcugagccugacggcccgacccccgaacucgaggaagagauguuuaaaaagcgcaaccugacaaucauggaucuucauccuggauccggcaaaaccagaaaguaccugcccgccauugugcgggaagcuaucaagcgcagacuccggacgcugauccucgccccuacaagaguuguggcggccgagauggaggaagcucugaaagggcuucccauucgcuaucagaccaccgccacaaagagcgagcacaccggacgggaaaucgucgaccugaugugccaugcuacauucaccacgagacugcucucuccugugcgcguuccgaauuacaaccugauuaucauggaugaggcccacuuuacagaccccgccagcauugcugcgcggggcuacaucuccaccagaguggggaugggagaagccgcugccaucuucaugacagccaccccucccggcacggcugaugccuuuccucagucuaaugcgcccauucaggacgaggagcgcgacaucccggaacggagcuggaacuccgggaaugaguggauuaccgauuucgcuggcaaaacagucugguuugugccuucuaucaaggccggaaacgacauugccaacugucuucgcaaaaauggcaagaaggugauccaacugagcagaaaaaccuucgauacagaauaucagaagaccaaacucaacgacugggauuuugucguuacaaccgacauuuccgagaugggggcuaauuucaaggccgaucgggugaucgaccccagacggugccugaaacccgugauccugacggauggaccugagcgcgucauucucgcgggccccaugccugugacagccgcuucugccgcucagagacgggggcgcguuggaagaaacccgcagaaggaaaaugaccaauacaucuuuaccggccagccccuuaacaaugaugaggaccaugcccacuggaccgaagcuaagaugcugcuggacaacauuaauacaccugaggggaucauucccgcccucuucgaaccugagcgggagaaaagcgcggccaucgauggcgaauauagacugaagggagagucccgcaaaaccuucguggaacuuaugcggagaggcgaccugcccgucuggcucgcucacaagguggccagcgaggggaucaaauacacagaucgcaaguggugcuuugacggacagcggaacaaucagauucuggaagagaacauggauguugagaucuggacgaaagaaggcgagaagaagaaacugagaccgcgcuggcucgacgcucggaccuauucugauccucuugcccugaaggaguucaaagaguuugccgcugggagaaaguccauugcgcuggaccucgugacagaaaucggacgcguccccagccaucuggcccacagaacccggaaugcucuugauaaccuggugaugcuccauacaucugagcacggcggccgcgccuacagacacgccgucgaggaacugccugagaccauggaaacgcugcuccuucuggggcugaugauucuccugaccggaggcgcuaugcuuuuccugaucuccgggaaaggaaucggcaagacaagcauugggcucaucugugugauugccuccucuggaaugcuguggauggcggagaucccccugcaauggauugccagcgcuaucguucucgaguuuuucaugauggugcuucugauuccugaacccgagaagcagcggaccccgcaggacaaucaacuggccuauguggucaucggcauccucacacuggcugccauuaucgcggccaacgaaaugggccuucuggagaccacgaaacgcgaucucgggauguccaaggaaccuggaguugugagccccacaucuuaccuggacguggaucugcaucccgcuuccgccuggacccucuacgcugucgccacaaccgugauuaccccuaugcuuagacacacaaucgagaauagcacggcuaacguuucucuggccgcgauugccaaccaggcugugguccugaugggccucgacaaaggguggccgaucagcaagauggaccugggagugccccuucuggcccucggcugcuauucccaggucaauccucugacccugacagcugccgugcuccuucugaucacccauuacgccauuaucgggcccggacugcaggcgaaagcuacacgggaggcccaaaagagaaccgcugccggcauuaugaagaacccuacgguugauggcaucaugacaauugaccucgaucccgugaucuaugacucuaaauuugaaaagcagcuggggcaggucaugcuucuggugcucugugccguucagcugcugcucaugcgcaccagcugggcucuuugcgaggcccugacccuggcgacaggaccuaucaccacacucugggaaggcuccccggggaaauucuggaauacgaccauugccgugucuauggcuaacaucuuucggggaagcuaccuggccggcgcugggcuugccuucuccauuaugaaaagcgucggaacaggcaaaagaggcaccgggucucaaggagagacacugggcgaaaaguggaagaaaaagcucaaucagcugucccgcaaagauuuugaccuguauaagaaaagcgggaucaccgagguggaucggacggaggcgaaggaaggacucaaaagaggcgagauuacccaccaugccgugucccgggggucugcuaaacuucagugguucguugaacgcaacauggucauccccgagggaagagugauugaccugggcuguggcagagggggauggagcuacuauugcgccggccugaagaaagugacagaaguccgcggguacaccaagggaggcccugggcacgaggagcccguuccuauguccacauacggauggaauaucgugaaacucaugucuggcaaggauguguuuuaucugcccccggaaaaaugugacacccuucugugcgauaucggcgagagcuccccuagccccacagucgaagagucuagaaccauucgggugcucaagaugguugagcccuggcugaagaacaaucaguucuguaucaaagugcugaacccuuacaugcccacggucauugaacaccucgagcgccuucaaagaaagcaugggggaaugcuggugcggaauccucugucccgcaacagcacacacgaaauguauuggaucucuaauggcaccgggaacauuguugcuuccgugaauauggucagcagacuccugcuuaaccgguucaccaugacacauagacgcccgacgaucgagaaagacguggaucugggagccggcacccggcacgugaacgcugaacccgagacaccuaauauggacgucaucggggagagaauuaagcgcaucaaagaagaacacaacucuaccuggcauuacgacgaugaaaaucccuauaagacaugggccuaccacggaagcuaugagguuaaggcgaccggcuccgccucuagcaugauuaacggcguggugaaacuccugacaaagccuugggacgucgugcccaugguuacccagauggcuaugacggauaccacaccguuugggcagcaacggguguucaaagaaaaggucgacaccagaacaccucgcuccaugcccggaacccggagagugaugggcaucacggccgaguggcuguggcgcacacucgggcggaauaaaaagccuagacugugcacccgcgaggaauuuacaaagaaaguucggaccaacgcugccaugggagccguguucacggaggaaaaucagugggauagcgcgaaggcugccgucgaggacgaagauuuuuggaaacuuguggacagagagcgcgagcugcauaagcucggcaaauguggguccugcguuuacaacaugaugggcaagagagagaagaagcugggagaguucggcaaggccaaagggucucgggcuauuugguacauguggcuuggagcccgcuaucuggaauuugaggcucucggcuuccugaaugaggaucacugguuuagcagagaaaacuccuacucugggguggagggagaaggccugcauaagcucggguauauccugcgggacaucagcaaaauucccggcggagccauguacgcggaugacaccgccggcugggacacaagaaucaccgaggaugaccuucacaaugaagagaagauuacacagcagauggauccugagcaccggcaacuggcuaacgccaucuucaaacucaccuaucagaauaaggucgugaagguccagcgccccacaccgaccgggacggugauggacauuaucuccagaaaagaucagcggggaucuggccaaguugggacauacggacugaacaccuuuaccaauauggaagcucagcuuauccgccagauggagggcgaaggggugcugagcaaggccgaccucgagaacccucaucugcccgagaaaaagauuacacaguggcuggagaccaaaggcgucgagagacucaagcggauggcgaucuccggagaugacugcguggugaagcccauugaugaccgcuucgccaacgcucugcuugcccugaaugauaugggcaaaguuagaaaggacaucccucaauggcagccgagcaaaggguggcacgauuggcaacaggugcccuuuuguucucaucacuuccacgaacucauuaugaaggacggacggaaacuggucgugccuugccgcccccaagacgagcuuaucggcagagcucggauuucccagggggccggauggagccugaaggaaacagcuugucucggcaaggccuaugcgcagauguggucucugauguacuuccaucgcagagaucugcggcucgccuccaacgcuaucugcagcgccguuccugugcacuggguccccacgucucgcaccacaugguccauccaugcccaccaucaauggaugaccacagaggacaugcugaccguguggaauagagucuggauugaagauaacccuuggauggaggacaaaacgcccgugaccacaugggagaauguuccguaccuugggaagcgggaagaucagugguguggcagccugaucggacucaccuccagagcuacaugggcccagaacauuccuaccgcgauccagcaagugcgcagccugauuggcaaugaggaauuucuugacuauaugcccucuaugaaacgguucagaaaggaggaggaaagcgagggggcuaucugguga

SEQ ID NO: 20577 - RNA, 9873 nt, Artificial Sequence
  derived and/or modified CDS sequence (opt5) from DENV-3__HQ705615__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggcgagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucucucucaaggauacccugaaaagacgcagcuggccccuuaaugagggagucauggccgugggccugguuuccauucuggcuucuagccuccugagaaacgacgugccuauggcggggccccuugucgccggaggccugcucaucgcuuguuaugugauuaccgggacauccgccgaucugaccguugaaaaggccgcugacaucacaugggaggaagaggccgaacagacgggagugagccacaaccucaugauugcggucgacgaugacggcaccaugcggaucaaagaugacgagacagagaauauccugaccgugcuucugaagacagcucugcucauugucucuggcaucuuuccguacuccauuccugccacccugcuuguguggcauacguggcagaaacagacccaacgcagcgggguucugugggaugugcccucuccucccgaaacacagaaggccgagcucgaagagggagucuacagaaucaaacagcagggcauuuucgggaagacccaagugggaguuggcgugcagaaggagggggucuuucacacaauguggcacgugacccggggagcugugcugacauauaacggcaaacgccucgaaccgaauugggccuccguuaagaaagaccugaucagcuacggcgggggauggagacuuucugcgcaguggcaaaagggcgaggaaguccaggugauugcuguggagccugggaaaaaccccaagaauuuccagacgaugccuggaaccuuccagacaaccaccggcgaaaucggggccaucgcccuggauuuuaagcccggaacauccggcagccccauuaucaaccgggagggcaaagucguggggcuguauggaaauggcguugugacgaagaacgggggauacgucuccggcauugcucaaaccaaugccgagccugacgggccgacacccgaacucgaggaagagauguucaaaaagcgcaaccugaccaucauggaucuucauccuggcagcggaaaaacaagaaaguaucugcccgcuauugugcgggaagccaucaagcgcagacuccggacccugauccucgcgccuacgagaguuguggccgcugagauggaggaagcccugaaaggccuucccauucgcuaccagacaaccgcuaccaagucugagcacacagggcgggaaaucgucgaccugaugugccaugccaccuuuacaaugagacugcucagcccugugcgcguuccgaauuauaaccugauuaucauggaugaggcccacuucaccgaccccgcuuccauugcggcccggggauacaucucuacgagagugggcaugggggaagcugccgccaucuuuaugacagcuaccccucccggaacagccgaugcguucccucagagcaaugcucccauucaggacgaggagcgcgacaucccggaacgguccuggaacucuggcaaugaguggauuaccgauuuugccgggaaaacggucugguucgugccuagcaucaaggccggcaacgacauugcuaacugucuucgcaaaaauggaaagaaggugauccaacuguccagaaaaaccuuugauacagaauaccagaagaccaaacucaacgacugggauuucgucguuacaaccgacauuucugagaugggcgccaauuuuaaggcggaucgggugaucgaccccagacggugccugaaacccgugauccugacagaugggccugagcgcgucauucucgccggacccaugccugugaccgcugccagcgcugcccagagacggggccgcguugggagaaacccgcagaaggaaaaugaccaauauaucuucacgggacagccccuuaacaaugaugaggaccaugcucacuggacagaagccaagaugcugcuggacaacauuaauaccccugagggcaucauucccgcccucuucgaaccugagcgggagaaauccgccgcuaucgauggggaauacagacugaagggcgagagccgcaaaaccuuuguggaacuuaugcggagaggagaccugcccgucuggcucgcccacaagguggcuucugagggcaucaaauauacagaucgcaaguggugcuucgacgggcagcggaacaaucagauucuggaagagaacauggauguugagaucuggaccaaagaaggagagaagaagaaacugagaccgcgcuggcucgacgcccggacauacuccgauccucuugcccugaaggaauuuaaagaguucgcugcgggcagaaagagcauugcccuggaccucgugacggaaaucgggcgcguccccucucaucuggcucacagaacccggaaugcccuugauaaccuggugaugcuccauacauccgagcacggaggccgcgccuauagacacgcugucgaggaacugccugagaccauggaaacacugcuccuucugggccugaugauucuccugaccgggggagccaugcuuuuucugaucagcggcaaagggaucggaaagacguccauuggccucaucugugugauuaccucuagcgggaugcuguggauggcggagaucccccugcaauggauugccuccgcuaucguucucgaguucuuuaugauggugcuucugauuccugaacccgagaagcagcggacaccgcaggacaaucaacuggccuacguggucaucggaauccucacccuggcugccauuaucgcggccaacgaaaugggccuucuggagacaaccaaacgcgaucucggcaugagcaaggaaccugggguugugucucccacguccuaucuggacguggaucugcaucccgcuagcgccuggacacucuacgcugucgccaccacagugauuaccccuaugcuuagacacaccaucgaaaauucuacagcuaacguuagccuggccgcgauugccaaccaggcugugguccugaugggacucgacaaaggcuggccgaucuccaagauggaccugggggugccccuucuggcccucggaugcuacucucaggucaauccucugacgcugaccgcugccgugcuccuucugaucacacauuaugccauuaucggccccgggcugcaggcgaaagcuacccgggaggcccaaaagagaacagcugccggaauuaugaagaacccuaccguugauggcaucaugacgauugaccucgaucccgugaucuacgacagcaaauucgaaaagcagcugggccaggucaugcuucuggugcucugugccguucagcugcugcucaugcgcacauccugggcucuuugcgaggcccugacccuggcgaccgggccuaucacaacccucugggaaggaucuccgggcaaauuuuggaauacaacgauugccgugagcauggcuaacaucuuccggggguccuaucuggccggagcuggccuugccuuuagcauuaugaagucugucgggaccggaaaaagaggcacaggcucccaaggggagacccugggagaaaaguggaagaaaaagcucaaucagcugagccgcaaagauuucgaccuguacaagaaauccggcaucacagagguggaucggaccgaggcgaaggaagggcucaaaagaggagagauuacgcaccaugccgugucucggggcagcgcuaaacuucagugguuuguugaacgcaacauggucauccccgaggggagagugauugaccugggauguggccggggcgggugguccuaucacugcgccggacugaagaaagugaccgaaguccgcggcuacacaaaagggggaccuggccacgaggagcccguuccuaugucuaccuauggguggaauaucgugaaacucaugagcggaaaggauguguucuaccugcccccggaaaaaugugacacacuucugugcgauaucggcgaguccagcccuucucccaccgucgaagaguccagaacaauucgggugcucaagaugguugagcccuggcugaagaacaaucaguucuguaucaaagugcugaacccuuacaugcccaccgucauugaacaucucgagcgccuucaaagaaagcacggcgggaugcuggugcggaauccucugagccgcaacucuacgcaugaaauguauuggaucuccaauggaacaggcaacauuguugcuagcgugaauauggucucuagacuccugcuuaaccgguuuaccaugacccacagacgcccgacaaucgagaaagacguggaucugggggccggaacgcggcacgugaacgcugaacccgagaccccuaauauggacgucaucggcgagagaauuaagcgcaucaaagaagaacacaacagcacauggcacuacgacgaugaaaaucccuauaagaccugggccuaccauggguccuaugagguuaaggcgacaggaucugccagcuccaugauuaacggcguggugaaacuccugaccaagccuugggacgucgugcccaugguuacacagauggcuaugaccgauacgaccccguucggccagcaacggguguuuaaagaaaaggucgacacaagaaccccucgcagcaugcccgggacacggagagugaugggaaucaccgccgaguggcuguggcgcacgcucggccggaauaaaaagccuagacugugcacacgcgaggaguucaccaagaaaguucggacaaacgcugccaugggggccguguuuaccgaggaaaaucagugggauuccgcgaaggcugccgucgaggacgaagauuucuggaaacuuguggacagagagcgcgagcugcacaagcucggaaaauguggcucuugcguuuacaacaugauggggaagagagagaagaagcugggcgaguuuggaaaggccaaaggcagccgggcuauuugguauauguggcuuggggcccgcuaccuggaguucgaggcucucggauuucugaaugaggaucauugguucuccagagaaaacucuuacagcggcguggagggggaaggacugcacaagcucggcuauauccugcgggacaucuccaaaauucccgggggcgccauguacgcggaugacacggccggaugggacaccagaaucacagaggaugaccuucacaaugaagagaagauuacccagcagauggauccugagcaucggcaacuggcuaacgccaucuuuaaacucacauaucagaauaaggucgugaagguccagcgccccaccccgacaggcaccgugauggacauuaucucuagaaaagaucagcgggggagcggacaaguuggcacguacgggcugaacacauucaccaauauggaagcucagcuuauccgccagauggagggagaaggcgugcuguccaaggccgaccucgagaacccucaucugcccgagaagaagauuacccaguggcuggagacaaaaggggucgagagacucaagcggauggcgaucagcggcgaugacugcguggugaagcccauugaugaccgcuuugccaacgcucugcuugcccugaaugauaugggaaaaguuagaaaggacaucccucaauggcagccgucuaaaggcuggcaugauuggcaacaggugcccuucuguucccaccacuuccaugaacucauuaugaaggacgggcggaaacuggucgugccuugccgcccccaagacgagcuuaucggacgggcucggauuagccagggcgccggguggucucugaaggaaaccgcuugucucggaaaggccuaugcgcagauguggucccugauguacuuucaccgcagagaucugcggcucgccagcaacgcuaucugcucugccguuccugugcauuggguccccacaucccgcacgaccuggagcauccacgcccaucaccaauggaugacaaccgacgauaugcugacaguguggaauagagucuggauugaggacaacccuuggauggaagauaaaacccccgugacgaccugggagaauguuccguaucuuggcaagcgggaggaccaguggugugggucccugaucggccucacaagcagagcuaccugggcccagaacauuccuacagcgauccagcaagugcgcucucugauuggaaaugaagaguuccuugauuacaugcccagcaugaaacgguuuagaaaggaagaggaguccgaaggcgcuaucugguga

SEQ ID NO: 20578 - RNA, 9873 nt, Artificial Sequence
  derived and/or modified CDS sequence (opt5) from DENV-3__JF920398__SS-prME
accagccugugccucaugaugauucugcccgccgcucuugccuuccaccugacgucccgggacggagaaccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacaauuuggucuaauggcgugcuggaaagcgauaugaucauucccaaaucccucgcugggccuaucagccagcacaaccaucgccccggauaucacacccaaacggccggcccuuggcaccuggggaaacuugagcuggacuuuaauuacugcgagggaacaaccguugugaucacagaaaacuguggcacccggggccccucucucagaacaaccacggucuccgggaaacugauucaugaguggugcugucgcagcugcacccugccgccucuucgguauaugggagaagauggcuguugguacgggauggagaucagacccauuucugaaaaggaggagaauauggugaaaucccucguuagcgcgggaucuggcaagguggacaacuucacaauggggguccugugccuggcuauccucuuugaagaggugaugcggggaaaguucggcaaaaagcacaugauugccggcguuuuccugaccuuugugcuucugcucagcgggcagaucacauggcgcgauauggcccauacccugauuaugaucggauccaaugcuagcgacagaaugggcaugggggucacguaucuggcccuuaucgcgacauucaaaauucagcccuuucuggcucucggauucuuucugcggaagcucaccucuagagaaaaccugcuucugggcguggggcucgccauggccacaacccugcaacugccugaggauaucgaacagauggcuaauggaauugcccuuggccugauggcucucaaacugaucacccaguucgagacauaccagcucuggacggcccugauuucccuuaccuguagcaacacaaucuuuacccugacaguggcguggcgcaccgccacgcucauccuggcuggcgucucccugcuuccgguuugccaaucuagcuccaugcggaagacagacuggcugcccauggccguggcugccaugggggugccuccccucccucuguucaucuuuucucucaaggauacccugaaaagacgcagcuggccccuuaaugagggagucauggccgugggccugguuuccauccuggcuucuagccuccugagaaacgacgugccuauggcggggccccuugucgccggaggccugcucauugcuuguuaugugaucaccgggacauccgccgaucugaccguugaaaaggccgcugacauuacaugggaggaagaggccgaacagacgggagugagccacaaccucaugaucaccgucgacgaugacggcacaaugcggaucaaagaugacgagaccgagaauauucugacagugcuucugaagaccgcgcugcucaucgucucuggcauuuucccguacuccaucccugcuacgcugcuuguguggcauaccuggcagaaacagacacaacgcagcgggguucugugggaugugcccucuccucccgaaacccagaaggccgagcucgaagagggagucuacagaauuaaacagcagggcaucuuugggaagacacaagugggaguuggcgugcagaaggagggggucuuccacaccauguggcacgugacacggggagccgugcugacguauaacggcaaacgccucgaaccgaauugggcuuccguuaagaaagaccugauuagcuacggcgggggauggagacuuucugcccaguggcaaaagggcgaggaaguccaggugaucgcgguggagccugggaaaaaccccaagaauuuucagaccaugccuggaacauuccagaccaccacaggcgaaaucggggcuauugcccuggauuucaagcccggaacguccggcagccccaucauuaaccgggagggcaaagucguggggcuguauggaaauggcguugugaccaagaacgggggauacgucuccggcaucgcccaaacaaaugcugagccugacgggccgacccccgaacucgaggaagagauguuuaaaaagcgcaaccugacaauuauggaucuucauccuggcagcggaaaaaccagaaaguaucugcccgccaucgugcgggaagcuaucaagcgcagacuccggacgcugauucucgccccuacaagaguuguggcggccgagauggaggaagcucugaaaggccuucccauccgcuaccagaccaccgccacaaagucugagcacaccgggcgggaaauugucgaccugaugugccaugcuacauucaccaugagacugcucagcccugugcgcguuccgaauuauaaccugaucauuauggaugaggcccacuuuacggaccccgccuccaucgcugcgcggggauacaucucuacaagagugggcaugggggaagccgcugccauuuucaugaccgccacaccucccggaaccgcugaugccuuuccucagagcaaugcgcccauccaggacgaggagcgcgacauuccggaacgguccuggaacucuggcaaugaguggaucacggauuucgcugggaaaaccgucugguuugugccuagcauuaaggccggcaacgacaucgccaacugucuucgcaaaaauggaaagaaggugauucaacuguccagaaaaacauucgauaccgaauaccagaagacaaaacucaacgacugggauuuugucguuaccacagacaucucugagaugggcgcuaauuucaaggccgaucgggugaucgaccccagacggugccugaaacccgugauucugaccgaugggccugagcgcgucauccucgcgggacccaugccugugacggccgcuagcgccgcucagagacggggccgcguugggagaaacccgcagaaggaaaaugaccaauauauuuuuacaggacagccccuuaacaaugaugaggaccaugcccacuggaccgaagcuaagaugcugcuggacaacaucaauaccccugagggcauuauccccgcccucuucgaaccugagcgggagaaauccgcggccaucgauggggaauacagacugaagggcgagagccgcaaaacauucguggaacuuaugcggagaggagaccugcccgucuggcucgcucacaagguggccucugagggcauuaaauauaccgaucgcaaguggugcuuugacgggcagcggaacaaucagauccuggaagagaacauggauguugagauuuggacaaaagaaggagagaagaagaaacugagaccgcgcuggcucgacgcucggacguacuccgauccucuugcccugaaggaguucaaagaguuugccgcuggcagaaagagcaucgcgcuggaccucgugaccgaaauugggcgcguccccucucaucuggcccacagaacacggaaugcucuugauaaccuggugaugcuccauaccuccgagcacggaggccgcgccuauagacacgccgucgaggaacugccugagacaauggaaacccugcuccuucugggccugaugauccuccugacagggggagcuaugcuuuuccugaucagcggcaaagggauuggaaagaccuccaucggccucauuugugugaucgccucuagcgggaugcuguggauggcggagauuccccugcaauggaucgccuccgcuauuguucucgaguuuuucaugauggugcuucugaucccugaacccgagaagcagcggacaccgcaggacaaucaacuggccuacguggucaucggcauucucacccuggcugccaucauugcggccaacgaaaugggccuucuggagacaaccaaacgcgaucucggcaugagcaaggaaccugggguugugucucccacguccuaucuggacguggaucugcaucccgcuagcgccuggacacucuacgcugucgccaccacagugaucaccccuaugcuuagacacaccauugaaaauucuacagcuaacguuagccuggccgcgaucgccaaccaggcugugguccugaugggacucgacaaaggcuggccgaucuccaagauggaccugggggugccccuucuggcccucggaugcuacucucaggucaauccucugacgcugaccgcugccgugcuccuucugauuacacauuaugccaucauuggccccgggcugcaggcgaaagcuacccgggaggcccaaaagagaacagcugccggaaucaugaagaacccuaccguugauggcauuaugacgaucgaccucgaucccgugaucuacgacagcaaauuugaaaagcagcugggccaggucaugcuucuggugcucugugccguucagcugcugcucaugcgcacauccugggcucuuugcgaggcccugacccuggcgaccgggccuauuacaacccucugggaaggaucuccgggcaaauucuggaauacaacgaucgccgugagcauggcuaacauuuuucggggguccuaucuggccggagcuggccuugccuucagcaucaugaagucugucgggaccggaaaaagaggcacaggcucccaaggggagacccugggagaaaaguggaagaaaaagcucaaucagcugagccgcaaagauuuugaccuguacaagaaauccggcauuacagagguggaucggaccgaggcgaaggaagggcucaaaagaggagagaucacgcaccaugccgugucucggggcagcgcuaaacuucagugguucguugaacgcaacauggucauucccgaggggagagugaucgaccugggauguggccggggcgggugguccuauuacugcgccggacugaagaaagugaccgaaguccgcggcuauacaaaagggggaccuggccacgaggagcccguuccuaugucuaccuacggguggaauaucgugaaacucaugagcggaaaggauguguuuuaccugcccccggaaaaaugugacacacuucugugcgauauuggcgaguccagcccuucucccaccgucgaagaguccagaacaauccgggugcucaagaugguugagcccuggcugaagaacaaucaguucuguauuaaagugcugaacccuuauaugcccaccgucaucgaacaccucgagcgccuucaaagaaagcauggcgggaugcuggugcggaauccucugagccgcaacucuacgcacgaaauguacuggauuuccaauggaacaggcaacaucguugcuagcgugaauauggucucuagacuccugcuuaaccgguucaccaugacccauagacgcccgacaaucgagaaagacguggaucugggggccggaacgcggcacgugaacgcugaacccgagaccccuaauauggacgucauuggcgagagaaucaagcgcauuaaagaagaacacaacagcacauggcauuaugacgaugaaaaucccuacaagaccugggccuaucacggguccuacgagguuaaggcgacaggaucugccagcuccaugaucaacggcguggugaaacuccugaccaagccuugggacgucgugcccaugguuacacagauggcuaugaccgauacgaccccguuuggccagcaacggguguucaaagaaaaggucgacacaagaaccccucgcagcaugcccgggacacggagagugaugggaauuaccgccgaguggcuguggcgcacgcucggccggaauaaaaagccuagacugugcacacgcgaggaauuuaccaagaaaguucggacaaacgcugccaugggggccguguucaccgaggaaaaucagugggauuccgcgaaggcugccgucgaggacgaagauuuuuggaaacuuguggacagagagcgcgagcugcauaagcucggaaaauguggcucuugcguuuauaacaugauggggaagagagagaagaagcugggcgaguucggaaaggccaaaggcagccgggcuaucugguacauguggcuuggggcccgcuaccuggaauuugaggcucucggauuccugaaugaggaucacugguuuuccagagaaaacucuuauagcggcguggagggggaaggacugcauaagcucggcuacauccugcgggacauuuccaaaauccccgggggcgccauguaugcggaugacacggccggaugggacaccagaauuacagaggaugaccuucacaaugaagagaagaucacccagcagauggauccugagcaccggcaacuggcuaacgccauuuucaaacucacauaccagaauaaggucgugaagguccagcgccccaccccgacaggcaccgugauggacaucaucucuagaaaagaucagcgggggagcggacaaguuggcacguaugggcugaacacauuuaccaauauggaagcucagcuuauucgccagauggagggagaaggcgugcuguccaaggccgaccucgagaacccucaucugcccgagaagaagaucacccaguggcuggagacaaaaggggucgagagacucaagcggauggcgauuagcggcgaugacugcguggugaagcccaucgaugaccgcuucgccaacgcucugcuugcccugaaugauaugggaaaaguuagaaaggacauuccucaauggcagccgucuaaaggcuggcacgauuggcaacaggugcccuuuuguucccaucacuuccacgaacucaucaugaaggacgggcggaaacuggucgugccuugccgcccccaagacgagcuuauuggacgggcucggaucagccagggcgccggguggucucugaaggaaaccgcuugucucggaaaggccuacgcgcagauguggucccugauguauuuccaucgcagagaucugcggcucgccagcaacgcuaucugcucugccguuccugugcacuggguccccacaucccgcacgaccuggagcauucaugcccaccaucaauggaugacaaccgaggacaugcugacaguguggaauagagucuggaucgaagauaacccuuggauggaggacaaaacccccgugacgaccugggagaauguuccguaccuuggcaagcgggaagaucaguggugugggucccugauuggccucacaagcagagcuaccugggcccagaacaucccuacagcgauucagcaagugcgcucucugaucggaaaugaggaauuucuugacuacaugcccagcaugaaacgguucagaaaggaggaggaauccgagggcgcuaucugguga

SEQ ID NO: 20579 - RNA, 9873 nt, Artificial Sequence
  derived and/or modified CDS sequence (opt5) from DENV-3__JF920402__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggcgagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaccucagcccauggagcugaaguauucuuggaaaaccugggggaaggccaagaucgugacagccgaaacccaaaacuccagcuucauuaucgauggaccuaauacacccgagugcccgucugucuccagagcuuggaacgugugggaaguggaggacuacggcuuuggcgucuucaccacgaauaucuggcucaaacugcgcgaaguuuauacacagcugugugaccaccggcuuaugagcgcggccgugaaggaugagagagcugugcaugccgacaugggguacuggauugagucccagaaaaacggaucuuggaagcucgaaaaagccagccugaucgaggucaagaccugcaccuggccuaagucccacacacuguggucuaauggcgugcucgaaagcgauaugauuauccccaaaucccuggcugggccuauuagccagcauaaccaccgccccggauaccacacccaaacggccggcccuuggcaucuugggaagcuggagcucgacuuuaauuauugcgagggaacaaccguugugaucacagaaaacuguggcgcgcggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaucuaucagcucuggaccgcgcugauuucccuuacauguagcaacacgaucuucacccugacaguggccuggcgcaccgcuacacucauccuggccggcgucucccugcuuccgaugugccaaucuagcuccaugcggaagaccgacuggcugcccauggcuguugccgccaugggggugccuccccucccucuguuuauuuucucucucaaggauacgcugaaaagacgcagcuggccccuuaaugagggagugauggcugucggccugguguccauccuggcgucuagccuccugagaaacgacguuccuauggccgggccccuuguggcuggaggccugcucauugccuguuacgucaucacagggaccuccgccgaucugaccguggaaaaggcugccgacauuacaugggaggaagaggcggaacagaccggaguuagccauaaccucaugaucacaguggacgaugacggcacgaugcggaucaaagaugacgagaccgagaauauucugacaguccuucugaagaccgcucugcucaucgugucuggcauuuuuccguauuccaucccugccacacugcuugucuggcacaccuggcagaaacagacgcaacgcagcggggugcugugggauguucccucuccucccgaaacccagaaggccgagcucgaagagggaguguacagaauuaaacagcagggcaucuucgggaagacacaagucggagugggcguucagaaggaggggguguuucacaccauguggcaugucacacggggagcugugcugaccuacaacggcaaacgccucgaaccgaauugggccuccgugaagaaagaccugauuagcuauggcgggggauggagacuuucugcgcaguggcaaaagggcgaggaaguucaggucaucgcuguggagccugggaaaaaccccaagaauuuccagacaaugccuggaacguuccagaccacaaccggcgaaaucggggccauugcccuggauuuuaagcccggaaccuccggcagccccaucauuaaccgggagggcaaaguggucgggcuguacggaaauggcgugguuacaaagaacgggggauauguguccggcaucgcucaaacgaaugccgagccugacgggccgacccccgaacucgaggaagagauguucaaaaagcgcaaccugacaauuauggaucuucacccuggcagcggaaaaaccagaaaguaccugcccgcuaucguccgggaagccaucaagcgcagacuccggacacugauucucgcgccuaccagagugguugccgcugagauggaggaagcccugaaaggccuucccauccgcuaucagacgacagcuaccaagucugagcauaccgggcgggaaauuguggaccugaugugccacgccacauuuaccaugagacugcucagcccuguccgcgugccgaauuacaaccugaucauuauggaugaggcccauuucacagaccccgcuuccaucgcggcccggggauauaucucuaccagaguuggcaugggggaagcugccgccauuuuuaugacggcuacaccucccggaaccgccgaugcguucccucagagcaaugcucccauccaggacgaggagcgcgacauuccggaacgguccuggaacucuggcaaugaguggaucacagauuuugccgggaaaaccgugugguucgucccuagcauuaaggccggcaacgacaucgcuaacugucuucgcaaaaauggaaagaaggugauucaacuguccagaaaaacguuugauaccgaauaccagaagacaaaacucaacgacugggauuucguggucaccacagacaucucugagaugggcgccaauuuuaaggcggaucggguuaucgaccccagacggugccugaaacccgugauucugaccgaugggccugagcgcgugauccucgccggacccaugccugucacagcugccagcgcugcccagagacggggccgcguggggagaaacccgcagaaggaaaaugaccaauacauuuucaccggacagccccuuaacaaugaugaggaccacgcucacuggacggaagccaagaugcugcuggacaacaucaauacaccugagggcauuauccccgcccucuucgaaccugagcgggagaaauccgccgcuaucgauggggaauauagacugaagggcgagagccgcaaaaccuuuguugaacuuaugcggagaggagaccugcccguguggcucgcccauaaggucgcuucugagggcauuaaauacaccgaucgcaaguggugcuucgacgggcagcggaacaaucagauccuggaagagaacauggauguggagauuuggacaaaagaaggagagaagaagaaacugagaccgcgcuggcucgacgcccggaccuauuccgauccucuugcccugaaggaauuuaaagaguucgcugcgggcagaaagagcaucgcccuggaccucguuacagaaauugggcgcgugcccucucaccuggcucauagaacgcggaaugcccuugauaaccuggucaugcuccacaccuccgagcacggaggccgcgccuacagacaugcuguggaggaacugccugagacaauggaaacccugcuccuucugggccugaugauccuccugacagggggagccaugcuuuuucugaucagcggcaaagggauuggaaagaccuccaucggccucauuugugucaucgcgucuagcgggaugcuguggauggccgagauuccccugcaauggaucgcuuccgccauugugcucgaguucuuuaugaugguucuucugaucccugaacccgagaagcagcggacgccgcaggacaaucaacuggcuuauguggugaucggcauucucacccuggccgcgaucauugccgcuaacgaaaugggccuucuggagacaaccaaacgcgaucucggcaugagcaaggaaccuggggucguuucucccacauccuaccuggacguggaucugcaccccgccagcgcuuggacccucuaugccguggcuacgacagucaucaccccuaugcuuagacauacaauugaaaauucuaccgccaacgugagccuggcggccaucgcuaaccaggccguugugcugaugggacucgacaaaggcuggccgaucuccaagauggaccugggggucccccuucuggcucucggaugcuacucucaggugaauccucugacccugacagccgccguccuccuucugauuacgcacuacgcgaucauuggccccgggcugcaggcuaaagccacccgggaggcucaaaagagaacagccgccggaaucaugaagaacccuaccguggauggcauuaugacaaucgaccucgaucccguuaucuaugacagcaaauucgaaaagcagcugggccaggugaugcuucugguccucugugugguucagcugcugcucaugcgcaccuccugggcucuuugcgaggcccugacgcuggcgacagggccuauuaccacccucugggaaggaucuccgggcaaauuuuggaauacaaccaucgccgugagcauggcuaacauuuuccggggguccuaccuggccggagcuggccuugccuuuagcaucaugaagucugucgggacaggaaaaagaggcacgggcucccaaggggagacccugggagaaaaguggaagaaaaagcucaaucagcugagccgcaaagauuucgaccuguauaagaaauccggcauuacagagguggaucggaccgaggcgaaggaagggcucaaaagaggagagaucacacaucacgccgugucucggggcagcgcuaaacuucagugguuuguugaacgcaacauggucauucccgaggggagagugaucgaccugggauguggccggggcgggugguccuacuauugcgccggacugaagaaagugaccgaaguccgcggcuacacgaaagggggaccuggccacgaggagcccguuccuaugucuaccuauggguggaauaucgugaaacucaugagcggaaaggauguguucuaccugcccccggaaaaaugugacacacuucugugcgauauuggcgaguccagcccuucucccaccgucgaagaguccagaacaauccgggugcucaagaugguugagcccuggcugaagaacaaucaguucuguauuaaagugcugaacccuuacaugcccaccgucaucgaacaucucgagcgccuucaaagaaagcacggcgggaugcuggugcggaauccucugagccgcaacucuacacaugaaauguauuggauuuccaauggaaccggcaacaucguugcuagcgugaauauggucucuagacuccugcuuaaccgguuuacgaugacacacagacgcccgaccaucgagaaagacguggaucugggggccggaacccggcacgugaacgcugaacccgagacaccuaauauggacgucauuggcgagagaaucaagcgcauuaaagaagaacacaacagcacguggcacuacgacgaugaaaaucccuauaagaccugggccuaccauggguccuaugagguuaaggcgacaggaucugccagcuccaugaucaacggcguggugaaacuccugaccaagccuugggacgucgugcccaugguuacacagauggcuaugaccgauacaaccccguucggccagcaacggguguuuaaagaaaaggucgacacgagaaccccucgcagcaugcccgggacacggagagugaugggaauuaccgccgaguggcuguggcgcacacucggccggaauaaaaagccuagacugugcacccgcgaggaguucacgaagaaaguucggacaaacgcugccaugggggccguguuuaccgaggaaaaucagugggauuccgcgaaggcugccgucgaggacgaagauuucuggaaacuuguggacagagagcgcgagcugcacaagcucggaaaauguggcucuugcguuuacaacaugauggggaagagagagaagaagcugggcgaguuuggaaaggccaaaggcagccgggcuaucugguauauguggcuuggggcccgcuaccuggaguucgaggcucucggauuucugaaugaggaucauugguucuccagagaaaacucuuacagcggcguggagggggaaggacugcacaagcucggcuauauccugcgggacauuuccaaaauccccgggggcgccauguacgcggaugacacagccggaugggacaccagaauuacggaggaugaccuucacaaugaagagaagaucacccagcagauggauccugagcaucggcaacuggcuaacgccauuuuuaaacucacauaucagaauaaggucgugaagguccagcgccccaccccgacaggcaccgugauggacaucaucucuagaaaagaucagcgggggagcggacaaguuggcacauacgggcugaacaccuucacgaauauggaagcucagcuuauucgccagauggagggagaaggcgugcuguccaaggccgaccucgagaacccucaucugcccgagaagaagaucacacaguggcuggagaccaaaggggucgagagacucaagcggauggcgauuagcggcgaugacugcguggugaagcccaucgaugaccgcuuugccaacgcucugcuugcccugaaugauaugggaaaaguuagaaaggacauuccucaauggcagccgucuaaaggcuggcaugauuggcaacaggugcccuucuguucccaccacuuccaugaacucaucaugaaggacgggcggaaacuggucgugccuugccgcccccaagacgagcuuauuggacgggcucggaucagccagggcgccggguggucucugaaggaaaccgcuugucucggaaaggccuaugcgcagauguggucccugauguacuuucaccgcagagaucugcggcucgccagcaacgcuaucugcucugccguuccugugcauuggguccccacaucccgcaccacauggagcauucacgcccaucaccaauggaugacgaccgaggacaugcugacaguguggaauagagucuggaucgaagauaacccuuggauggaggacaaaacccccgugacaaccugggagaauguuccguaucuuggcaagcgggaagaucaguggugugggucccugauuggccucacgagcagagcuaccugggcccagaacaucccuacagcgauucagcaagugcgcucucugaucggaaaugaggaguuccuugacuacaugcccagcaugaaacgguuuagaaaggaggaggaauccgagggcgcuaucugguga

SEQ ID NO: 20580 - RNA, 9873 nt, Artificial Sequence
  derived and/or modified CDS sequence (opt5) from DENV-3__JF937652__SS-prME
accagccucugccucaugaugauccuccccgccgcucuugccuuccaccugacaucccgggacggagagccucggaugauuguggggaagaacgaacgcgggaagucucuccuguuuaagacggcgagcggcaucaauauguguacccuuauugcuauggaucugggggagaugugcgacaacacagugaccuacaaguguccgcauaucacagaaguugagcccgaagauauugacugcugguguaaucucaccuccacaugggugaccuauggaacgugcaaccaggccggcgagcacagacgggauaagcgcucuguggcccuggcuccucaugucgggaugggacuggacaccagaacacaaaccuggaugagcgccgagggcgcuuggcggcaggucgaaaagguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaucgggauuuugucgaagggcucagcggagcuaccuggguggacgugguccuggagcacggcgggugcguuaccacaauggccaagaacaaacccacgcuggauauugagcuccagaagaccgaagcuacacaacuggccacccuucgcaaacuguguaucgagggaaagauuacaaauaucaccacggacuccagaugcccuacacagggcgaagcgacccucccggaggaacaggaucagaacuauguguguaaacacaccuacguggaccggggcugggggaauggaugcggccuguucgggaagggaagccuugucacaugcgccaaguuucaaugucuggagcccauugagggcaaagugguucaguaugaaaaccucaaguacaccgugaucaucacaguccauacgggggaucagcaccaggugggaaaugagacccaaggcguuacagcugaaauuaccccucaggccucuacaaccgaggcugugcugcccgaauauggcacgcuggggcucgagugcuccccucgcaccggacuggacuucaacgagaugauccuucugacaaugaaaaauaaggccuggaugguccauagacagugguuuuucgaccucccccugccguggaccagcggcgccacaaccgaaacgccuacauggaaccggaaagagcuucuggugaccuuuaagaaugcucacgcgaaaaagcaagaagucgugguucucgggucucaggagggagccaugcacacagcucugaccggcgccaccgaaauucagaacuccgggggcacaagcaucuucgccggacaucugaagugucgccucaaaauggauaagcuggagcuuaaaggcaugucuuacgcuaugugcacgaacaccuuugugcugaagaaagaggucuccgaaacacagcacgggaccauucucaucaagguggaguacaagggagaagacguucccuguaaaaucccuuucagcacagaggauggccaagggaaggcccauaauggaagacugauuaccgcgaaccccguggucacgaaaaaggaggaacuggugaauaucgaggcugaacccccuuucggcgaguccaacauugugaucgggauuggcgacaaugcccuuaaaaucaacugguauaagaagggaucuagcaucggcaaaauguuugaagccacagcuagaggggccagacgcauggcuauucucggagauaccgccugggacuucggcuccguugggggaguccugaauagccugggcaagauggugcaccagaucuuugggucugcguacaccgcccucuucuccggcgugagcugggucaugaaaauuggaaucggcgugcugcuuacauggauugggcugaacucuaagaauaccagcauguccuuuucuugcaucgcuauuggaaucaucacacucuaucugggcgccguugugcaggcugauauggggugugucauuaacuggaaaggaaaggagcugaagugcggcagcgggaucuucgugacgaaugagguucauaccuggacagaacaguacaaauuucaagccgacuccccgaagcggcuugcgaccgccauugcuggcgccugggagaacggaguguguggcaucagaagcacaacccgcauggaaaaucuccuguggaaacagauugcuaacgagcugaauuauauccucugggaaaacaacaucaagcugacggucgugguuggggauauuaucggagugcuugagcagggcaaacggacccugacaccccagccuauggagcucaaguacucuuggaaaaccugggggaaggccaagauugucacagccgaaacccaaaauuccagcuucaucauugacggacccaacacaccugagugccccucuguguccagagcuuggaaugugugggaagucgaggauuauggcuuuggcguuuucaccacgaacaucuggcugaaacugcgcgaaguguacacacagcuuugugaccaccggcucaugagcgcggccgugaaggacgagagagcuguccacgccgauaugggguacuggaucgagucccagaaaaauggaucuuggaagcuggaaaaagccagccugauugaggugaagaccugcaccuggccgaagucccauacacucuggucuaacggcguucuggaaagcgacaugaucauuccuaaaucccuugcugggcccaucagccagcacaauuaucgcccuggauaccauacccaaacggccggccccuggcaccuggggaagcucgagcuggauuuuaacuauugcgagggaacaaccguggucauuacagaaaauuguggcacccggggcccuucucugagaacaaccacgguguccgggaaacuuauccacgaguggugcugucgcagcugcacccugcccccgcugcgguacaugggagaagacggcuguugguaugggauggagaucagaccuauuucugaaaaggaggagaacaugguuaaaucccuggugagcgcgggaucuggcaaggucgauaauuucacaaugggggugcucugccuggcuauccuuuuugaagagguuaugcggggaaagcugggcaaaaagcauaugauugccggcguguucuucaccuuuguccuccugcugagcgggcagaucacauggcgcgacauggcccacacccuuauuaugaucggauccaacgcuagcgauagaaugggcaugggggugacguaccuggcccucauugcgacauucaaaauccagcccuuucuggcucucggauucuuucugcggaaacuuaccucuagagaaaaucugcuccugggcguggggcuggccauggccacaacccuucaacugcccgaggacaucgaacagauggcuaacggaauugcccucggccugauggcucucaaacugaucacccaguucgagacauaucagcuuuggacggcccugauuucccucaccuguagcaauacaaucuuuacccugacagucgcguggcgcaccgccacgcugauucuugcuggcguuucccugcucccugugugccaaucuagcuccaugcggaagacagauuggcugccgauggccguggcugccaugggggugcccccucucccccuguucaucuuuggacuuaaggacacccugaaaagacgcucuuggccucugaacgagggcgugauggccguugggcucgugagcauccuggcuuccucucuucugagaaacgauguccccauggcgggaccucucguggccggcgggcugcucauugcuuguuacguuaucaccggaacaagcgccgaccugaccguggaaaaggccgcugauauuacaugggaggaagaggccgaacagacgggcgucucccauaaucuuaugaucaccguggacgacgauggcacaaugcggauuaaagacgaugagaccgagaacauccugacaguccugcucaagaccgcgcugcuuaucgugagcgggauuuuccccuacucuaucccggcuacgcugcucguuuggcacaccuggcagaaacagacacaacgcuccggagugcugugggacgucccuucucccccugaaacccagaaggccgagcucgaagagggcguguauagaauuaaacagcaggggaucuuuggaaagacacaaguuggcguggggguccagaaggagggaguguuccauaccauguggcacgugacacggggcgccguucugacguacaauggcaaacgccuugaacccaacugggcuuccgucaagaaagaucugauuuccuaugggggaggcuggagacugagcgcccaguggcaaaagggggaggaaguccaggugaucgcggucgagccgggcaagaauccuaagaacuuucagaccaugcccggcacauuccagaccaccacaggggaaauuggagcuaucgcccucgacuucaagccuggcacgucuggcucccccaucauuaaucgggaggggaaagugguuggacuguacggcaacgggguggucaccaagaauggaggcuaugugagcgggaucgcccaaacaaacgcugagcccgauggcccuaccccggaacuugaggaagagauguuuaaaaagcgcaaucugacaauuauggaccuccaccccggauccggcaaaaccagaaaguaccugccugccaucguucgggaagcuauuaagcgcagacuccggacgcugauccuugcccccacaagaguggucgcggccgagauggaggaagcucugaaagggcugccuauccgcuaucagaccaccgccacaaagagcgagcauaccggacgggaaauuguggaucucaugugccacgcuacauucaccaugagacugcuuucucccguucgcgugccuaacuacaaucugaucauuauggacgaggcccauuuuacggauccggccagcaucgcugcgcggggcuacauuuccacaagagucgggaugggagaagccgcugccaucuucaugaccgccacacccccuggcaccgcugacgccuuuccccagucuaacgcgccuauccaggaugaggagaaagacauucccgaacgcagcuggaauagcgggaacgaguggaucacggacuucgcuggcaagaccgugugguuugugccgucuauuaaagccggaaacgauaucgccaauugucuccggaagaacggcaagaaagucauucaacugagcagaaagacauucgacaccgaauaucagaaaacaaagcugaaugauugggacuuuguugugaccacagauaucuccgagaugggggcuaacuucaaagccgaccgcgugauugauccucggagaugccucaagcccgucauccuuaccgacggacccgagcgggugauccuggcgggcccuaugcccguuacggccgcuucugccgcucagcgcagagggcgggugggacgcaauccucagaaggaaaacgaucaauacauuuuuacaggccagccgcugaauaacgacgaggaucacgcccauuggaccgaagcuaaaaugcuccuggacaauaucaacacccccgaggggauuaucccugcccuuuucgaacccgagagagaaaagagcgcggccauugacggcgaauaucggcugaaaggagaguccagaaagacauucgucgaacucaugcgccggggcgaucugccuguguggcuggcucacaaaguugccagcgaggggaucaaguacaccgacagaaaauggugcuuugauggacagcgcaauaaccagauccucgaagagaauauggacguggagauuuggacaaaggaaggcgagaagaagaaacuucggcccagauggcuggaugcucgcacguauucugacccgcuggcccucaaagaguucaaagaguuugccgcugggcggaaauccaucgcgcuggaucuugucaccgaaauuggaagagugccuagccaccuggcccaucgcacaagaaacgcucucgacaaucuggucaugcugcacaccucugagcauggcggccgggccuaccgccacgccguggaggaacuccccgagacaauggaaacccuucugcugcucgggcugaugauccuucugacgggaggcgcuaugcuguuccugauuuccgggaagggaaucggcaagaccagcaucgggcugauuuguguuaucgccuccucuggaaugcucuggauggcggagauuccucuucaauggaucgccagcgcuauugugcuggaguuuuucaugauggugcugcucauccccgaaccugagaaacagagaacaccccaggauaaccaacuggccuaugucguuauuggcauccuuacccuggcugccaucauugcggccaaugaaaugggccuccuggagacaaccaagcgggaccuggggauguccaaagaaccgggaguggugagcccuacgucuuaccucgaugucgaccuucaccccgcuuccgccuggacacuguacgcuguggccaccacaguuaucacccccaugcugcgccauaccauugagaacagcacagcuaacgugucucucgccgcgaucgccaaucaggcugucgugcugaugggccuugauaagggguggccuauuagcaaaauggaccugggagucccgcuccuggcccugggcugcuauucccaggugaacccccucacgcuuaccgcugccguucugcugcucaucacacacuacgccaucauugggccuggacugcaggcgaaggcuaccagagaggcccaaaagcggacagcugccggcaucaugaaaaaucccaccguggacggcauuaugacgaucgaucuugacccugucauuuaugauucuaaguuugaaaaacagcugggacaggugaugcuccugguucugugugccgugcagcuccuucugaugagaacaagcugggcucugugcgaggcccucacccuggcgaccggacccaucacaacccuuugggaaggcuccccugggaaguucuggaacacaacgaucgccgucucuauggcuaauauuuuucgcggaagcuaccuggccggcgcugggcucgccuucuccaucaugaaaagcgugggaaccggcaagcggggcacagggucucaaggagagacccugggcgaaaaguggaaaaagaaacugaaccagcucuccagaaaggacuuugaucuuuauaaaaagagcgggauuacagagguggaccgcaccgaggcgaaagaaggacugaagcggggcgagaucacgcaucacgccguuuccagagggucugcuaagcugcagugguucgucgaacggaauauggugauuccggagggacgcgugaucgaucucggcuguggcagagggggauggagcuacuauugcgccggccugaaaaaggucaccgaaguucggggguacacaaaaggaggccccgggcaugaggagccugugcccauguccaccuacggauggaacauugugaaacuuaugucuggcaaagacgucuuuuaucugccucccgaaaagugugauacacuccugugcgacaucggcgagagcuccccgagcccuaccguggaagagucucgcacaaucagaguucugaagaugguggagcccuggcucaaaaauaaccaguucuguauuaagguccuuaaucccuacaugccuaccgugaucgaacaccuggagcggcugcaacgcaaacacgggggaaugcucguuagaaacccccugucccggaauagcacgcaugaaauguauuggauuucuaacggcacagggaauaucguggcuuccgucaacauggugagccgccuucugcucaacagauucaccaugacccaccggagaccuacaauugagaaggauguggaccugggagccggcacgcgccaugucaaugcugaaccggagacccccaacauggauguuaucggggagcggaucaaaagaauuaaggaggaacacaauucuacauggcacuacgacgacgaaaacccuuauaagaccugggccuaccauggaagcuaugaggugaaagcgacaggcuccgccucuagcaugaucaauggcguggucaagcugcucaccaaacccugggaugugguuccuauggugacacagauggcuaugaccgacacgacccccuuugggcagcaacgcgucuucaaggaaaaaguggauacacggaccccgagauccaugccuggaacacgccggguuaugggcauuaccgccgaguggcuguggagaacgcuugggcgcaacaagaagccccggcugugcacaagagaggaauuuaccaaaaaggugcgcacaaaugcugccaugggagccgucuucaccgaggaaaaccagugggacagcgcgaaagcugccguggaggaugaagacuuuuggaagcucguugaucgggagagagagcugcacaaacuuggcaaguguggguccugcguguacaauaugaugggcaaacgcgaaaagaagcugggagaguucggcaaagccaaggggucuagagcuaucugguacauguggcucggagcccgguaucuggaauuugaggcucugggcuuccucaacgaggaccauugguuuagccgcgaaaauuccuacucuggggucgagggagaaggccugcacaaacuuggguauauucugagagauaucagcaagaucccuggcggagccauguacgcggacgauacggccggcugggacacccggauuacagaggacgaucuccauaacgaagagaaaaucacccagcagauggaccccgagcacagacaacuggcuaaugccauuuucaaacuuacauaucagaacaagguggucaaagugcagcggccuacccccacagggaccguuauggauaucauuucccgcaaggaccagagaggaucuggccaaguggggacguacggacugaauacauuuaccaacaugggcgcucagcucauccggcagauggaaggggagggcguccugagcaaagccgaucuggaaaacccgcaccucccugagaagaaaaucacccaguggcuggaaacaaagggaguggagcgccuuaagagaauggcgauuuccggcgacgauugcgugguuaaacccaucgacgaucgguucgccaaugcucugcucgcccugaacgacauggggaaggugcgcaaagauauuccccaauggcagccuagcaagggauggcaugacuggcagcaggucccguuuuguucucaccauuuccacgagcuuaucaugaaagauggcagaaagcuggugguucccugccggccucaagacgaacucauugggcgcgcuagaaucucccagggagccggcuggagccugaaggagaccgcuugucuggggaaagccuaugcgcagauguggucucucauguacuuccaccggcgcgaccugagacuugccuccaaugcuauuugcagcgccgugcccguccauugggugccuacaucucggacgaccugguccauccacgcccaucaccaauggaugacaaccgaagauaugcugacagucuggaaccgcguguggaucgaggacaaucccuggauggaagauaagaccccuguuacgaccugggagaacgugcccuaccucggcaaaagagaggaccagugguguggaagccugauuggccuuacaucccgggcuaccugggcccagaauaucccgacagcgauucagcaagucagaagccugaucgggaacgaagaguuucucgauuauaugccuucuaugaagcgcuuccggaaagaagaggagagcgaaggagcuauuugguga

SEQ ID NO: 20581 - RNA, 9873 nt, Artificial Sequence
  derived and/or modified CDS sequence (opt5) from DENV-3__JF920404__SS-prME
accagccugugccucaugaugauccugcccgcggcucuugccuuccaccugacaucccgggacggcgagccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacgccuuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugucuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucggacucaaggauacacugaaaagacgcucuuggccccuuaaugagggcgucauggcuguggggcugguuagcauucuggcguccucucuccugagaaacgacgugccuauggccggaccccuugucgcuggcgggcugcucaucgccuguuaugugauuaccggaaccagcgccgaucugacaguugaaaaggcugccgacaucaccugggaggaaggcgcggagcagacaggcgugucccacaaccucaugauuacggucgacgaugacgggaccaugcggaucaaagaugacgaaacagagaauauccugaccgugcuucugaagacagcucugcucauugucagcggaaucuuuccguacucuauuccugccacccugcuuguguggcauacguggcagaaacagacccaacgcuccggcguucugugggaugugcccagcccucccgagacacagaaggccgaacucgaggaaggggucuacagaaucaaacagcagggaauuuucggcaagacccaaguggggguuggagugcagaaggagggcgucuuucacacaauguggcacgugacccggggcgcugugcugacauauaacgggaaacgccucgagccgaauugggccucuguuaagaaagaccugaucuccuacggaggcggguggagacuuagcgcgcaguggcaaaagggagaagagguccaggugauugcuguggaaccuggcaaaaaccccaagaauuuccagacgaugccugggaccuuccagacaaccaccggagagaucggcgccaucgcccuggauuuuaagcccggcacaucugggucccccauuaucaaccgggaaggaaaagucgugggccuguaugggaauggaguugugacgaagaacggcggguacgucagcggcauugcucaaaccaaugccgagccugacggaccgacacccgagcucgaagaggaaauguucaaaaagcgcaaccugaccaucauggaucuucauccuggcuccgggaaaacaagaaaguaucugcccgcuauugugcgggaggccaucaagcgcagacuccggacccugauccucgcgccuacgagaguuguggccgcugaaauggaggaggcccugaaaggacuucccauucgcuaccagacaaccgcuaccaagagcgaacacacaggccgggagaucgucgaccugaugugccaugccaccuuuacaaugagacugcucucuccugugcgcguuccgaauuauaaccugauuaucauggaugaagcccacuucaccgaccccgcuagcauugcggcccggggguacaucuccacgagagugggaaugggcgaggcugccgccaucuuuaugacagcuaccccucccgggacagccgaugcguucccucagucuaaugcucccauucaggacgaagaacgcgacaucccggagcggagcuggaacuccggcaaugaauggauuaccgauuuugccggaaaaacggucugguucgugccuucuaucaaggccggcaacgacauugcuaacugucuucgcaaaaaugggaagaaggugauccaacugagcagaaaaaccuuugauacagaguaccagaagaccaaacucaacgacugggauuucgucguuacaaccgacauuuccgaaaugggagccaauuuuaaggcggaucgggugaucgaccccagacggugccugaaacccgugauccugacagauggcccugagcgcgucauucucgccgggcccaugccugugaccgcugccucugcugcccagagacggggacgcguuggcagaaacccgcagaaggagaaugaccaauauaucuucacggggcagccccuuaacaaugaugaagaccaugcucacuggacagaggccaagaugcugcuggacaacauuaauaccccugaaggcaucauucccgcccucuucgagccugaacgggagaaaagcgccgcuaucgauggagaguacagacugaagggcgaaucccgcaaaaccuuuguggagcuuaugcggagaggggaccugcccgucuggcucgcccacaagguggcuagcgaaggaaucaaauauacagaucgcaaguggugcuucgacggccagcggaacaaucagauucuggaggaaaacauggauguugagaucuggaccaaagagggggaaaagaagaaacugagaccgcgcuggcucgacgcccggacauacucugauccucuugcccugaaggaguuuaaagaguucgcugcgggaagaaaguccauugcccuggaccucgugacggagaucggccgcguccccagccaucuggcucacagaacccggaaugcccuugauaaccuggugaugcuccauacaucugaacacggcgggcgcgccuauagacacgcugucgaggagcugccugaaaccauggagacacugcuccuucugggacugaugauucuccugaccggcggggccaugcuuuuucugaucuccggaaaaggcaucgggaagacgagcauuggacucaucugugugauugcguccucuggcaugcuguggauggccgaaaucccccugcaauggauugcuagcgccaucguucucgaguucuuuaugauggugcuucugauuccugagcccgaaaagcagcggaccccgcaggacaaucaacuggcuuacguggucaucggcauccucacacuggccgcgauuaucgccgcuaacgagauggggcuucuggaaaccacaaaacgcgaucucggaauguccaaggagccuggcguugugagccccaccucuuaucuggacguggaucugcaucccgccuccgcuuggacgcucuacgccgucgcuacaaccgugauuacaccuaugcuuagacacaccaucgaaaauagcaccgccaacguuucucuggcggccauugcuaaccaggccgugguccugauggggcucgacaaaggauggccgaucagcaagauggaccugggcgugccccuucuggcucucgggugcuacucccaggucaauccucugacacugacggccgccgugcuccuucugaucacccauuaugcgauuaucggacccggccugcaggcuaaagccacacgggaggcucaaaagagaaccgccgccggcauuaugaagaacccuacaguugaugggaucaugaccauugaccucgaucccgugaucuacgacucuaaauucgagaagcagcugggacaggucaugcuucuggugcucugugcuguucagcugcugcucaugcgcacgagcugggcccuuugcgaagcgcugacacuggccaccggcccuaucaccacacucugggagggguccccgggaaaauuuuggaauaccacaauugcugugucuauggccaacaucuuccggggcagcuaucuggcuggggccggacuugcguuuuccauuaugaaaagcgucggcacgggcaaaagagggaccggaucucaaggcgaaacacugggggagaaguggaagaaaaagcucaaucagcugucccgcaaagauuucgaccuguacaagaaaagcggaaucaccgaaguggaucggacagaggccaaggagggccucaaaagaggggaaauuacccaccaugcugugucccggggaucugccaaacuucagugguuuguugagcgcaacauggucauccccgaaggcagagugauugaccugggcugugggcggggaggcuggagcuauuacugcgcugggcugaagaaagugacggagguccgcggauauaccaagggcgggccuggacacgaggaacccguuccuauguccacauacggcuggaauaucgugaaacucaugucuggcaaggauguguucuaccugcccccggagaaaugugacacccuucugugcgauaucggggaaagcuccccuagccccacagucgaggaaucuagaaccauucgggugcucaagaugguugagcccuggcugaagaacaaucaguucuguaucaaagugcugaacccuuauaugcccacagucauugagcaccucgaacgccuucaaagaaagcauggaggcaugcuggugcggaauccucugucccgcaacagcacccacgagauguacuggaucucuaaugggacgggaaacauuguugccuccgugaauauggucagcagacuccugcuuaaccgguuuacaaugacccauagacgcccgaccaucgaaaaagacguggaucugggcgcugggacacggcacgugaacgccgagcccgaaacgccuaauauggacgucaucggagagagaauuaagcgcaucaaagaggaacacaacucuaccuggcauuaugacgaugagaaucccuacaagacaugggcguaucacggcagcuacgaaguuaaggccaccggcuccgcuucuagcaugauuaacgggguggugaaacuccugacaaagccuugggacgucgugcccaugguuacccagauggccaugacagauaccacgccguucggacagcaacggguguuuaaagagaaggucgacaccagaacaccucgcuccaugcccggcacccggagagugauggggaucacagcugaauggcuguggcgcacccucggacggaauaaaaagccuagacugugcacgcgcgaggaguucacaaagaaaguucggaccaacgccgccaugggcgcgguguuuacagaagagaaucagugggauagcgcuaaggccgccgucgaagacgaggauuucuggaaacuuguggacagagaacgcgagcugcauaagcucgggaaauguggcuccugcguuuauaacaugaugggaaagagagagaaaaagcugggcgaauuugggaaggcuaaaggaucucgggccauuugguacauguggcuuggcgcucgcuaccuggaguucgaagcccucggguuucugaaugaggaucacugguucagcagagagaacuccuauucuggaguggaaggcgaggggcugcauaagcucggcuacauccugcgggacaucagcaaaauucccggaggcgcgauguaugccgaugacaccgcugggugggacacgagaaucaccgaagaugaccuucacaaugaggaaaagauuacacagcagauggauccugagcaccggcaacuggccaacgcuaucuuuaaacucaccuaccagaauaaggucgugaagguccagcgccccacaccgaccggaacagugauggacauuaucuccagaaaagaucagcggggcucugggcaaguuggaaccuauggccugaacacguucacaaauauggaggcccagcuuauccgccagauggaaggggagggcgugcugagcaaggcggaccucgaaaacccucaucugcccgagaaaaagauuacccaguggcuggaaaccaaaggagucgagagacucaagcggauggccaucuccggcgaugacugcguggugaagcccauugaugaccgcuuugcuaacgcccugcuugcucugaaugauauggggaaaguuagaaaggacaucccucaauggcagccgagcaaaggauggcacgauuggcaacaggugcccuucuguucucaucacuuccacgagcucauuaugaaggacggccggaaacuggucgugccuugccgcccccaagacgaacuuaucgggagagcccggauuucccagggagcuggcuggagccugaaggagacagccugucucgggaaggcguacgcccagauguggucucugauguauuuucaucgcagagaucugcggcucgcuuccaacgccaucugcagcgccguuccugugcacuggguccccaccucucgcacaacgugguccauccaugcucaccaucaauggaugaccacagaagacaugcugaccguguggaauagagucuggauugaggauaacccuuggauggaagacaaaacacccgugaccacgugggagaauguuccguaccuuggcaagcgggaggaucagugguguggaagccugaucggccucaccuccagagccacaugggcgcagaacauuccuaccgcuauccagcaagugcgcagccugauugggaaugaagaguuccuugacuacaugcccucuaugaaacgguuuagaaaggaagaggagagcgaaggagccaucugguga

SEQ ID NO: 20582 - RNA, 9873 nt, Artificial Sequence
  derived and/or modified CDS sequence (opt5) from DENV-3__JF937641__SS-prME
accagccugugccucaugaugauccugcccgcggcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacgccuuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugucuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucggacucaaggauacacugaaaagacgcucuuggccccuuaaugagggcgucauggcuguggggcugguuagcauucuggcguccucucuccugagaaacgacgugccuauggccggaccccuugucgcuggcgggcugcucaucgccuguuaugugauuaccggaaccagcgccgaucugacaguugaaaaggcugccgacaucaccugggaggaagaggcggaacagacaggcgugucccacaaccucaugauuacggucgacgaugacggcaccaugcggaucaaagaugacgagacagagaauauccugaccgugcuucugaagacagcucugcucauugucagcgggaucuuuccguacucuauuccugccacccugcuuguguggcauacguggcagaaacagacccaacgcuccggaguucugugggaugugcccagcccucccgaaacacagaaggccgagcucgaagagggcgucuacagaaucaaacagcaggggauuuucggaaagacccaagugggcguuggggugcagaaggagggagucuuucacacaauguggcacgugacccggggcgcugugcugacauauaacggcaaacgccucgaaccgaauugggccucuguuaagaaagaccugaucuccuacgggggaggcuggagacuuagcgcgcaguggcaaaagggggaggaaguccaggugauugcuguggagccuggcaagaaccccaagaauuuccagacgaugccuggcaccuuccagacaaccaccggggaaaucggagccaucgcccuggauuuuaagcccggcacaucuggcucccccauuaucaaccgggaggggaaagucgugggacuguauggcaaugggguugugacgaagaacggaggcuacgucagcgggauugcucaaaccaaugccgagccugacggcccgacacccgaacucgaggaagagauguucaaaaagcgcaaccugaccaucauggaucuucauccuggauccggcaaaacaagaaaguaucugcccgcuauugugcgggaagccaucaagcgcagacuccggacccugauccucgcgccuacgagaguuguggccgcugagauggaggaagcccugaaagggcuucccauucgcuaccagacaaccgcuaccaagagcgagcacacaggacgggaaaucgucgaccugaugugccaugccaccuuuacaaugagacugcucucuccugugcgcguuccgaauuauaaccugauuaucauggaugaggcccacuucaccgaccccgcuagcauugcggcccggggcuacaucuccacgagaguggggaugggagaagcugccgccaucuuuaugacagcuaccccucccggcacagccgaugcguucccucagucuaaugcucccauucaggacgaggagcgcgacaucccggaacggagcuggaacuccgggaaugaguggauuaccgauuuugccggcaaaacggucugguucgugccuucuaucaaggccggaaacgacauugcuaacugucuucgcaaaaauggcaagaaggugauccaacugagcagaaaaaccuuugauacagaauaccagaagaccaaacucaacgacugggauuucgucguuacaaccgacauuuccgagaugggggccaauuuuaaggcggaucgggugaucgaccccagacggugccugaaacccgugauccugacagauggaccugagcgcgucauucucgccggccccaugccugugaccgcugccucugcugcccagagacgggggcgcguuggaagaaacccgcagaaggaaaaugaccaauauaucuucacgggccagccccuuaacaaugaugaggaccaugcucacuggacagaagccaagaugcugcuggacaacauuaauaccccugaggggaucauucccgcccucuucgaaccugagcgggagaaaagcgccgcuaucgauggcgaauacagacugaagggagagucccgcaaaaccuuuguggaacuuaugcggagaggcgaccugcccgucuggcucgcccacaagguggcuagcgaggggaucaaauauacagaucgcaaguggugcuucgacggacagcggaacaaucagauucuggaagagaacauggauguugagaucuggaccaaagaaggcgagaagaagaaacugagaccgcgcuggcucgacgcccggacauacucugauccucuugcccugaaggaauuuaaagaguucgcugcggggagaaaguccauugcccuggaccucgugacggaaaucggacgcguccccagccaucuggcucacagaacccggaaugcccuugauaaccuggugaugcuccauacaucugagcacggcggccgcgccuauagacacgcugucgaggaacugccugagaccauggaaacacugcuccuucuggggcugaugauucuccugaccggaggcgccaugcuuuuucugaucuccgggaaaggaaucggcaagacgagcauugggcucaucugugugauugcguccucuggaaugcuguggauggccgagaucccccugcaauggauugcuagcgccaucguucucgaguucuuuaugauggugcuucugauuccugaacccgagaagcagcggaccccgcaggacaaucaacuggcuuacguggucaucggcauccucacacuggccgcgauuaucgccgcuaacgaaaugggccuucuggagaccacaaaacgcgaucucgggauguccaaggaaccuggaguugugagccccaccucuuaucuggacguggaucugcaucccgccuccgcuuggacgcucuacgccgucgcuacaaccgugauuacaccuaugcuuagacacaccaucgagaauagcaccgccaacguuucucuggcggccauugcuaaccaggccgugguccugaugggccucgacaaaggguggccgaucagcaagauggaccugggagugccccuucuggcucucggcugcuacucccaggucaauccucugacacugacggccgccgugcuccuucugaucacccauuaugcgauuaucgggcccggacugcaggcuaaagccacacgggaggcucaaaagagaaccgccgccggcauuaugaagaacccuacaguugauggcaucaugaccauugaccucgaucccgugaucuacgacucuaaauucgaaaagcagcuggggcaggucaugcuucuggugcucugugcuguucagcugcugcucaugcgcacgagcugggcccuuugcgaggcgcugacacuggccaccggaccuaucaccacacucugggaaggcuccccggggaaauuuuggaauaccacaauugcugugucuauggccaacaucuuccggggaagcuaucuggcuggcgccgggcuugcguuuuccauuaugaaaagcgucggaacgggcaaaagaggcaccgggucucaaggagagacacugggcgaaaaguggaagaaaaagcucaaucagcugucccgcaaagauuucgaccuguacaagaaaagcgggaucaccgagguggaucggacagaggccaaggaaggacucaaaagaggcgagauuacccaccaugcugugucccgggggucugccaaacuucagugguuuguugaacgcaacauggucauccccgagggaagagugauugaccugggcuguggcagagggggauggagcuauuacugcgcuggccugaagaaagugacggaaguccgcggguauaccaagggaggcccugggcacgaggagcccguuccuauguccacauacggauggaauaucgugaaacucaugucuggcaaggauguguucuaccugcccccggaaaaaugugacacccuucugugcgauaucggcgagagcuccccuagccccacagucgaagagucuagaaccauucgggugcucaagaugguugagcccuggcugaagaacaaucaguucuguaucaaagugcugaacccuuauaugcccacagucauugaacaccucgagcgccuucaaagaaagcaugggggaaugcuggugcggaauccucugucccgcaacagcacccacgaaauguacuggaucucuaauggcacggggaacauuguugccuccgugaauauggucagcagacuccugcuuaaccgguuuacaaugacccauagacgcccgaccaucgagaaagacguggaucugggagcuggcacacggcacgugaacgccgaacccgagacgccuaauauggacgucaucggggagagaauuaagcgcaucaaagaagaacacaacucuaccuggcauuaugacgaugaaaaucccuacaagacaugggcguaucacggaagcuacgagguuaaggccaccggcuccgcuucuagcaugauuaacggcguggugaaacuccugacaaagccuugggacgucgugcccaugguuacccagauggccaugacagauaccacgccguucgggcagcaacggguguuuaaagaaaaggucgacaccagaacaccucgcuccaugcccggaacccggagagugaugggcaucacagcugaguggcuguggcgcacccucgggcggaauaaaaagccuagacugugcacgcgcgaggaguucacaaagaaaguucggaccaacgccgccaugggagcgguguuuacagaggaaaaucagugggauagcgcuaaggccgccgucgaggacgaagauuucuggaaacuuguggacagagagcgcgagcugcauaagcucggcaaauguggguccugcguuuauaacaugaugggcaagagagagaagaagcugggagaguuuggcaaggcuaaagggucucgggccauuugguacauguggcuuggagcucgcuaccuggaguucgaggcccucggcuuucugaaugaggaucacugguucagcagagaaaacuccuauucugggguggagggagaaggccugcauaagcucggguacauccugcgggacaucagcaaaauucccggcggagcgauguaugccgaugacaccgcuggcugggacacgagaaucaccgaggaugaccuucacaaugaagagaagauuacacagcagauggauccugagcaccggcaacuggccaacgcuaucuuuaaacucaccuaccagaauaaggucgugaagguccagcgccccacaccgaccgggacagugauggacauuaucuccagaaaagaucagcggggaucuggccaaguugggaccuauggacugaacacguucacaaauauggaagcccagcuuauccgccagauggagggcgaaggggugcugagcaaggcggaccucgagaacccucaucugcccgagaaaaagauuacccaguggcuggagaccaaaggcgucgagagacucaagcggauggccaucuccggagaugacugcguggugaagcccauugaugaccgcuuugcuaacgcccugcuugcucugaaugauaugggcaaaguuagaaaggacaucccucaauggcagccgagcaaaggguggcacgauuggcaacaggugcccuucuguucucaucacuuccacgaacucauuaugaaggacggacggaaacuggucgugccuugccgcccccaagacgagcuuaucggcagagcccggauuucccagggggcuggauggagccugaaggaaacagccugucucggcaaggcguacgcccagauguggucucugauguauuuucaucgcagagaucugcggcucgcuuccaacgccaucugcagcgccguuccugugcacuggguccccaccucucgcacaacgugguccauccaugcucaccaucaauggaugaccacagaggacaugcugaccguguggaauagagucuggauugaagauaacccuuggauggaggacaaaacacccgugaccacgugggagaauguuccguaccuugggaagcgggaagaucagugguguggcagccugaucggacucaccuccagagccacaugggcgcagaacauuccuaccgcuauccagcaagugcgcagccugauuggcaaugaggaguuccuugacuacaugcccucuaugaaacgguuuagaaaggaggaggaaagcgagggggccaucugguga

SEQ ID NO: 20583 - RNA, 9873 nt, Artificial Sequence
  derived and/or modified CDS sequence (opt5) from DENV-3__JF920396__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggcgagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcgcucuccugacauggaucgggcuuaauucuaagaacaccagcauguccuuuucuugcauugccaucggaaucauuacacuguaucucggcgcugucgugcaggccgacaugggguguguugugaauuggaaaggaaaggagcugaagugcggcagcgggaucuucgucacgaacgaggugcauaccuggacagaacaguacaaauuucaagcggauucccccaagcggcuggccaccgcuauugccggcgcuugggagaauggaguuuguggcaucagaagcacaacccgcauggaaaaccuucucuggaaacagauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccaaaacuccagcuucaucauugauggaccuaauacacccgagugcccgucugucuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaaccaucgccccggauaucacacccaaacggcgggcccuuggcaccuugggaagcuggagcucgacuuuaauuacugcgagggaacaaccguugugauuacagaaaacuguggcacccggggccccucucugagaacaaccacggucuccgggaaacugauccaugaguggugcugucgcagcugcacccuuccgccucuccgguauaugggagaagauggcuguugguacgggauggagaucagacccauuucugaaaaggaggagaauauggugaaaucccugguuagcgcuggaucuggcaagguggacaacuucacaauggggguccugugccucgccauccuguuugaagaggugaugcggggaaaguucggcaaaaagcacaugauugccggcguuuucuuuaccuucgugcuucugcucagcgggcagaucacauggcgcgauauggcucauacccugauuaugaucggauccaaugccagcgacagaaugggcaugggggucacguaucuggcgcuuauugcuacauuuaaaauccagcccuuccuggcccucggauuuuuccugcggaagcucaccucuagagaaaaccugcuucugggcguggggcucgccauggcuacaacccugcaacugccugaggauaucgaacagauggccaauggaauugcucuuggccugauggcccucaaacugaucacccaguuugagacauaccagcucuggacggcgcugauuucccuuaccuguagcaacacaaucuucacccugacaguggccuggcgcaccgcuacgcucauucuggccggcgucucccugcuuccgguuugccaaucuagcuccaugcggaagacagacuggcugcccauggcuguggccgccaugggggugccuccccucccucuguuuaucuucucucucaaggauacccugaaaagacgcagcuggccccuuaaugagggagucauggcugugggccugguuuccauccuggcgucuagccuccugagaaacgacgugccuauggccgggccccuugucgcuggaggccugcucauugccuguuaugugaucaccgggacauccgccgaucugaccguugaaaaggcugccgacauuacaugggaggaagaggcggaacagacgggagugagccacaaccucaugaucaccgucgacgaugacggcacaaugcggauuaaagaugacgagaccgagaauauccugacagugcuucugaagaccgcucugcucaucgucucuggcauuuuuccguacuccaucccugccacgcugcuuguguggcauaccuggcagaaacagacacaacgcagcgggguucugugggaugugcccucuccucccgaaacccagaaggccgagcucgaagagggagucuacagaauuaaacagcagggcaucuucgggaagacacaagugggaguuggcgugcagaaggagggggucuuucacaccauguggcacgugacacggggagcugugcugacguauaacggcaaacgccucgaaccgaauugggccuccguuaagaaagaccugauuagcuacggcgggggauggagacuuucugcgcaguggcaaaagggcgaggaaguccaggugaucgcuguggagccugggaaaaaccccaagaauuuccagaccaugccuggaacauuccagaccaccacaggcgaaauuggggccaucgcccuggauuuuaagcccggaacguccggcagccccaucauuaaccgggagggcaaagucguggggcuguauggaaauggcguugugaccaagaacgggggauacgucuccggcaucgcucaaacaaaugccgagccugacgggccgacccccgaacucgaggaagagauguucaaaaagcgcaaccugacaauuauggaucuucauccuggcagcggaaaaaccagaaaguaucugcccgcuaucgugcgggaagccauuaagcgcagacuccggacgcugauccucgcgccuacaagaguuguggccgcugagauggaggaagcccugaaaggccuucccauccgcuaccagaccaccgcuacaaagucugagcacaccgggcgggaaauugucgaccugaugugccaugccacauuuaccaugagacugcucagcccugugcgcguuccgaauuauaaccugaucauuauggaugaggcccacuucacggaccccgcuuccaucgcggcccggggauacauuucuacaagagugggcaugggggaagcugccgccaucuuuaugaccgcuacaccucccggaaccgccgaugcguucccucagagcaaugcucccauccaggacgaggagcgcgacauuccggaacgguccuggaacucuggcaaugaguggaucacggauuuugccgggaaaaccgucugguucgugccuagcauuaaggccggcaacgacaucgcuaacugucuucgcaaaaauggaaagaaggugauucaacuguccagaaaaacauuugauaccgaauaccagaagacaaaacucaacgacugggauuucgucguuaccacagacaucucugagaugggcgccaauuuuaaggcggaucgggugauugaccccagacggugccugaaacccgugauccugaccgaugggccugagcgcgucauccucgccggacccaugccugugacggcugccagcgcugcccagagacggggccgcguugggagaaacccgcagaaggaaaaugaccaauauauuuucacaggacagccccuuaacaaugaugaggaccaugcucacuggaccgaagccaagaugcugcuggacaacaucaauaccccugagggcauuauccccgcccucuucgaaccugagcgggagaaauccgccgcuauugauggggaauacagacugaagggcgagagccgcaaaacauuuguggaacuuaugcggagaggagaccugcccgucuggcucgcccacaagguggcuucugagggcaucaaauauaccgaucgcaaguggugcuucgacgggcagcggaacaaucagauccuggaagagaacauggauguugagauuuggacaaaagaaggagagaagaagaaacugagaccgcgcuggcucgacgcccggacguacuccgauccucuugcccugaaggaauuuaaagaguucgcugcgggcagaaagagcaucgcccuggaccucgugaccgaaauugggcgcguccccucucaucuggcucacagaacacggaaugcccuugauaaccuggugaugcuccauaccuccgagcacggaggccgcgccuauagacacgcugucgaggaacugccugagacaauggaaacccugcuccuucugggccugaugauccuccugacagggggagccaugcuuuuucugauuagcggcaaagggaucggaaagaccuccaucggccucauuugugugaucgcgucuagcgggaugcuguggauggccgagauuccccugcaauggaucgcuuccgccauuguucucgaguucuuuaugauggugcuucugaucccugaacccgagaagcagcggacaccgcaggacaaucaacuggcuuacguggucauuggaauccucacccuggccgcgaucauugccgcuaacgaaaugggccuucuggagacaaccaaacgcgaucucggcaugagcaaggaaccugggguugugucucccacguccuaucuggacguggaucugcaucccgccagcgcuuggacacucuacgccgucgcuaccacagugaucaccccuaugcuuagacacaccauugaaaauucuacagccaacguuagccuggcggccaucgcuaaccaggccgugguccugaugggacucgacaaaggcuggccgauuuccaagauggaccugggggugccccuucuggcucucggaugcuacucucaggucaauccucugacgcugaccgccgccgugcuccuucugaucacacauuaugcgaucauuggccccgggcugcaggcuaaagccacccgggaggcucaaaagagaacagccgccggaaucaugaagaacccuaccguugauggcauuaugacgaucgaccucgaucccgugauuuacgacagcaaauucgaaaagcagcugggccaggucaugcuucuggugcucugugcuguucagcugcugcucaugcgcacauccugggcccuuugcgaggcgcugacccuggccaccgggccuaucacaacccucugggaaggaucuccgggcaaauuuuggaauacaacgaucgcugugagcauggccaacauuuuccggggguccuaucuggcuggagccggccuugcguuuagcaucaugaagucugucgggaccggaaaaagaggcacaggcucccaaggggagacccugggagaaaaguggaagaaaaagcucaaucagcugagccgcaaagauuucgaccuguacaagaaauccggcauuacagagguggaucggaccgaggccaaggaagggcucaaaagaggagagaucacgcaccaugcugugucucggggcagcgccaaacuucagugguuuguugaacgcaacauggucauucccgaggggagagugaucgaccugggauguggccggggcgggugguccuauuacugcgcuggacugaagaaagugaccgaaguccgcggcuauacaaaagggggaccuggccacgaggagcccguuccuaugucuaccuacggguggaauauugugaaacucaugagcggaaaggauguguucuaccugcccccggaaaaaugugacacacuucugugcgauaucggcgaguccagcccuucucccaccgucgaagaguccagaacaauccgggugcucaagaugguugagcccuggcugaagaacaaucaguucuguauuaaagugcugaacccuuauaugcccaccgucaucgaacaccucgagcgccuucaaagaaagcauggcgggaugcuggugcggaauccucugagccgcaacucuacgcacgaaauguacuggauuuccaauggaacaggcaacaucguugccagcgugaauauggucucuagacuccugcuuaaccgguuuaccaugacccauagacgcccgacaauugagaaagacguggaucugggggcuggaacgcggcacgugaacgccgaacccgagaccccuaauauggacgucaucggcgagagaaucaagcgcauuaaagaagaacacaacagcacauggcauuaugacgaugaaaaucccuacaagaccugggcguaucacggguccuacgagguuaaggccacaggaucugcuagcuccaugaucaacggcguggugaaacuccugaccaagccuugggacgucgugcccaugguuacacagauggccaugaccgauacgaccccguucggccagcaacggguguuuaaagaaaaggucgacacaagaaccccucgcagcaugcccgggacacggagagugaugggaauuaccgcugaguggcuguggcgcacgcucggccggaauaaaaagccuagacugugcacacgcgaggaguucaccaagaaaguucggacaaacgccgccaugggggcgguguuuaccgaggaaaaucagugggauuccgcuaaggccgccgucgaggacgaagauuucuggaaacuuguggacagagagcgcgagcugcauaagcucggaaaauguggcucuugcguuuauaacaugauggggaagagagagaagaagcugggcgaguuuggaaaggcuaaaggcagccgggccaucugguacauguggcuuggggcucgcuaccuggaguucgaggcccucggauuucugaaugaggaucacugguucuccagagaaaacucuuauagcggcguggagggggaaggacugcauaagcucggcuacauucugcgggacaucuccaaaauccccgggggcgcgauguaugccgaugacacggcuggaugggacaccagaauuacagaggaugaccuucacaaugaagagaagaucacccagcagauggauccugagcaccggcaacuggccaacgcuauuuuuaaacucacauaccagaauaaggucgugaagguccagcgccccaccccgacaggcaccgugauggacaucauuucuagaaaagaucagcgggggagcggacaaguuggcacguaugggcugaacacauucaccaauauggaagcccagcuuauccgccagauggagggagaaggcgugcuguccaaggcggaccucgagaacccucaucugcccgagaagaagaucacccaguggcuggagacaaaaggggucgagagacucaagcggauggccauuagcggcgaugacugcguggugaagcccaucgaugaccgcuuugcuaacgcccugcuugcucugaaugauaugggaaaaguuagaaaggacauuccucaauggcagccgucuaaaggcuggcacgauuggcaacaggugcccuucuguucccaucacuuccacgaacucaucaugaaggacgggcggaaacuggucgugccuugccgcccccaagacgagcuuauuggacgggcccggaucagccagggcgcuggguggucucugaaggaaaccgccugucucggaaaggcguacgcccagauguggucccugauguauuuucaucgcagagaucugcggcucgcuagcaacgccauuugcucugccguuccugugcacuggguccccacaucccgcacgaccuggagcauccaugcucaccaucaauggaugacaaccgaggacaugcugacaguguggaauagagucuggaucgaagauaacccuuggauggaggacaaaacccccgugacgaccugggagaauguuccguaccuuggcaagcgggaagaucaguggugugggucccugauuggccucacaagcagagccaccugggcgcagaacaucccuacagcuauucagcaagugcgcucucugaucggaaaugaggaguuccuugacuacaugcccagcaugaaacgguuuagaaaggaggaggaauccgagggcgccauuugguga

SEQ ID NO: 20584 - RNA, 9873 nt, Artificial Sequence
  derived and/or modified CDS sequence (opt5) from DENV-3__JF920406__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacgccuuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggcccggggggcuagacgcauggccauccuuggagacacagcgugggauuucggcuccguggggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugucuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuugaaauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccauggcuguggccgccaugggggugccuccccucccucuguuuaucuucggacucaaggauacacugaagagacgcucuuggccccuuaaugaaggcgucauggcuguggggcugguuagcauucuggcguccucucuccugagaaacgacgugccuauggccggaccccuugucgcuggcgggcugcucaucgccuguuaugugauuaccggaaccagcgccgaucugacaguugagaaagcugccgacaucaccugggaagaggaagcggagcagacaggcgugucccacaaccucaugauuacggucgacgaugacggcaccaugcggaucaaggaugacgagacagaaaauauccugaccgugcuucugaaaacagcucugcucauugucagcgggaucuuuccguacucuauuccugccacccugcuuguguggcauacguggcagaagcagacccaacgcuccggaguucugugggaugugcccagcccucccgagacacagaaagccgaacucgaggagggcgucuacagaaucaagcagcaggggauuuucggaaaaacccaagugggcguuggggugcagaaggaaggagucuuucacacaauguggcacgugacccggggcgcugugcugacauauaacggcaagcgccucgagccgaauugggccucuguuaaaaaggaccugaucuccuacgggggaggcuggagacuuagcgcgcaguggcaaaaaggggaagagguccaggugauugcuguggaaccuggaaagaaccccaaaaauuuccagacgaugccuggcaccuuccagacaaccaccggggagaucggagccaucgcccuggauuuuaagcccggcacaucuggcucccccauuaucaaccgggaggggaaggucgugggacuguauggcaaugggguugugacgaaaaacggaggcuacgucagcgggauugcucaaaccaaugccgaaccugacggcccgacacccgagcucgaagaggaaauguucaagaaacgcaaccugaccaucauggaucuucauccuggauccggcaagacaagaaaauaucugcccgcuauugugcgggaggccaucaagcgcagacuccggacccugauccucgcgccuacgagaguuguggccgcugagauggaagaggcccugaaggggcuucccauucgcuaccagacaaccgcuaccaaaagcgaacacacaggacgggagaucgucgaccugaugugccaugccaccuuuacaaugagacugcucucuccugugcgcguuccgaauuauaaccugauuaucauggaugaagcccacuucaccgaccccgcuagcauugcggcccggggcuacaucuccacgagaguggggaugggagaggcugccgccaucuuuaugacagcuaccccucccggcacagccgaugcguucccucagucuaaugcucccauucaggacgaggaacgcgacaucccggagcggagcuggaacuccgggaaugaauggauuaccgauuuugccggcaagacggucugguucgugccuucuaucaaagccggaaacgacauugcuaacugucuuagaaagaauggcaaaaaggugauccaacugagccgcaagaccuuugauacagaguaccagaaaaccaagcucaacgacugggauuucgucguuacaaccgacauuuccgagaugggggccaauuuuaaagcggaucgggugaucgaccccagacggugccugaagcccgugauccugacagauggaccugaacgcgucauucucgccggccccaugccugugaccgcugccucugcugcccagagacgggggcgcguuggaagaaacccgcagaaagagaaugaccaauauaucuucacgggccagccccuuaacaaugaugaagaccaugcucacuggacagaggccaagaugcugcuggacaacauuaauaccccugaagggaucauucccgcgcucuucgagccugagcgggaaaagagcgccgcuaucgauggcgaguacagacugaaaggagaaucccgcaagaccuuuguggagcuuaugcggagaggcgaccugcccgucuggcucgcccacaaaguggcuagcgaagggaucaaguauacagaucgcaaauggugcuucgacggacagcggaacaaucagauucuggaggagaacauggauguugaaaucuggaccaaggagggcgaaaaaaagaagcugagaccgcgcuggcucgacgcccggacauacucugauccucuugcccugaaagaguuuaaggaauucgcugcggggagaaaauccauugcccuggaccucgugacggagaucggacgcguccccagccaucuggcucacagaacccggaaugcccuugauaaccuggugaugcuccauacaucugagcacggcggccgcgccuauagacacgcugucgaagagcugccugaaaccauggagacacugcuccuucuggggcugaugauucuccugaccggaggcgccaugcuuuuucugaucuccgggaagggaaucggcaaaacgagcauugggcucaucugugugauugcguccucuggaaugcuguggauggccgagaucccccugcaauggauugcuagcgccaucguucucgaauucuuuaugauggugcuucugauuccugagcccgaaaagcagcggaccccgcaggacaaucaacuggcuuacguggucaucggcauccucacacuggccgcgauuaucgccgcuaacgagaugggccuucuggaaaccacaaagcgcgaucucgggauguccaaagagccuggaguugugagccccaccucuuaucuggacguggaucugcaucccgccuccgcuuggacgcucuacgccgucgcuacaaccgugauuacaccuaugcuuagacacaccaucgagaauagcaccgccaacguuucucuggcggccauugcuaaccaggccgugguccugaugggccucgacaagggguggccgaucagcaaaauggaccugggagugccccuucuggcucucggcugcuacucccaggucaauccucugacacugacggccgccgugcuccuucugaucacccauuaugcgauuaucgggcccggacugcaggcuaaggccacacgggaagcucaaaaaagaaccgccgccggcauuaugaagaacccuacaguugauggcaucaugaccauugaccucgaucccgugaucuacgacucuaaguucgagaaacagcuggggcaggucaugcuucuggugcucugugcuguucagcugcugcucaugcgcacgagcugggcccuuugcgaagcgcugacacuggccaccggaccuaucaccacacucugggagggcuccccggggaaguuuuggaauaccacaauugcugugucuauggccaacaucuuccggggaagcuaucuggcuggcgccgggcuugcguuuuccauuaugaaaagcgucggaacgggcaagagaggcaccgggucucaaggagaaacacugggcgagaaauggaagaagaaacucaaucagcugucccgcaaggauuucgaccuguacaaaaagagcgggaucaccgagguggaucggacagaagccaaagagggacucaagagaggcgaaauuacccaccaugcugugucccgggggucugccaaacuucagugguuuguugagcgcaacauggucauccccgaaggaagagugauugaccugggcuguggccgggggggauggagcuauuacugcgcuggccugaagaaggugacggagguccgcggguauaccaaaggaggcccugggcacgaggaacccguuccuauguccacauacggauggaauaucgugaagcucaugucuggcaaagauguguucuaccugcccccggagaagugugacacccuucugugcgauaucggcgaaagcuccccuagccccacagucgaggagucuagaaccauucgggugcucaaaaugguugaacccuggcugaagaacaaucaguucuguaucaaggugcugaacccuuauaugcccacagucauugagcaccucgaacgccuucaaagaaaacaugggggaaugcuggugcggaauccucugucccgcaacagcacccacgagauguacuggaucucuaauggcacggggaacauuguugccuccgugaauauggucagcagacuccugcuuaaccgguuuacaaugacccauagacgcccgaccaucgaaaaggacguggaucugggagcuggcacacggcacgugaacgccgagcccgagacgccuaauauggacgucaucggggaaagaauuaaacgcaucaaggaggaacacaacucuaccuggcauuaugacgaugagaaucccuacaaaacaugggcguaucacggaagcuacgaaguuaaggccaccggcuccgcuucuagcaugauuaacggcguggugaagcuccugacaaaaccuugggacgucgugcccaugguuacccagauggccaugacagauaccacgccguucgggcagcaacggguguuuaaggagaaagucgacaccagaacaccucgcuccaugcccggaacccggagagugaugggcaucacagcugaguggcuguggcgcacccucgggcggaauaagaaaccuagacugugcacgcgcgaagaguucacaaagaagguucggaccaacgccgccaugggagcgguguuuacagaagagaaucagugggauagcgcuaaagccgccgucgaagacgaggauuucuggaagcuuguggacagagagcgcgaacugcauaaacucggcaaguguggguccugcguuuauaacaugaugggcaaaagagagaagaaacugggagaauuuggcaaggcuaaggggucucgggccauuugguacauguggcuuggagcucgcuaccuggaguucgaggcccucggcuuucugaaugaagaucacugguucagcagagagaacuccuauucugggguggaaggagagggccugcauaaacucggguacauccugcgggacaucagcaagauucccggcggagcgauguaugccgaugacaccgcuggcugggacacgagaaucaccgaagaugaccuucacaaugaggagaaaauuacacagcagauggauccugaacaccggcaacuggccaacgcuaucuuuaagcucaccuaccagaauaaagucgugaagguccagcgccccacaccgaccgggacagugauggacauuaucuccagaaaggaucagcggggaucuggccaaguugggaccuauggacugaacacguucacaaauauggaggcccagcuuauccgccagauggaaggcgagggggugcugagcaaagcggaccucgaaaacccucaucugcccgagaagaaaauuacccaguggcuggagaccaagggcgucgaaagacucaaacggauggccaucuccggagaugacugcguggugaagcccauugaugaccgcuuugcuaacgcccugcuugcucugaaugauaugggcaagguuagaaaagacaucccucaauggcagccgagcaagggguggcacgauuggcagcaggugcccuucuguucucaucacuuccacgagcucauuaugaaagacggacggaagcuggucgugccuugccgcccccaagacgaacuuaucggcagagcccggauuucccagggggcuggauggagccugaaagagacagccugucucggcaaggcguacgcccagauguggucucugauguauuuucaucgcagagaucugcggcucgcuuccaacgccaucugcagcgccguuccugugcacuggguccccaccucucgcacaacgugguccauccaugcucaccaucaauggaugaccacagaagacaugcugaccguguggaauagagucuggauugaggauaacccuuggauggaggacaagacacccgugaccacgugggaaaauguuccguaccuugggaaacgggaggaucagugguguggcagccugaucggacucaccuccagagccacaugggcgcagaacauuccuaccgcuauccagcaagugcgcagccugauuggcaaugaagaguuccuugacuacaugcccucuaugaagcgguuuagaaaagaggaagagagcgaaggggccaucugguga

SEQ ID NO: 20585 - RNA, 9873 nt, Artificial Sequence
  derived and/or modified CDS sequence (opt5) from DENV-3__JF920409__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucgcucagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccacacucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugucuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcgcuuucuuuauguucguucuucugcucagcgggcagauuacauggcgcgauauggcccauacccugaucaugauuggauccaaugcgagcgacagaaugggcaugggggugacauaucuggcucuuaucgccaccuuuaaaauccagcccuuccuggcccucggauuuuuccugcggaagcucacgucuagagaaaaccugcuucugggcgucgggcucgcuauggccacaacccugcaacugccugaggauauugaacagauggcuaauggaaucgcccuuggccugauggcgcucaaacugauuacacaguuugagaccuaccagcucuggaccgcccugaucucccuuacauguagcaacacgauuuucacccugacaguggcuuggcgcaccgccacacucauccuggcuggcgugucccugcuuccggucugccaaucuagcuccaugcggaagaccgacuggcugcccauggccguugccgcuaugggggugccuccccucccucuguuuaucuucucucucaaggauacgcugaaaagacgcagcuggccccuuaaugagggagugauggcggucggccugguguccauucuggccucuagccuccugagaaacgacguuccuauggcugggccccuuguggccggaggccugcucaucgccuguuaugucauuacagggaccuccgcugaucugaccguggaaaaggccgcggacaucacaugggaggaagaggcugaacagaccggaguuagccacaaccucaugauuacaguggacgaugacggcacgaugcggaucaaagaugacgagucugagaauauccugaccguccuucugaagacagcccugcucauuguguccggcaucuuuccguacagcauuccugccacccugcuugucuggcauacauggcagaaacagacccaacgcucuggggugcugugggauguucccuccccucccgaaacgcagaaggcugagcucgaagagggaguguacagaaucaaacagcagggcauuuucgggaagacccaagucggagugggcguucagaaggaggggguguuucacacaauguggcacgucacccggggagccgugcugacauauaacggcaaacgccucgaaccgaauugggcgagcgugaagaaagaccugaucucuuacggcgggggauggagacuuuccgcucaguggcaaaagggcgaggaaguucaggucauugccguggagccugggaaaaaccccaagaauuuccagaccaugccuggaacauuccagacgaccacaggcgaaaucggggccaucgcucuggauuuuaagcccggaaccagcggcucccccauuaucaaccgggagggcaaaguggucgggcuguauggaaauggcgugguuaccaagaacgggggauacgugagcggcauugcccaaacaaaugcugagccugacgggccgacgcccgaacucgaggaagagauguucaaaaagcgcaaccugaccaucauggaucuucauccuggcucuggaaaaacaagaaaguaucugcccgccauuguccgggaagcgaucaagcgcagacuccggacccugauccucgccccuacaagagugguugcugccgagauggaggaagcucugaaaggccuucccauucgcuaccagaccacggccacaaagagcgagcacaccgggcgggaaaucguggaccugaugugccaugccaccuuuacaaugagacugcucuccccuguccgcgugccgaauuauaaccugauuaucauggaugaggcucacuucaccgaccccgcgucuauugccgcucggggauacaucagcacaagaguuggcaugggggaagccgccgcuaucuuuaugaccgccacgccucccggaacagcggaugcuuucccucaguccaaugcccccauucaggacgaggagcgcgacaucccggaacggucuuggaacagcggcaaugaguggauuaccgauuuugccgggaaaacagugugguucgucccuuccaucaaggcuggcaacgacauugccaacugucuucgcaaaaauggaaagaaggugauccaacugucuagaaaaaccuuugauacggaauaccagaagaccaaacucaacgacugggauuucguggucacaaccgacauuagcgagaugggcgcgaauuuuaaggccgaucggguuaucgaccccagacggugccugaaacccgugauccugacagaugggccugagcgcgugauucucgcuggacccaugccugucaccgccgcuuccgccgcucagagacggggccgcguggggagaaacccgcagaaggaaaaugaccaauauaucuucacaggacagccccuuaacaaugaugaggaccaugcccacuggaccgaagcgaagaugcugcuggacaacauuaauacgccugagggcaucauucccgcccucuucgaaccugagcgggagaaaagcgcugccaucgauggggaauacagacugaagggcgagucucgcaaaacauuuguugaacuuaugcggagaggagaccugcccguguggcucgcucacaaggucgccuccgagggcaucaaauauaccgaucgcaaguggugcuucgacgggcagcggaacaaucagauucuggaagagaacauggauguggagaucuggaccaaagaaggagagaagaagaaacugagaccgcgcuggcucgacgcccggacauacagcgauccucuugcucugaaggaauuuaaagaguucgcggccggcagaaagucuauugcucuggaccucguuaccgaaaucgggcgcgugcccucccaucuggcccacagaacacggaaugcccuugauaaccuggucaugcuccauacgagcgagcacggaggccgcgcuuauagacacgccguggaggaacugccugagaccauggaaacacugcuccuucugggccugaugauucuccugaccgggggagcgaugcuuuuucugaucuccggcaaagggaucggaaagacaucuauuggccucaucugugucauugccagcuccgggaugcuguggauggcugagaucccccugcaauggauugccagcgcuaucgugcucgaguucuuuaugaugguucuucugauuccugaacccgagaagcagcggaccccgcaggacaaucaacuggccuacguggugaucggaauccucacgcuggcggccauuaucgcugccaacgaaaugggccuucuggagaccacaaaacgcgaucucggcaugucuaaggaaccuggggucguuucccccaccagcuaucuggacguggaucugcaucccgcuucugccuggacacucuacgcuguggccaccacggucauuacaccuaugcuuagacacaccaucgagaauagcacagcgaacgugucccuggccgcuauugccaaccaggcuguugugcugaugggacucgacaaaggcuggccgaucucuaagauggaccugggggucccccuucuggcccucggaugcuacagccaggugaauccucugacccugaccgccgcgguccuccuucugaucacacauuaugcuauuaucggccccgggcugcaggccaaagcuacgcgggaggcccaaaagagaaccgccgcuggaauuaugaagaacccuacaguggauggcaucaugaccauugaccucgaucccguuaucuacgacuccaaauucgaaaagcagcugggccaggugaugcuucugguccucugugccgugcagcugcugcucaugcgcacaucuugggcgcuuugcgaggcccugacccuggcuacggggccuaucacaacccucugggaaggaagcccgggcaaauuuuggaauaccacaauugccguuuccauggcuaacaucuuccgggggagcuaucuggccggagcgggccuugccuuuucuauuaugaaguccguggggaccggaaaaagaggcacaggcagccaaggggagacgcugggagaaaaguggaagaaaaagcucaaucagcugucccgcaaagauuucgaccuguacaagaaaucuggcaucaccgaggucgaucggacagaggcuaaggaagggcucaaaagaggagagauuacccaccaugccgugagccggggcuccgcuaaacuucagugguuuguggaacgcaacaugguuauccccgaggggagagucauugaccugggauguggccggggcggguggucuuauuacugcgccggacugaagaaagugacagaagugcgcggcuauaccaaagggggaccuggccacgaggagcccgucccuaugagcacguacggguggaauaucguuaaacucauguccggaaaggauguguucuaccugcccccggaaaaaugugacacccuucugugcgauaucggcgagagcucuccuucccccacaguggaagagagcagaaccauucggguccucaagaugguggagcccuggcugaagaacaaucaguucuguaucaaaguucugaacccuuauaugcccacagugauugaacaccucgagcgccuucaaagaaagcauggcgggaugcugguccggaauccucugucucgcaacuccacccacgaaauguacuggaucagcaauggaacaggcaacauuguggcuucuguuaauauggugagcagacuccugcuuaaccgguuuaccaugacgcauagacgcccgacaaucgagaaagacgucgaucugggggccggaacccggcacgugaacgcggaacccgagaccccuaauauggacgugaucggcgagagaauuaagcgcaucaaagaagaacacaacuccacauggcauuaugacgaugaaaaucccuacaagacgugggccuaucacgggucuuacgaggucaaggcuaccggaagcgccuccagcaugauuaacggcguugugaaacuccugacaaagccuugggacgugguccccauggugacccagauggcuaugacagauaccacaccguucggccagcaacggguuuuuaaagaaaagguggacaccagaacgccucgcuccaugcccgggacccggagagucaugggaaucacagccgaguggcuguggcgcacccucggccggaauaaaaagccuagacugugcacacgcgaggaguucaccaagaaagugcggacgaacgccgcgaugggggcuguuuuuacagaggaaaaucagugggauucugccaaggccgcuguggaggacgaagauuucuggaaacuugucgacagagagcgcgagcugcauaagcucggaaaauguggcagcugcguguauaacaugauggggaagagagagaagaagcugggcgaguuuggaaaggccaaaggcucccgggcuauuugguacauguggcuuggggcccgcuaccuggaguucgaggcgcucggauuucugaaugaggaucacugguucucuagagaaaacagcuauuccggcguugagggggaaggacugcauaagcucggcuacauccugcgggacaucucuaaaauucccgggggcgccauguaugcugaugacaccgccggaugggacacaagaaucaccgaggaugaccuucacaaugaagagaagauuacgcagcagauggauccugagcaccggcaacuggcuaacgccaucuuuaaacucaccuaccagaauaagguggucaaggugcagcgccccacaccgaccggcacagucauggacauuaucagcagaaaagaucagcggggguccggacaagugggcaccuaugggcugaacacauucaccaauauggaagcgcagcuuauccgccagauggagggagaaggcguucugagcaaggccgaccucgagaacccucaucugcccgagaagaagauuacgcaguggcuggagacaaaagggguggagagacucaagcggauggcuaucucuggcgaugacugcgucgugaagcccauugaugaccgcuuugccaacgcucugcuugcccugaaugauaugggaaaagugagaaaggacaucccucaauggcagccguccaaaggcuggcacgauuggcagcagguucccuucuguagccaucacuuccacgaacucauuaugaaggacgggcggaaacugguggucccuugccgcccccaagacgagcuuaucggacgggcucggauuucucagggcgccggguggucccugaaggaaaccgcgugucucggaaaggccuacgcucagauguggagccugauguauuuucaucgcagagaucugcggcucgccucuaacgccaucugcuccgcugugccuguucacugggugcccaccagccgcacaaccugguccauccaugcccaccaucaauggaugacaacggaggacaugcugaccgucuggaauagaguguggauugaagauaacccuuggauggaggacaaaacacccgucaccacaugggagaaugugccguaccuuggcaagcgggaagaucaguggugugggagccugaucggccucaccucuagagcgacgugggcucagaacauuccuaccgccauccagcaaguucgcagccugauuggaaaugaggaguuccuugacuacaugcccuccaugaaacgguuuagaaaggaggaggaaucugagggcgccaucugguga

SEQ ID NO: 20586 - RNA, 9873 nt, Artificial Sequence
  derived and/or modified CDS sequence (opt5) from DENV-3__JF920408__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacggcacccaaggcguuacagcugagauuaccccucaggccucuacaaccgaagcuauccugcccgaguaugggacgcugggacucgaaugcuccccucgcaccggccuggacuucaaugagaugauucuucugacaaugaaaaacaaggccuggauggugcauagacagugguuuuucgaucucccccugccguggaccagcggggccacaaccgagacgccuacauggaaucggaaagaacuucuggucaccuuuaagaacgcucacgcgaaaaagcaagagguggucgugcucggaucucaggaaggcgccaugcacacagcucugaccggggccaccgagauccagaauuccggcggaacaggcauuuucgccgggcaucugaagugucgccucaaaauggacaagcuggaacuuaaaggaaugagcuacgcuaugugcacgaacaccuuuguucugaagaaagaggugucugagacacagcacggcaccauccucaucaaggucgaauacaagggggaggaugugcccuguaaaauuccuuucuccacagaagacggacaaggcaaggcccauaacgggagacugaucaccgcgaaucccguugugacgaaaaaggaggagcccgucaacauugaagcugagccuccguucggcgaaagcaauaucgugauuggaaucggcgauaacgcccugaaaaucaauugguauaagaagggguccucuauuggaaaaauguuugaggccacagcucggggcgccagacgcauggcuauccuuggggacaccgccugggauuucggaagcgugggcgggguucucaacucccugggcaagaugguccaccagauuuuuggaagcgcguacaccgcccuguucucuggcguguccugggugaugaaaaucgggauuggaguccuccugacauggaucggccuuaauagcaagaacaccucuaugagcuuuuccugcauugcuaucgggaucauuacacuguaucucggagccgugguucaggcugacaugggcugugugaucaauuggaaagggaaggaacugaagugcggcucuggaauuuucgucacgaacgaggugcauaccuggacagagcaguacaaauuucaagccgauagccccaagcggcuggcgaccgccaucgcuggcgccugggaaaaugggguuuguggaauuagauccacaacccgcauggagaaccuucucuggaaacagaucgcuaaugaacugaacuauauccugugggagaauaacauuaagcucacgguggucgugggcgacaucauugggguucuggaacagggaaaacggacccuuacaccucagcccauggagcugaaguacagcuggaaaaccuggggcaaggccaagaucgugacagccgagacccaaaacucuuccuucauuaucgauggcccuaauacacccgaaugcccgagcgucucuagagcuuggaacgugugggagguggaagacuauggguuuggagucuucaccacgaauaucuggcucaaacugcgcgagguuuacacacagcugugugaccaccggcuuauguccgcggccgugaaggaugaaagagcugugcacgccgacaugggcuacuggauugagagccagaaaaacggguccuggaagcucgagaaagccucucugaucgaagucaagaccugcaccuggccuaagagccauacacugugguccaauggagugcucgagucugauaugauuauccccaaaagccuggcuggcccuauuucccagcacaaccaucgccccggguaucacacccaaacggccggaccuuggcaccuuggcaagcuggaacucgacuuuaauuacugcgagggcacaaccguugugaucacagagaacugugggacccggggacccagccugagaacaaccacggucucuggcaaacugauccaugaauggugcugucgcuccugcacccuuccgccucuccgguauaugggggaggauggauguugguacggcauggaaauuagacccaucagcgagaaggaagagaauauggugaaaucucugguuuccgcggggagcggaaagguggacaacuucacaaugggcguccugugccucgcuauucuguuugaggaagugaugcggggcaaguucgggaaaaagcacaugaucgccggaguuuucuuuaccuucgugcuucugcucucuggccagauuacauggcgcgauauggcccauacccugaucaugauugggagcaaugcuuccgacagaaugggaaugggcgucacguaucuggcccuuaucgcgacauuuaaaauccagcccuuccuggcucucggguuuuuccugcggaagcucaccagcagagagaaccugcuucugggagugggccucgccauggccacaacccugcaacugccugaagauauugagcagauggcuaauggcaucgcccuugggcugauggcucucaaacugauuacccaguuugaaacauaccagcucuggacggcccugaucucucuuaccuguuccaacacaauuuucacccugacaguggcguggcgcaccgccacgcucauccuggcuggagucagccugcuuccgguuugccaauccucuagcaugcggaagacagacuggcugcccauggccguggcugccaugggcgugccuccccucccucuguuuaucuucgggcucaaggauacccugaaaagacgcuccuggccccuuaaugagggagucauggccgugggccugguuucuauucuggcuagcucccuccugagaaacgacgugccuauggcggggccccuugucgccggaggccugcucaucgcuuguuaugugauuaccggcacaucugccgaucugaccguugagaaggccgcugacaucacaugggaagaggaagccgagcagacgggggugagccacaaccucaugauuaccgucgacgaugacggaacaaugcggaucaaagaugacgaaaccgagaauauccugacagugcuucugaagaccgcgcugcucauugucuccggcaucuuuccguacagcauuccugcuacgcugcuuguguggcauaccuggcagaaacagacacaacgcucugggguucugugggaugugcccuccccucccgagacccagaaggccgaacucgaggaaggagucuacagaaucaaacagcagggcauuuucgggaagacacaagugggaguuggcgugcagaaggagggcgucuuucacaccauguggcacgugacacggggggccgugcugacguauaacggaaaacgccucgagccgaauugggcuagcguuaagaaagaccugaucucuuacggcgggggauggagacuuuccgcccaguggcaaaagggcgaagagguccaggugauugcgguggaaccugggaaaaaccccaagaauuuccagaccaugccuggaacauuccagaccaccacaggcgagaucggcgcuaucgcccuggauuuuaagcccgggacgagcggaucucccauuaucaaccgggaaggcaaagucguggggcuguauggaaauggcguugugaccaagaacgggggcuacgucuccggaauugcccaaacaaaugcugagccugacggcccgacccccgagcucgaagaggaaauguucaaaaagcgcaaccugacaaucauggaucuucauccugggagcggaaaaaccagaaaguaucugcccgccauugugcgggaggcuaucaagcgcagacuccggacgcugauccucgccccuacaagaguuguggcggccgaaauggaggaggcucugaaaggccuucccauucgcuaccagaccaccgccacaaaguccgaacacaccgggcgggagaucgucgaccugaugugccaugcuacauuuaccaugagacugcucagcccugugcgcguuccgaauuauaaccugauuaucauggaugaagcccacuucacggaccccgccucuauugcugcgcggggauacaucagcacaagagugggcaugggggaggccgcugccaucuuuaugaccgccacaccucccggcaccgcugaugccuucccucaguccaaugcgcccauucaggacgaagagcgcgacaucccggagcggucuuggaacagcggaaaugaauggauuacggauuuugcuggcaaaaccgucugguucgugccuuccaucaaggccgggaacgacauugccaacugucuuagaaaaaauggaaagaaggugauccaacugucucgcaaaacauuugauaccgaguaccagaagacaaaacucaacgacugggauuucgucguuaccacagacauuagcgaaaugggcgcuaauuuuaaggccgaucgggugaucgaccccagacggugccugaaacccgugauccugaccgaugggccugagcgcgucauucucgcgggacccaugccugugacggccgcuuccgccgcucagagacggggccgcguugggagaaacccgcagaaggagaaugaccaauauaucuucacaggccagccccuuaacaaugaugaagaccaugcccacuggaccgaggcuaagaugcugcuggacaacauuaauaccccugaaggaaucauucccgcccucuucgagccugaacgggagaaaucugcggccaucgauggcgaguacagacugaagggggaaagccgcaaaacauuuguggagcuuaugcggagaggagaccugcccgucuggcucgcucacaagguggccuccgaaggcaucaaauauaccgaucgcaaguggugcuucgacgggcagcggaacaaucagauucuggaggaaaacauggauguugagaucuggacaaaagagggagaaaagaagaaacugagaccgcgcuggcucgacgcucggacguacagcgauccucuugcccugaaggaguuuaaagaauucgccgcuggcagaaagucuauugcgcuggaccucgugaccgagaucggccgcguccccucccaucuggcccacagaacacggaaugcucuugauaaccuggugaugcuccauaccagcgaacacgggggacgcgccuauagacacgccgucgaggagcugccugaaacaauggagacccugcuccuucugggccugaugauucuccugacggggggagcuaugcuuuuucugaucucuggcaaagggaucggaaagaccuccauuggccucaucugugugauugccagcuccggcaugcuguggauggcggaaaucccccugcaauggauugccucugcuaucguucucgaguucuuuaugauggugcuucugauuccugagcccgaaaagcagcggacaccgcaggacaaucaacuggccuacguggucaucgggauccucacccuggcugccauuaucgcggccaacgagaugggacuucuggaaacaaccaaacgcgaucucggcaugagcaaggagccugggguugugucccccacgagcuaucuggacguggaucugcaucccgcuucugccuggacacucuacgcugucgccaccacagugauuaccccuaugcuuagacacaccaucgaaaauuccacagcuaacguuagccuggccgcgauugccaaccaggcugugguccugaugggacucgacaaaggcuggccgaucucuaagauggaccugggggugccccuucuggcccucggaugcuacagccaggucaauccucugacgcugaccgcugccgugcuccuucugaucacacauuaugccauuaucggccccggccugcaggcgaaagcuacccgggaggcccaaaagagaacagcugccgggauuaugaagaacccuaccguugauggaaucaugacgauugaccucgaucccgugaucuacgacuccaaauucgagaagcagcugggccaggucaugcuucuggugcucugugccguucagcugcugcucaugcgcacaucuugggcucuuugcgaagcccugacccuggcgaccgggccuaucacaacccucugggagggaagcccgggcaaauuuuggaauacaacgauugccguguccauggcuaacaucuuccgggggucuuaucuggccggagcuggccuugccuuuagcauuaugaaguccgucggcaccgggaaaagaggaacaggcagccaaggggaaacccugggagagaaguggaagaaaaagcucaaucagcugucucgcaaagauuucgaccuguacaagaaauccggcaucacagaaguggaucggaccgaggcgaaggaggggcucaaaagaggagaaauuacgcaccaugccgugagccggggcuccgcuaagcuucagugguuuguugagcgcaacauggucauccccgaaggcagagugauugaccugggguguggacggggcggguggucuuauuacugcgccggacugaagaaagugaccgagguccgcggcuauacaaaggggggaccuggccacgaagagcccguuccuaugagcaccuacggcuggaauaucgugaaacucauguccgggaaggauguguucuaccugcccccggagaaaugugacacacuucugugcgauaucggagaaucuagcccuucccccaccgucgaggaaagcagaacaauucgggugcucaagaugguugagcccuggcugaagaacaaucaguucuguaucaaagugcugaacccuuauaugcccaccgucauugagcaccucgaacgccuucaaagaaagcauggcgggaugcuggugcggaauccucugucucgcaacuccacgcacgagauguacuggaucagcaauggaacaggcaacauuguugcuucugugaauauggucuccagacuccugcuuaaccgguuuaccaugacccauagacgcccgacaaucgaaaaagacguggaucugggggccggaacgcggcacgugaacgcugagcccgaaaccccuaauauggaggucaucggcgagagaauuaagcgcaucaaagaagagcacaacagcacauggcauuaugacgacgaaaaucccuacaagaccugggccuaucacggcucuuacgagguuaaggcgacagggagcgccuccucuaugauuaacggaguggugaaacuccugaccaagccuugggaugucgugcccaugguuacacagauggcuaugaccgacacgaccccguucggccagcaacggguguuuaaagaaaaggucgauacaagaaccccucgcagcaugcccgggacacggagagugaugggaaucaccgccgaguggcuguggcgcacgcucggccggaauaaaaagccuagacugugcacacgcgaggaauucaccaagaaaguucggacaaacgcugccaugggggccguguuuaccgaggaaaaucagugggacuccgcgaaggcugccgucgaggaugaagacuucuggaaacuuguggauagagagcgcgagcugcauaagcucggcaaauguggaagcugcguuuauaacaugaugggcaagagagaaaaaaagcugggggaguuuggaaaggccaaaggcucccgggcuauuugguacauguggcuuggggcccgcuaccuggaauucgaggcucucggauuucugaaugaggaccacugguucucuagagaaaacagcuauuccggcguggagggggaaggccugcauaagcucggauacauccugcgggauaucucuaaaauucccggcggggccauguaugcggacgauacggccggaugggacaccagaaucacagaggacgaucuucacaaugaagagaagauuacccagcagauggacccugagcaccggcaacuggcugaugccaucuuuaaacucacauaccagaacaaggucgugaagguccagcgccccaccccgacaggcaccgugauggacauuaucagcagaaaagaucagcggggguccggacaaguuggcacguaugggcugaauacauucaccaacauggaagcucagcuuauccgccagauggagggcgaaggagugcugucuaaggccgaccucgagaauccucaucugcccgaaaaaaagauuacccaguggcuggagacaaaaggcgucgagagacucaagcggauggcgaucagcggggaugacugcguggugaagcccauugaugaccgcuuugccaacgcucugcuugcccugaacgauaugggaaaaguuagaaaggacaucccucaauggcagccguccaaaggcuggcacgauuggcagcaggugcccuucuguagccaucacuuccacgaacucauuaugaaggacgggcggaaacuggucgugccuugccgcccccaagacgagcuuaucggaagagcucggauuucucagggcgccggguggucccugaaggaaaccgcuugucucggcaaggccuacgcgcagauguggagccugauguauuuucaucgcagagaucugcggcucgccucuaaugcuaucugcuccgccguuccugugcacuggguccccacaagccgcacgaccuggucuauccaugcccaccaucaauggaugacaaccgaggacaugcugacaguguggaacagagucuggauugaagauaauccuuggauggaggacaaaacccccgugacgaccugggagaacguuccguaccuuggaaagcgggaagaucagugguguggcucccugaucgggcucacaagcagagcuaccugggcccagaauauuccuacagcgauccagcaagugcgcucccugauuggaaacgaggaauuccuugacuacaugcccagcaugaaacgguuuagaaaggaggaggaaucugagggcgcuaucugguga

SEQ ID NO: 20587 - RNA, 9873 nt, Artificial Sequence
  derived and/or modified CDS sequence (opt5) from DENV-3__JF920397__SS-prME
accagccugugccucaugaugauccugcccgccgcucuugccuuccaccugacgucccgggacggagagccucggaugauuguggggaagaacgaacgcggaaagucucuccuguuuaagacggcgagcggcaucaauauguguacccuuauugcuauggaucugggggagaugugcgacgauacagugaccuacaaguguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagaccuucuggucaccuuuaagaacgcucacgcgaaaaagcaagagguggucgugcucgggucucaggaaggagccaugcauacagcucugaccggcgccaccgagauccaaaauuccgggggcacaagcauuuucgccggacaccugaagugucgccucaaaauggauaagcuggaacuuaaaggcaugucuuaugcuaugugcacgaacaccuuuguucugaagaaagagguguccgagacacagcaugggaccauccucaucaaggucgaauacaagggagaggacgugcccuguaaaauuccuuucagcacagaagauggccaagggaaggcccacaacggaagacugaucaccgcgaaucccguugugacgaaaaaggaggagcccgucaacauugaagcugagccuccguucggcgaauccaauaucgugauugggaucggcgacaacgcccugaaaaucaauugguacaagaagggaucuagcauuggcaaaauguuugaggccacagcuagaggggccagacgcauggcuauccuuggagauaccgccugggacuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugauauggggugugugaucaauuggaaaggaaaggaacugaagugcggcagcgggauuuucgucacgaacgaggugcacaccuggacagagcaguauaaauuucaagccgacucccccaagcggcuggcgaccgccaucgcuggcgccugggaaaauggaguuuguggcauuagaagcacaacccgcauggagaaccuucucuggaaacagaucgcuaaugaacugaacuacauccugugggagaauaacauuaagcucacgguggucgugggggauaucauuggaguucuggaacagggcaaacggacccuuacaccucagcccauggagcugaaguauucuuggaaaaccugggggaaggccaagaucgugacagccgagacccaaaacuccagcuucauuaucgacggaccuaauacacccgaaugcccgucugucuccagagcuuggaacgugugggagguggaagacuacggcuuuggcgucuucaccacgaauaucuggcucaaacugcgcgagguuuauacacagcugugugaucaccggcuuaugagcgcggccgugaaggacgaaagagcugugcaugccgauaugggguacuggauugagucccagaaaaacggaucuuggaagcucgagaaagccagccugaucgaagucaagaccugcaccuggccuaagucccacacacuguggucuaauggcgugcucgagagcgacaugauuauccccaaaucccuggcugggccuauuagccagcauaaccaccgccccggauaccacacccaaacggccggcccuuggcaucuugggaagcuggaacucgauuuuaauuauugcgagggaacaaccguugugaucacagagaacuguggcacccggggccccucucugagaacaaccacggucuccgggaaacugauccacgaauggugcugucgcagcugcacccuuccgccucuccgguacaugggagaggacggcuguugguaugggauggaaauuagacccaucucugagaaggaagagaauauggugaaaucccugguuagcgcgggaucuggcaagguggauaacuucacaauggggguccugugccucgcuauucuguuugaggaagugaugcggggaaaguucggcaaaaagcauaugaucgccggcguuuucuuuaccuucgugcuucugcucagcgggcagauuacauggcgcgacauggcccacacccugaucaugauuggauccaaugcuagcgauagaaugggcaugggggucacguaccuggcccuuaucgcgacauuuaaaauccagcccuuccuggcucucggauuuuuccugcggaagcucaccucuagagagaaccugcuucugggcguggggcucgccauggccacaacccugcaacugccugaagacauugagcagauggcuaauggaaucgcccuuggccugauggcucucaaacugauuacccaguuugaaaucuaucagcucuggacagcccugauuucccuuacguguagcaacaccaucuucacacugaccguggcguggcgcacagccacccucauccuggcuggcgucucccugcuuccgaugugccaaucuagcuccaugcggaagacggauuggcugcccauggccguugcugccaugggggugccuccccucccucuguuuauuuucucucucaaggacacacugaaaagacgcagcuggccccuuaaugagggagugauggccgucggccugguguccauccuggcuucuagccuccugagaaacgauguuccuauggcggggccccuuguggccggaggccugcucauugcuuguuacgucaucaccgggaccuccgccgaccugacaguggagaaggccgcugacauuaccugggaagaggaagccgagcagacaggaguuagccauaaccucaugaucacgguggaugacgauggcaccaugcggaucaaagacgaugaaacagagaauauucugaccguccuucugaagacagcgcugcucaucgugucuggcauuuuuccguauuccaucccugcuacccugcuugucuggcacacguggcagaaacagacccaacgcagcggggugcugugggacguucccucuccucccgagacacagaaggccgaacucgaggaaggaguguacagaauuaaacagcagggcaucuucgggaagacccaagucggagugggcguucagaaggaggggguguuucacacaauguggcaugucacccggggagccgugcugacauacaacggcaaacgccucgagccgaauugggcuuccgugaagaaagaucugauuagcuauggcgggggauggagacuuucuacgcaguggcaaaagggcgaagagguucaggucaucgccguggaaccugggaaaaaccccaagaauuuccagaccaugccuggaacauuccagaccaccacaggcgagaucggggcgauugcucuggacuuuaagcccggaacguccggcagccccaucauuaaccgggaaggcaaaguggucgggcuguacggaaauggcgugguuaccaagaacgggggauauguguccggcaucgcccaaacaaaugccgagccugaugggccgacccccgagcucgaagaggaaauguucaaaaagcgcaaccugacaauuauggaccuucacccuggcagcggaaaaaccagaaaguaccugcccgcuaucguccgggaggccaucaagcgcagacuccggacgcugauucucgcuccuacaagagugguugccgcggaaauggaggaggcccugaaaggccuucccauccgcuaucagaccaccgcuacaaagucugaacauaccgggcgggagauuguggaucugaugugccacgccacauuuaccaugagacugcucagcccuguccgcgugccgaauuacaaccugaucauuauggacgaagcucauuucacggaucccgccuccaucgccgcucggggauauaucucuacaagaguuggcaugggggaggcggccgcuauuuuuaugaccgccacaccucccggaaccgccgacgcuuucccucagagcaaugcccccauccaggacgaagaacgcgauauuccggagcgguccuggaacucuggcaaugaauggaucacggacuuugcggggaaaaccgugugguucgucccuagcauuaaggcuggcaacgauaucgccaacugucuucgcaaaaauggaaagaaggugauucaacuguccagaaaaacauuugacaccgaguaccagaagacaaaacucaacgauugggacuucguggucaccacagauaucucugaaaugggcgccaauuuuaaggcugaccggguuaucgaucccagacggugccugaaacccgugauucugaccgacgggccugagcgcgugauccucgccggacccaugccugucacggcggccagcgcugcccagagacggggccgcguggggagaaacccgcagaaggagaaugaucaauacauuuucacaggacagccccuuaacaaugacgaagaccacgcucacuggaccgaggccaagaugcugcuggauaacaucaauaccccugaaggcauuauccccgcucucuucgagccugaacgggagaaauccgccgcgaucgacggggaguauagacugaagggcgaaagccgcaaaacauuuguugagcuuaugcggagaggagaucugcccguguggcucgcccauaaggucgcuucugaaggcauuaaauacaccgaccgcaaguggugcuucgaugggcagcggaacaaucagauccuggaggaaaacauggacguggagauuuggacaaaagagggagaaaagaagaaacugagaccgcgcuggcucgaugcccggacguauuccgacccucuugcucugaaggaguuuaaagaguucgccgccggcagaaagagcaucgcucuggaucucguuaccgagauugggcgcgugcccucucaccuggcgcauagaacacggaaugcccuugacaaccuggucaugcuccacaccuccgaacacggaggccgcgcuuacagacaugccguggaggagcugccugaaacaauggagacccugcuccuucugggccugaugauccuccugacagggggagccaugcuuuuucugaucagcggcaaagggauuggaaagaccuccaucggccucauuugugucaucgcuucuagcgggaugcuguggauggccgaaauuccccugcaauggaucgcguccgccauugugcucgaguucuuuaugaugguucuucugaucccugagcccgaaaagcagcggacaccgcaggauaaucaacuggcuuauguggugaucggcauucucacccuggccgcuaucauugccgcgaacgagaugggccuucuggaaacaaccaaacgcgaccucggcaugagcaaggagccuggggucguuucucccacguccuaccuggauguggaccugcaccccgccagcgcuuggacacucuaugccguggcuaccacagucaucaccccuaugcuuagacauaccauugaaaauucuacagccaacgugagccuggcugccaucgcgaaccaggccguugugcugaugggacucgacaaaggcuggccgaucuccaagauggaucugggggucccccuucuggcucucggaugcuacucucaggugaauccucugacgcugaccgccgcuguccuccuucugauuacacacuacgccaucauuggccccgggcugcaggccaaagcgacccgggaggcucaaaagagaacagccgcuggaaucaugaagaacccuaccguggacggcauuaugacgaucgaucucgaccccguuaucuaugauagcaaauucgagaagcagcugggccaggugaugcuucugguccucugugugguucagcugcugcucaugcgcacauccugggcccuuugcgaagcccugacccuggcuaccgggccuauuacaacccucugggagggaucuccgggcaaauuuuggaauacaacgaucgccgugagcauggcgaacauuuuccggggguccuaccuggccggagcuggccuugccuuuagcaucaugaagucugucgggaccggaaaaagaggcacaggcucccaaggggaaacccugggagagaaguggaagaaaaagcucaaucagcugagccgcaaagacuucgaucuguauaagaaauccggcauuacagaaguggaccggaccgaggcuaaggaggggcucaaaagaggagaaaucacgcaucacgccgugucucggggcagcgcgaaacuucagugguuuguugagcgcaacauggucauucccgaagggagagugaucgaucugggauguggccggggcgggugguccuacuauugcgccggacugaagaaagugaccgagguccgcggcuacacaaaagggggaccuggccacgaggaacccguuccuaugucuaccuauggguggaauaucgugaaacucaugagcggaaaggacguguucuaccugcccccggagaaaugugauacacuucugugcgacauuggcgaauccagcccuucucccaccgucgaggaauccagaacaauccgggugcucaagaugguugagcccuggcugaagaacaaucaguucuguauuaaagugcugaacccuuacaugcccaccgucaucgagcaucucgaacgccuucaaagaaagcacggcgggaugcuggugcggaauccucugagccgcaacucuacgcaugagauguauuggauuuccaauggaacaggcaacaucguugcuagcgugaauauggucucuagacuccugcuuaaccgguuuaccaugacccacagacgcccgacaaucgaaaaagauguggaccugggggccggaacgcggcacgugaacgcugagcccgaaaccccuaauauggacgucauuggcgagagaaucaagcgcauuaaagaggaacauaacagcacauggcacuacgaugacgagaaucccuauaagaccugggccuaccauggguccuaugaaguuaaggcuacaggaucugccagcuccaugaucaacggcguggugaaacuccugaccaagccuugggaugucgugcccaugguuacacagauggcgaugaccgacacgaccccguucggccagcaacggguguuuaaagagaaggucgauacaagaaccccucgcagcaugcccgggacacggagagugaugggaauuaccgccgaauggcuguggcgcacgcucggccggaauaaaaagccuagacugugcacacgcgaggaguucaccaagaaaguucggacaaacgcugccaugggggcuguguuuaccgaagagaaucagugggacuccgccaaggccgcggucgaagaugaggacuucuggaaacuuguggauagagaacgcgagcugcacaagcucggaaaauguggcucuugcguuuacaacaugauggggaagagagagaaaaagcugggcgaauuuggaaaggcuaaaggcagccgggccaucugguauauguggcuuggggcccgcuaccuggaguucgaagcucucggauuucugaaugaggaccauugguucuccagagagaacucuuacagcggcguggaaggggagggacugcacaagcucggcuauauccugcgggauauuuccaaaauccccgggggcgccauguacgcugacgacacggccggaugggauaccagaauuacagaagacgaucuucacaaugaggaaaagaucacccagcagauggacccugagcaucggcaacuggcgaacgccauuuuuaaacucacauaucagaauaaggucgugaagguccagcgccccaccccgacaggcaccgugauggauaucaucucuagaaaagaccagcgggggagcggacaaguuggcacguacgggcugaacacauucaccaauauggaggcucagcuuauucgccagauggaaggagagggcgugcuguccaaggccgaucucgaaaacccucaucugcccgagaaaaagaucacccaguggcuggaaacaaaaggggucgagagacucaagcggauggcuauuagcggcgacgauugcguggugaagcccaucgacgaucgcuuugccaacgcgcugcuugcccugaaugacaugggaaaaguuagaaaggauauuccucaauggcagccgucuaaaggcuggcaugacuggcaacaggugcccuucuguucccaccacuuccaugagcucaucaugaaggacgggcggaaacuggucgugccuugccgcccccaagaugaacuuauuggacgggcucggaucagccagggcgccggguggucucugaaggagaccgcuugucucggaaaggccuaugcucagauguggucccugauguacuuucaccgcagagaccugcggcucgccagcaacgcgaucugcucugccguuccugugcauuggguccccacaucccgcacgaccuggagcauucacgcucaucaccaauggaugacaaccgaagauaugcugacaguguggaauagagucuggaucgaggacaacccuuggauggaagauaaaacccccgugacgaccugggagaauguuccguaucuuggcaagcgggaggaccaguggugugggucccugauuggccucacaagcagagccaccugggcccagaacaucccuacagcuauucagcaagugcgcucucugaucggaaaugaagaguuccuugauuacaugcccagcaugaaacgguuuagaaaggaagaggaguccgaaggcgccaucugguga

SEQ ID NO: 20588 - RNA, 9873 nt, Artificial Sequence
  derived and/or modified CDS sequence (opt5) from DENV-3__JN093513__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaccucagcccauggagcugaaguauucuuggaaaaccugggggaaggccaagaucgugacagccgaaacccaaaacuccagcuucauuaucgauggaccuaauacacccgagugcccgucugucuccagagcuuggaacgugugggaaguggaggacuacggcuuuggcgucuucaccacgaauaucuggcucaaacugcgcgaaguuuauacacagcugugugaccaccggcuuaugagcgcggccgugaaggaugagagagcugugcaugccgacaugggguacuggauugagucccagaaaaacggaucuuggaagcucgaaaaagccagccugaucgaggucaagaccugcaccuggccuaagucccacacacuguggucuaauggcgugcucgaaagcgauaugauuauccccaaaucccuggcugggccuauuagccagcauaaccaccgccccggauaccacacccaaacggccggcccuuggcaucuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcauaugaucgccggcguuuucuuuaccuucgugcuucugcucagcgggcagauuacauggcgcgauauggcccacacccugaucaugauuggauccaauacgagcgacagaaugggcaugggggucacauaccuggcucuuaucgccaccuuuaaaauccagcccuuccuggcgcucggauuuuuccugcggaagcucacaucuagagaaaaccugcuucugggcguggggcucgcuauggccaccacccugcaacugccugaggauauugaacagauggccaauggaaucgcucuuggccugauggcccucaaacugauuacacaguuugagaucuaucagcucuggacggcucugauuucccuuaccuguagcaacacaaucuucacccugacaguggccuggcgcaccgcgacgcucauccuggccggcgucucccugcuuccgguuugccaaucuagcuccaugcggaagacagacuggcugcccauggcuguggccgcuaugggggugccuccccucccucuguuuauuuucggacucaaggauacccugaaaagacgcucuuggccccuuaaugagggcgucauggccguggggcugguuagcauccuggccuccucucuccugagaaacgacgugccuauggcuggaccccuugucgcgggcgggcugcucauugccuguuacgugaucaccggaacaagcgcugaucugaccguugaaaaggccgccgacauuacaugggaggaagaggcugaacagacgggcgugucccauaaccucaugaucaccgucgacgaugacggcacaaugcggaucaaagaugacgagaccgagaauauucugacagugcuucugaagaccgcccugcucaucgucagcgggauuuuuccguauucuaucccugcgacgcugcuuguguggcacaccuggcagaaacagacacaacgcuccggaguucugugggaugugcccagcccucccgaaacccagaaggcugagcucgaagagggcgucuacagaauuaaacagcaggggaucuucggaaagacacaagugggcguuggggugcagaaggagggagucuuucacaccauguggcaugugacacggggcgccgugcugacguacaacggcaaacgccucgaaccgaauugggccucuguuaagaaagaccugauuuccuaugggggaggcuggagacuuagcgcucaguggcaaaagggggaggaaguccaggugaucgccguggagccuggcaagaaccccaagaauuuccagaccaugccuggcacauuccagaccaccacaggggaaaucggagcgauugcucuggauuuuaagcccggcacgucuggcucccccaucauuaaccgggaggggaaagucgugggacuguacggcaaugggguugugaccaagaacggaggcuaugucagcgggaucgcccaaacaaaugccgagccugacggcccgacccccgaacucgaggaagagauguucaaaaagcgcaaccugacaauuauggaucuucacccuggauccggcaaaaccagaaaguaccugcccgcuaucgugcgggaagccaucaagcgcagacuccggacgcugauucucgcuccuacaagaguuguggccgcggagauggaggaagcccugaaagggcuucccauccgcuaucagaccaccgcuacaaagagcgagcauaccggacgggaaauugucgaccugaugugccacgccacauuuaccaugagacugcucucuccugugcgcguuccgaauuacaaccugaucauuauggaugaggcucauuucacggaccccgccagcaucgccgcucggggcuauaucuccacaagaguggggaugggagaagcggccgcuauuuuuaugaccgccacaccucccggcaccgccgaugcuuucccucagucuaaugcccccauccaggacgaggagcgcgacauuccggaacggagcuggaacuccgggaaugaguggaucacggauuuugcgggcaaaaccgucugguucgugccuucuauuaaggcuggaaacgacaucgccaacugucuucgcaaaaauggcaagaaggugauucaacugagcagaaaaacauuugauaccgaauaccagaagacaaaacucaacgacugggauuucgucguuaccacagacaucuccgagaugggggccaauuuuaaggcugaucgggugaucgaccccagacggugccugaaacccgugauucugaccgauggaccugagcgcgucauccucgccggccccaugccugugacggcggccucugcugcccagagacgggggcgcguuggaagaaacccgcagaaggaaaaugaccaauacauuuucacaggccagccccuuaacaaugaugaggaccacgcucacuggaccgaagccaagaugcugcuggacaacaucaauaccccugaggggauuauccccgcucucuucgaaccugagcgggagaaaagcgccgcgaucgauggcgaauauagacugaagggagagucccgcaaaacauuuguggaacuuaugcggagaggcgaccugcccgucuggcucgcccauaagguggcuagcgaggggauuaaauacaccgaucgcaaguggugcuucgacggacagcggaacaaucagauccuggaagagaacauggauguugagauuuggacaaaagaaggcgagaagaagaaacugagaccgcgcuggcucgacgcccggacguauucugauccucuugcucugaaggaauuuaaagaguucgccgccgggagaaaguccaucgcucuggaccucgugaccgaaauuggacgcguccccagccaccuggcgcauagaacacggaaugcccuugauaaccuggugaugcuccacaccucugagcacggcggccgcgcuuacagacaugccgucgaggaacugccugagacaauggaaacccugcuccuucuggggcugaugauccuccugacgggaggcgccaugcuuuuucugaucuccgggaaaggaauuggcaagaccagcaucgggcucauuugugugaucgcuuccucuggaaugcuguggauggccgagauuccccugcaauggaucgcgagcgccauuguucucgaguucuuuaugauggugcuucugaucccugaacccgagaagcagcggacaccgcaggacaaucaacuggcuuauguggucaucggcauucucacccuggccgcuaucauugccgcgaacgaaaugggccuucuggagacaaccaaacgcgaucucgggauguccaaggaaccuggaguugugagccccacgucuuaccuggacguggaucugcaccccgccuccgcuuggacacucuaugccgucgcuaccacagugaucaccccuaugcuuagacauaccauugagaauagcacagccaacguuucucuggcugccaucgcgaaccaggccgugguccugaugggccucgacaaaggguggccgaucagcaagauggaccugggagugccccuucuggcucucggcugcuacucccaggucaauccucugacgcugaccgccgcugugcuccuucugauuacacacuacgccaucauugggcccggacugcaggccaaagcgacccgggaggcucaaaagagaacagccgcuggcaucaugaagaacccuaccguugauggcauuaugacgaucgaccucgaucccgugaucuaugacucuaaauucgaaaagcagcuggggcaggucaugcuucuggugcucugugccguucagcugcugcucaugcgcacaagcugggcccuuugcgaggcucugacccuggccaccggaccuauuacaacccucugggaaggcuccccggggaaauuuuggaauacaacgaucgcggugucuauggccaacauuuuccggggaagcuaccuggcuggcgccgggcuugcuuuuuccaucaugaaaagcgucggaaccggcaaaagaggcacagggucucaaggagagacccugggcgaaaaguggaagaaaaagcucaaucagcugucccgcaaagauuucgaccuguauaagaaaagcgggauuacagagguggaucggaccgaggccaaggaaggacucaaaagaggcgagaucacgcaucacgcggugucccgggggucugccaaacuucagugguuuguugaacgcaacauggucauucccgagggaagagugaucgaccugggcuguggcagagggggauggagcuacuauugcgcuggccugaagaaagugaccgaaguccgcggguacacaaagggaggcccugggcacgaggagcccguuccuauguccaccuauggauggaauaucgugaaacucaugucuggcaaggauguguucuaccugcccccggaaaaaugugacacacuucugugcgauauuggcgagagcuccccuagccccaccgucgaagagucuagaacaauccgggugcucaagaugguugagcccuggcugaagaacaaucaguucuguauuaaagugcugaacccuuacaugcccaccgucaucgaacaucucgagcgccuucaaagaaagcacgggggaaugcuggugcggaauccucugucccgcaacagcacgcaugaaauguauuggauuucuaauggcacagggaacaucguugccuccgugaauauggucagcagacuccugcuuaaccgguuuaccaugacccacagacgcccgacaaucgagaaagacguggaucugggagcuggcacgcggcacgugaacgccgaacccgagaccccuaauauggacgucauuggggagagaaucaagcgcauuaaagaagaacacaacucuacauggcacuacgacgaugaaaaucccuauaagaccugggcuuaccauggaagcuaugagguuaaggccacaggcuccgcgucuagcaugaucaacggcguggugaaacuccugaccaagccuugggacgucgugcccaugguuacacagauggccaugaccgauacgaccccguucgggcagcaacggguguuuaaagaaaaggucgacacaagaaccccucgcuccaugcccggaacacggagagugaugggcauuaccgcugaguggcuguggcgcacgcucgggcggaauaaaaagccuagacugugcacacgcgaggaguucaccaagaaaguucggacaaacgccgcuaugggagccguguuuaccgaggaaaaucagugggauagcgccaaggcggcugucgaggacgaagauuucuggaaacuuguggacagagagcgcgagcugcacaagcucggcaaauguggguccugcguuuacaacaugaugggcaagagagagaagaagcugggagaguuuggcaaggccaaagggucucgggccaucugguauauguggcuuggagcucgcuaccuggaguucgaggcccucggcuuucugaaugaggaucauugguucagcagagaaaacuccuacucugggguggagggagaaggccugcacaagcucggguauauccugcgggacauuagcaaaauccccggcggagcuauguacgccgaugacacggcgggcugggacaccagaauuacagaggaugaccuucacaaugaagagaagaucacccagcagauggauccugagcaucggcaacuggccaacgcuauuuuuaaacucacauaucagaauaaggucgugaagguccagcgccccaccccgacagggaccgugauggacaucaucuccagaaaagaucagcggggaucuggccaaguugggacguacggacugaacacauucaccaauauggaagcccagcuuauucgccagauggagggcgaaggggugcugagcaaggcugaccucgagaacccucaucugcccgagaaaaagaucacccaguggcuggagacaaaaggcgucgagagacucaagcggauggccauuuccggagaugacugcguggugaagcccaucgaugaccgcuuugcgaacgcccugcuugcucugaaugauaugggcaaaguuagaaaggacauuccucaauggcagccgagcaaaggguggcaugauuggcaacaggugcccuucuguucucaccacuuccaugaacucaucaugaaggacggacggaaacuggucgugccuugccgcccccaagacgagcuuauuggcagagcccggaucucccagggggcuggauggagccugaaggaaaccgccugucucggcaaggcuuaugcccagauguggucucugauguacuuucaccgcagagaucugcggcucgcguccaacgccaucugcagcgcuguuccugugcauuggguccccacaucucgcacgaccugguccauucacgcccaucaccaauggaugacaaccgaggacaugcugacaguguggaauagagucuggaucgaagauaacccuuggauggaggacaaaacccccgugacgaccugggagaauguuccguaucuugggaagcgggaagaucagugguguggcagccugauuggacucacauccagagccaccugggcucagaacaucccuacagccauucagcaagugcgcagccugaucggcaaugaggaguuccuugacuacaugcccucuaugaaacgguuuagaaaggaggaggaaagcgagggggcgaucugguga

SEQ ID NO: 20589 - RNA, 9873 nt, Artificial Sequence
  derived and/or modified CDS sequence (opt5) from DENV-3__JF937624__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaaaaggccgcugacaucacaugggaggaagaggccgaacagacgggcgugucccacaaccucaugauuaccgucgacgaugacggcacaaugcggaucaaagaugacgagaccgagaauauccugacagugcuucugaagaccgcgcugcucauugucagcgggaucuuuccguacucuauuccugcuacgcugcuuguguggcauaccuggcagaaacagacacaacgcuccggaguucugugggaugugcccagcccucccgaaacccagaaggccgagcucgaagagggcgucuacagaaucaaacagcaggggauuuucggaaagacacaagugggcguuggggugcagaaggagggagucuuucacaccauguggcacgugacacggggcgccgugcugacguauaacggcaaacgccucgaaccgaauugggcuucuguuaagaaagaccugaucuccuacgggggaggcuggagacuuagcgcccaguggcaaaagggggaggaaguccaggugauugcgguggagccuggcaagaaccccaagaauuuccagaccaugccuggcacauuccagaccaucaccggggaaaucggagcuauugcccuggauuuuaagcccggcacaucuggcucccccaucauuaaccgggaggggaaagucgugggacuguauggcaaugggguugugacgaagaacggaggcuacgucagcgggaucgcccaaaccaaugcugagccugacggcccgacacccgaacucgaggaagagauguucaaaaagcgcaaccugaccauuauggaucuucauccuggauccggcaaaacaagaaaguaucugcccgccaucgugcgggaagcuaucaagcgcagacuccggacccugauucucgccccuacgagaguuguggcggccgagauggaggaagcucugaaagggcuucccauccgcuaccagacaaccgccaccaagagcgagcacacaggacgggaaauugucgaccugaugugccaugcuaccuuuacaaugagacugcucucuccugugcgcguuccgaauuauaaccugaucauuauggaugaggcccacuucaccgaccccgccagcaucgcugcgcggggcuacaucuccacgagaguggggaugggagaagccgcugccauuuuuaugacagccaccccucccggcacagcugaugccuucccucagucuaaugcgcccauccaggacgaggagcgcgacauuccggaacggagcuggaacuccgggaaugaguggaucaccgauuuugcuggcaaaacggucugguucgugccuucuauuaaggccggaaacgacaucgccaacugucuucgcaaaaauggcaagaaggugauucaacugagcagaaaaaccuuugauacagaauaccagaagaccaaacucaacgacugggauuucgucguuacaaccgacaucuccgagaugggggcuaauuuuaaggccgaucgggugaucgaccccagacggugccugaaacccgugauucugacagauggaccugagcgcgucauccucgcgggccccaugccugugaccgccgcuucugccgcucagagacgggggcgcguuggaagaaacccgcagaaggaaaaugaccaauauauuuucacgggccagccccuuaacaaugaugaggaccaugcccacuggacagaagcuaagaugcugcuggacaacaucaauaccccugaggggauuauccccgcccucuucgaaccugagcgggagaaaagcgcggccaucgauggcgaauacagacugaagggagagucccgcaaaaccuuuguggaacuuaugcggagaggcgaccugcccgucuggcucgcucacaagguggccagcgaggggauuaaauauacagaucgcaaguggugcuucgacggacagcggaacaaucagauccuggaagagaacauggauguugagauuuggaccaaagaaggcgagaagaagaaacugagaccgcgcuggcucgacgcucggacauacucugauccucuugcccugaaggaauuuaaagaguucgccgcugggagaaaguccaucgcgcuggaccucgugacggaaauuggacgcguccccagccaucuggcccacagaacccggaaugcucuugauaaccuggugaugcuccauacaucugagcacggcggccgcgccuauagacacgccgucgaggaacugccugagaccauggaaacacugcuccuucuggggcugaugauccuccugaccggaggcgcuaugcuuuuucugaucuccgggaaaggaauuggcaagacgagcaucgggcucauuugugugaucgccuccucuggaaugcuguggauggcggagauuccccugcaauggaucgccagcgcuauuguucucgaguucuuuaugauggugcuucugaucccugaacccgagaagcagcggaccccgcaggacaaucaacuggccuacguggucaucggcauucucacacuggcugccaucauugcggccaacgaaaugggccuucuggagaccacaaaacgcgaucucgggauguccaaggaaccuggaguugugagccccaccucuuaucuggacguggaucugcaucccgcuuccgccuggacgcucuacgcugucgccacaaccgugaucacaccuaugcuuagacacaccauugagaauagcaccgcuaacguuucucuggccgcgaucgccaaccaggcugugguccugaugggccucgacaaaggguggccgaucagcaagauggaccugggagugccccuucuggcccucggcugcuacucccaggucaauccucugacacugacggcugccgugcuccuucugauuacccauuaugccaucauugggcccggacugcaggcgaaagcuacacgggaggcccaaaagagaaccgcugccggcaucaugaagaacccuacaguugauggcauuaugaccaucgaccucgaucccgugaucuacgacucuaaauucgaaaagcagcuggggcaggucaugcuucuggugcucugugccguucagcugcugcucaugcgcacgagcugggcucuuugcgaggcccugacacuggcgaccggaccuauuaccacacucugggaaggcuccccggggaaauuuuggaauaccacaaucgccgugucuauggcuaacauuuuccggggaagcuaucuggccggcgcugggcuugccuuuuccaucaugaaaagcgucggaacgggcaaaagaggcaccgggucucaaggagagacacugggcgaaaaguggaagaaaaagcucaaucagcugucccgcaaagauuucgaccuguacaagaaaagcgggauuaccgagguggaucggacagaggcgaaggaaggacucaaaagaggcgagaucacccaccaugccgugucccgggggucugcuaaacuucagugguuuguugaacgcaacauggucauucccgagggaagagugaucgaccugggcuguggcagagggggauggagcuauuacugcgccggccugaagaaagugacggaaguccgcggguauaccaagggaggcccugggcacgaggagcccguuccuauguccacauacggauggaauaucgugaaacucaugucuggcaaggauguguucuaccugcccccggaaaaaugugacacccuucugugcgauauuggcgagagcuccccuagccccacagucgaagagucuagaaccauccgggugcucaagaugguugagcccuggcugaagaacaaucaguucuguauuaaagugcugaacccuuauaugcccacagucaucgaacaccucgagcgccuucaaagaaagcaugggggaaugcuggugcggaauccucugucccgcaacagcacccacgaaauguacuggauuucuaauggcacggggaacaucguugcuuccgugaauauggucagcagacuccugcuuaaccgguuuacaaugacccauagacgcccgaccaucgagaaagacguggaucugggagccggcacacggcacgugaacgcugaacccgagacgccuaauauggacgucauuggggagagaaucaagcgcauuaaagaagaacacaacucuaccuggcauuaugacgaugaaaaucccuacaagacaugggccuaucacggaagcuacgagguuaaggcgaccggcuccgccucuagcaugaucaacggcguggugaaacuccugacaaagccuugggacgucgugcccaugguuacccagauggcuaugacagauaccacgccguucgggcagcaacggguguuuaaagaaaaggucgacaccagaacaccucgcuccaugcccggaacccggagaauuaugggcaucacagccgaguggcuguggcgcacccucgggcggaauaaaaagccuagacugugcacgcgcgaggaguucacaaagaaagugcggaccaacgcugccaugggagccguuuuuacagaggaaaaucagugggauagcgcgaaggcugccguggaggacgaagauuucuggaaacuugucgacagagagcgcgagcugcauaagcucggcaaauguggguccugcguguauaacaugaugggcaagagagagaagaagcugggagaguuuggcaaggccaaagggucucgggcuaucugguacauguggcuuggagcccgcuaccuggaguucgaggcucucggcuuucugaaugaggaucacugguucagcagagaaaacuccuauucugggguugagggagaaggccugcauaagcucggguacauucugcgggacaucagcaaaauucccggcggagccauguaugcggaugacaccgccggcugggacacgagaaucaccgaggaugaccuucacaaugaagagaagauuacacagcagauggauccugagcaccggcaacuggcuaacgccaucuuuaaacucaccuaccagaauaagguggucaaggugcagcgccccacaccgaccgggacagucauggacaucauuuccagaaaagaucagcggggaucuggccaaguggggaccuauggacugaacacguucacaaauauggaagcucagcuuauccgccagauggagggcgaagggguucugagcaaggccgaccucgagaacccucaucugcccgagaaaaagauuacccaguggcuggagaccaaaggcguggagagacucaagcggauggcgaucuccggagaugacugcgucgugaagcccauugaugaccgcuuugccaacgcucugcuugcccugaaugauaugggcaaagugagaaaggacaucccucaauggcagccgagcaaaggguggcacgauuggcagcagguucccuucuguucucaucacuuccacgaacucauuaugaaggacggacggaaacugguggucccuugccgcccccaagacgagcuuaucggcagagcucggaucucccagggggccggauggagccugaaggaaacagcuugucucggcaaggccuacgcgcagauguggucucugauguauuuucaucgcagagaucugcggcucgccuccaacgcuauuugcagcgccgugccuguucacugggugcccaccucucgcacaacgugguccauccaugcccaccaucaauggaugaccacagaggacaugcugaccgucuggaauagaguguggauugaagauaacccuuggauggaggacaaaacacccgucaccacgugggagaaugugccguaccuugggaagcgggaagaucagugguguggcagccugaucggacucaccuccagagcuacaugggcccagaacauuccuaccgcgauccagcaaguucgcagccugaucggcaaugaggaguuccuugacuacaugcccucuaugaaacgguuuagaaaggaggaggaaagcgagggggcuauuugguga

SEQ ID NO: 20590 - RNA, 9873 nt, Artificial Sequence
  derived and/or modified CDS sequence (opt5) from DENV-3__JN000938__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaaggugguuauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccuucucugaaaaggaggagaauauggugaaaucccugguuagcgcgggaggcgggaagguggacaacuuuacaaugggaguccugugccucgcuauccuguucgaagaggugaugcggggcaaguucggcaaaaagcacaugauugccggggucuuuuucaccuuugugcuucugcucucuggacagaucacauggcgcgauauggcccauacccugauuaugaucggcagcaaugcuuccgacagaauggggaugggagucacguaucuggcccuuauugcgacauucaaaauccagcccuuucuggcucucggcuucuuucugcggaagcucaccagcagagaaaaccugcuucugggggugggacucgccauggccacaacccugcaacugccugaggauaucgaacagauggcuaauggcauugcccuuggccugauggcucucaaacugaucacccaguucgagacauaccagcucuggacggcccugauuucucuuaccuguuccaacacaaucuuuacccugacaguggcguggcgcaccgccacgcucauucuggcuggggucagccugcuuccgguuugccaauccucuagcaugcggaagacagacuggcugcccauggccguggcugccaugggagugccuccccucccucuguucaucuuuggccucaaggauacccugaaaagacgcuccuggccccuuaaugagggggucauggccgugggacugguuucuauccuggcuagcucccuccugagaaacgacgugccuauggcgggcccccuugucgccgggggacugcucauugcuuguuaugugaucaccggcacaucugccgaucugaccguugaaaaggccgcugacauuacaugggaggaagaggccgaacagacgggcgugagccacaaccucaugaucaccgucgacgaugacgggacaaugcggauuaaagaugacgagaccgagaauauccugacagugcuucugaagaccgcgcugcucaucgucuccggaauuuucccguacagcaucccugcuacgcugcuuguguggcauaccuggcagaaacagacacaacgcucuggcguucugugggaugugcccuccccucccgaaacccagaaggccgagcucgaagagggggucuacagaauuaaacagcagggaaucuuuggcaagacacaaguggggguuggagugcagaaggagggcgucuuccacaccauguggcacgugacacggggcgccgugcugacguauaacgggaaacgccucgaaccgaauugggcuagcguuaagaaagaccugauuucuuacggaggcggguggagacuuuccgcccaguggcaaaagggagaggaaguccaggugaucgcgguggagccuggcaaaaaccccaagaauuuccagaccaugccugggacauuucagaccaccacaggagaaauuggcgcuaucgcccuggauuucaagcccggcacgagcgggucucccaucauuaaccgggagggaaaagucgugggccuguaugggaauggaguugugaccaagaacggcggguacgucuccggcaucgcccaaacaaaugcugagccugacggaccgacccccgaacucgaggaagagauguuuaaaaagcgcaaccugacaauuauggaucuucauccuggcagcgggaaaaccagaaaguaucugcccgccaucgugcgggaagcuauuaagcgcagacuccggacgcugauccucgccccuacaagaguuguggcggccgagauggaggaagcucugaaaggacuucccauccgcuaccagaccaccgccacaaaguccgagcacaccggccgggaaauugucgaccugaugugccaugcuacauucaccaugagacugcucagcccugugcgcguuccgaauuauaaccugaucauuauggaugaggcccacuuuacggaccccgccucuaucgcugcgcggggguacauuagcacaagagugggaaugggcgaagccgcugccaucuucaugaccgccacaccucccgggaccgcugaugccuuuccucaguccaaugcgcccauccaggacgaggagcgcgacauuccggaacggucuuggaacagcggcaaugaguggaucacggauuucgcuggaaaaaccgucugguuugugccuuccauuaaggccggcaacgacaucgccaacugucuucgcaaaaaugggaagaaggugauucaacugucuagaaaaacauucgauaccgaauaccagaagacaaaacucaacgacugggauuuugucguuaccacagacaucagcgagaugggagcuaauuucaaggccgaucgggugauugaccccagacggugccugaaacccgugauccugaccgauggcccugagcgcgucauccucgcggggcccaugccugugacggccgcuuccgccgcucagagacggggacgcguuggcagaaacccgcagaaggaaaaugaccaauauauuuucacagggcagccccuuaacaaugaugaggaccaugcccacuggaccgaagcuaagaugcugcuggacaacaucaauaccccugagggcauuauccccgcccucuuugaaccugagcgggagaaaucugcggccauugauggagaauacagacugaagggcgagagccgcaaaacauucguggaacuuaugcggagaggggaccugcccgucuggcucgcucacaagguggccuccgagggaaucaaauauaccgaucgcaaguggugcuuugacggccagcggaacaaucagauccuggaagagaacauggauguugagauuuggacaaaagaaggggagaagaagaaacugagaccgcgcuggcucgacgcucggacguacagcgauccucuugcccugaaggaguucaaagaguuugccgcuggaagaaagucuaucgcgcuggaccucgugaccgaaauuggccgcguccccucccaucuggcccacagaacacggaaugcucuugauaaccuggugaugcuccauaccagcgagcacggcgggcgcgccuauagacacgccgucgaggaacugccugagacaauggaaacccugcuccuucugggacugaugauccuccugacgggcggggcuaugcuuuuccugauuucuggaaaaggcaucgggaagaccuccaucggacucauuugugugaucgccagcuccggcaugcuguggauggcggagauuccccugcaauggaucgccucugcuauuguucucgaguuuuucaugauggugcuucugaucccugaacccgagaagcagcggacaccgcaggacaaucaacuggccuacguggucauuggcauccucacccuggcugccaucauugcggccaacgaaauggggcuucuggagacaaccaaacgcgaucucggaaugagcaaggaaccuggcguugugucccccacgagcuaucuggacguggaucugcaucccgcuucugccuggacacucuacgcugucgccaccacagugaucaccccuaugcuuagacacaccauugaaaauuccacagcuaacguuagccuggccgcgaucgccaaccaggcugugguccugauggggcucgacaaaggauggccgauuucuaagauggaccugggcgugccccuucuggcccucgggugcuacagccaggucaauccucugacgcugaccgcugccgugcuccuucugaucacacauuaugccaucauuggacccggccugcaggcgaaagcuacccgggaggcccaaaagagaacagcugccggcaucaugaagaacccuaccguugaugggauuaugacgaucgaccucgaucccgugauuuacgacuccaaauuugaaaagcagcugggacaggucaugcuucuggugcucugugccguucagcugcugcucaugcgcacaucuugggcucuuugcgaggcccugacccuggcgaccggcccuaucacaacccucugggaagggagcccgggaaaauucuggaauacaacgaucgccguguccauggcuaacauuuuucggggcucuuaucuggccggggcuggacuugccuucagcaucaugaaguccgucggcaccggcaaaagagggacaggaagccaaggcgagacccugggggaaaaguggaagaaaaagcucaaucagcugucucgcaaagauuuugaccuguacaagaaauccggaauuacagagguggaucggaccgaggcgaaggaaggccucaaaagaggggagaucacgcaccaugccgugagccggggauccgcuaaacuucagugguucguugaacgcaacauggucauucccgagggcagagugaucgaccugggcugugggcggggaggcuggucuuauuacugcgccgggcugaagaaagugaccgaaguccgcggauauacaaagggcgggccuggacacgaggagcccguuccuaugagcaccuacggcuggaauauugugaaacucauguccggcaaggauguguucuaccugcccccggaaaaaugugacacacuucugugcgauaucggggagucuagcccuucccccaccgucgaagagagcagaacaauccgggugcucaagaugguugagcccuggcugaagaacaaucaguuuuguauuaaagugcugaacccuuauaugcccaccgucaucgaacaccucgagcgccuucaaagaaagcauggaggcaugcuggugcggaauccucugucucgcaacuccacgcacgaaauguacuggauuagcaaugggacaggaaacaucguugcuucugugaauauggucuccagacuccugcuuaaccgguucaccaugacccauagacgcccgacaauugagaaagacguggaucugggcgccgggacgcggcacgugaacgcugaacccgagaccccuaauauggacgucaucggagagagaaucaagcgcauuaaagaagaacacaacagcacauggcauuaugacgaugaaaaucccuacaagaccugggccuaucacggcucuuacgagguuaaggcgacaggcagcgccuccucuaugaucaacgggguggugaaacuccugaccaagccuugggacgucgugcccaugguuacacagauggcuaugaccgauacgaccccguuuggacagcaacggguguucaaagaaaaggucgacacaagaaccccucgcagcaugcccggcacacggagagugauggggauuaccgccgaguggcuguggcgcacgcucggacggaauaaaaagccuagacugugcacacgcgaggaauuuaccaagaaaguucggacaaacgcugccaugggcgccguguucaccgaggaaaaucagugggauuccgcgaaggcugccgucgaggacgaagauuuuuggaaacuuguggacagagagcgcgagcugcauaagcucgggaaauguggcagcugcguuuauaacaugaugggaaagagagagaagaagcugggcgaguucgggaaggccaaaggaucccgggcuaucugguacauguggcuuggcgcccgcuaccuggaauuugaggcucucggguuccugaaugaggaucacugguuuucuagagaaaacagcuauuccggaguggagggcgaagggcugcauaagcucggcuacauucugcgggacaucucuaaaauccccggaggcgccauguaugcggaugacacggccgggugggacaccagaauuacagaggaugaccuucacaaugaagagaagaucacccagcagauggauccugagcaccggcaacuggcuaacgccauuuucaaacucacauaccagaauaaggucgugaagguccagcgccccaccccgacaggaaccgugauggacaucauuagcagaaaagaucagcggggcuccgggcaaguuggaacguauggccugaacacauuuaccaauauggaagcucagcuuauccgccagauggagggggaaggcgugcugucuaaggccgaccucgagaacccucaucugcccgagaaaaagaucacccaguggcuggagacaaaaggagucgagagacucaagcggauggcgauuagcggcgaugacugcguggugaagcccaucgaugaccgcuucgccaacgcucugcuugcccugaaugauauggggaaaguuagaaaggacauuccucaauggcagccguccaaaggauggcacgauuggcaacaggugcccuucuguagccaucacuuucacgaacucaucaugaaggacggccggaaacuggucgugccuugccgcccccaagacgagcuuauugggagagcucggaucucucagggagccggcuggucccugaaggaaaccgcuugucucgggaaggccuacgcgcagauguggagccugauguauuuccaucgcagagaucugcggcucgccucuaacgcuauuugcuccgccguuccugugcacuggguccccacaagccgcacgaccuggucuauccaugcccaccaucaauggaugacaaccgaggacaugcugacaguguggaauagagucuggaucgaagauaacccuuggauggaggacaaaacccccgugacgaccugggagaauguuccguaccuuggcaagcgggaagaucagugguguggaucccugauuggccucacaagcagagcuaccugggcccagaacaucccuacagcgauucagcaagugcgcucccugaucgggaaugaggaauuucuugacuacaugcccagcaugaaacgguucagaaaggaggaggaaucugagggagcuauuugguga

SEQ ID NO: 20591 - RNA, 9873 nt, Artificial Sequence
  derived and/or modified CDS sequence (opt5) from DENV-3__JN093515__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccagaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaacgggaggaacccgucaacauugaggcugaaccuccguucggcgaguccaauaucgugauugggaucggcgauaacgcccugaagaucaauugguacaaaaagggaucuagcauuggcaagauguuugaagccacagcuagaggggcccgccggauggcuauccuuggagacaccgccugggauuucggcuccguggggggaguucucaacagccugggcaaaaugguccaucagauuuuugggucugcguauaccgcccuguucuccggcgugagcugggugaugaagaucggaauuggcguccuccugacauggaucgggcuuaauucuaaaaacaccagcauguccuuuucuugcauugcuaucggaaucauuacacuguaccucggcgccgugguucaggcugacauggggugugugaucaauuggaagggaaaagagcugaagugcggcagcgggauuuucgucacgaacgaggugcacaccuggacagaacaguauaaguuucaagccgauucccccaaaagacuggcgaccgccaucgcuggcgccugggagaauggaguuuguggcauucgcagcacaacccggauggaaaaccuucucuggaagcagaucgcuaaugagcugaacuacauccugugggaaaauaacauuaaacucacgguggucgugggggacaucauuggaguucuggagcagggcaagagaacccuuacaccucagcccauggagcugaaauauucuuggaagaccugggggaaagccaagaucgugacagccgaaacccaaaacuccagcuucauuaucgauggaccuaauacacccgagugcccgucugucucccgcgcuuggaacgugugggaaguggaggacuacggcuuuggcgucuucaccacgaauaucuggcucaagcugcgggaaguuuauacacagcugugugaccacagacuuaugagcgcggccgugaaagaugagcgcgcugugcaugccgacaugggguacuggauugagucccagaagaacggaucuuggaaacucgaaaaggccagccugaucgaggucaaaaccugcaccuggccuaagucccacacacuguggucuaauggcgugcucgaaagcgauaugauuauccccaagucccuggcugggccuauuagccagcauaaccaccggcccggauaccacacccaaacggccggcccuuggcaucuugggaaacuggagcucgacuuuaauuauugcgagggaacaaccguugugaucacagaaaacuguggcaccagaggccccucucugcgcacaaccacggucuccgggaagcugauccacgaguggugcugucggagcugcacccuuccgccucucagauacaugggagaagauggcuguugguaugggauggagauucggcccaucucugaaaaagaggagaauauggugaagucccugguuagcgcgggaucuggcaaaguggacaacuucacaauggggguccugugccucgcuauucuguuugaagaggugaugcgcggaaaguucggcaagaaacauaugaucgccggcguuuucuuuaccuucgugcuucugcucagcgggcagauuacauggagagauauggcccacacccugaucaugauuggauccaaugcuagcgaccggaugggcaugggggucacguaccuggcccuuaucgcgacauuuaagauccagcccuuccuggcucucggauuuuuccugagaaaacucaccucucgcgaaaaccugcuucugggcguggggcucgccauggccacaacccugcaacugccugaggauauugaacagauggcuaauggaaucgcccuuggccugauggcucucaagcugauuacccaguuugagaucuaucagcucuggacagcccugauuucccuuacguguagcaacaccaucuucacacugaccguggcguggcggacagccacccucauccuggcuggcgucucccugcuuccgaugugccaaucuagcuccaugagaaaaacggacuggcugcccauggccguugcugccaugggggugccuccccucccucuguuuauuuucucucucaaggauacacugaagcgcagaagcuggccccuuaaugagggagugauggccgucggccugguguccauccuggcuucuagccuccugcggaacgacguuccuauggcggggccccuuguggccggaggccugcucauugcuuguuacgucaucaccgggaccuccgccgaucugacaguggaaaaagccgcugacauuaccugggaggaagaggccgaacagacaggaguuagccauaaccucaugaucacgguggacgaugacggcaccaugcgcaucaaggaugacgagacagagaauauucugaccguccuucugaaaacagcgcugcucaucgugucuggcauuuuuccguauuccaucccugcuacccugcuugucuggcacacguggcagaagcagacccaaagaagcggggugcugugggauguucccucuccucccgaaacacagaaagccgagcucgaagagggaguguaccggauuaagcagcagggcaucuucgggaaaacccaagucggagugggcguucagaaggaggggguguuucacacaauguggcaugucacccgcggagccgugcugacauacaacggcaagagacucgaaccgaauugggcuuccgugaaaaaggaccugauuagcuauggcgggggauggcggcuuucugcccaguggcaaaaaggcgaggaaguucaggucaucgcgguggagccugggaagaaccccaaaaauuuccagacgaugccuggaaccuuccagacaaccaccggcgaaaucggggcuauugcccuggauuuuaagcccggaacauccggcagccccaucauuaaccgcgagggcaagguggucgggcuguacggaaauggcgugguuacgaaaaacgggggauauguguccggcaucgcccaaaccaaugcugagccugacgggccgacacccgaacucgaggaagagauguucaagaaaagaaaccugaccauuauggaucuucacccuggcagcggaaagacacggaaauaccugcccgccaucguccgcgaagcuaucaagagacggcucagaacccugauucucgccccuacgcgcgugguugcggccgagauggaggaagcucugaagggccuucccauccgguaucagacaaccgccaccaaaucugagcauacagggagagaaauuguggaccugaugugccacgcuaccuuuacaaugcgccugcucagcccuguccgggugccgaauuacaaccugaucauuauggaugaggcccauuucaccgaccccgccuccaucgcugcgagaggauauaucucuacgcgcguuggcaugggggaagccgcugccauuuuuaugacagccaccccucccggaacagcugaugccuucccucagagcaaugcgcccauccaggacgaggagcgggacauuccggaaagauccuggaacucuggcaaugaguggaucaccgauuuugcugggaagacggugugguucgucccuagcauuaaagccggcaacgacaucgccaacugucuucgcaagaauggaaaaaaggugauucaacugucccggaagaccuuugauacagaauaccagaaaaccaagcucaacgacugggauuucguggucacaaccgacaucucugagaugggcgcuaauuuuaaagccgauagaguuaucgacccccggcgcugccugaagcccgugauucugacagaugggccugagagagugauccucgcgggacccaugccugucaccgccgcuagcgccgcucagcggcgcggcagaguggggcggaacccgcagaaagaaaaugaccaauacauuuucacgggacagccccuuaacaaugaugaggaccacgcccacuggacagaagcuaagaugcugcuggacaacaucaauaccccugagggcauuauccccgcccucuucgaaccugagagagagaaguccgcggccaucgauggggaauaucgccugaaaggcgagagccggaagaccuuuguugaacuuaugagacgcggagaccugcccguguggcucgcucauaaagucgccucugagggcauuaaguacacagaucggaaauggugcuucgacgggcagagaaacaaucagauccuggaagagaacauggauguggagauuuggaccaaggaaggagagaaaaagaagcugcgcccgcgguggcucgacgcuagaacauauuccgauccucuugcccugaaagaauuuaaggaguucgccgcuggccgcaaaagcaucgcgcuggaccucguuacggaaauugggagagugcccucucaccuggcccaucggacccgcaaugcucuugauaaccuggucaugcuccacacauccgagcacggaggcagagccuaccggcaugccguggaggaacugccugagaccauggaaacacugcuccuucugggccugaugauccuccugaccgggggagcuaugcuuuuucugaucagcggcaaggggauuggaaaaacguccaucggccucauuugugucaucgccucuagcgggaugcuguggauggcggagauuccccugcaauggaucgccuccgcuauugugcucgaguucuuuaugaugguucuucugaucccugaacccgagaagcagcgcaccccgcaggacaaucaacuggccuauguggugaucggaauucucacacuggcugccaucauugcggccaacgaaaugggccuucuggagaccacaaagagagaucucggcaugagcaaagaaccuggggucguuucucccaccuccuaccuggacguggaucugcaccccgcuagcgccuggacgcucuaugcuguggccacaaccgucaucacaccuaugcuucggcauaccauugagaauucuaccgcuaacgugagccuggccgcgaucgccaaccaggcuguugugcugaugggacucgacaagggcuggccgaucuccaaaauggaccugggggucccccuucuggcccucggaugcuacucucaggugaauccucugacacugacggcugccguccuccuucugauuacccacuacgccaucauuggccccgggcugcaggcgaaggcuacaagagaggcccaaaaacgcaccgcugccggaaucaugaagaacccuacaguggauggcauuaugaccaucgaccucgaucccguuaucuaugacagcaaguucgaaaaacagcugggccaggugaugcuucugguccucugugugguucagcugcugcucaugcggacguccugggcccuuugcgaggcucugacacuggccaccgggccuauuaccacacucugggaaggaucuccgggcaaguuuuggaauaccacaaucgcggugagcauggccaacauuuucagaggguccuaccuggcuggagccggccuugcuuuuagcaucaugaaaucugucgggacgggaaagcgcggcaccggcucccaaggggagacacugggagaaaaauggaagaagaaacucaaucagcugagccggaaggauuucgaccuguauaaaaaguccggcauuaccgagguggauagaacagaggccaaagaagggcucaagcggggagagaucacccaucacgcggugucucgcggcagcgccaaacuucagugguuuguugaaagaaacauggucauucccgaggggcgggugaucgaccugggauguggccgcggcgggugguccuacuauugcgcuggacugaagaaggugacggaagucagaggcuacaccaaagggggaccuggccacgaggagcccguuccuaugucuacauauggguggaauaucgugaagcucaugagcggaaaagauguguucuaccugcccccggaaaagugugacacccuucugugcgauauuggcgaguccagcccuucucccacagucgaagagucccggaccauccgcgugcucaaaaugguugagcccuggcugaagaacaaucaguucuguauuaaggugcugaacccuuacaugcccacagucaucgaacaucucgagagacuucaacggaaacacggcgggaugcuggugcgcaauccucugagcagaaacucuacccaugaaauguauuggauuuccaauggaacgggcaacaucguugccagcgugaauauggucucucggcuccugcuuaacagauuuacaaugacccaccgccggccgaccaucgagaaggacguggaucugggggcuggaacaagacacgugaacgccgaacccgagacgccuaauauggacauuaucggcgagcgcauuaaacggaucaaggaagagcauaacagcaccuggcacuacgacgaugaaaaucccuauaaaacaugggcuuaccauggguccuaugaggucaaggccaccggaucugcgagcuccaugauuaacggcguugugaagcuccugacaaaaccuugggacgugguccccauggugacccagauggccaugacagauaccacgccguucggccagcaaagaguuuuuaaggaaaaaguggacacccgcacaccucggagcaugcccgggaccagacgcgucaugggaaucacagcugaguggcuguggcggacccucggcagaaauaagaaaccucgccugugcacgcgggaggaauucacaaagaaggugagaaccaacgccgcuaugggggccguuuuuacagaggaaaaucagugggauuccgccaaagcggcuguggaggacgaagauuucuggaagcuugucaaccgcgagagagagcugcacaaacucggaaaguguggcucuugcguguacaauaugauggggaaacgggaaaagaaacugggcgaguuuggaaaggccaagggcagccgcgccaucugguauauguggcuuggggcuagauaccuggaauucgaggcccucggauuucugaacgaggaccauugguucucccgggaaaauucuuacagcggcguugagggggaaggacugcacaaacucggcuauauucugagagauaucuccaagauucccgggggcgcuauguacgccgacgauaccgcgggaugggacacgcggaucaccgaggacgaucuucacaacgaagagaaaauuacacagcagauggacccugagcaucgccaacuggccaaugcuaucuuuaagcucaccuaucagaacaaaguggucaaggugcagagacccacaccgaccggcacagucauggauaucauuucucggaaggaccagcgcgggagcggacaagugggcaccuacgggcugaauacguucacaaacauggaagcccagcuuaucagacagauggagggagaaggcguucuguccaaagcugaucucgagaacccucaccugcccgaaaagaaaauuacccaguggcuggagaccaaggggguggagcggcucaaacgcauggccaucagcggcgacgauugcgucgugaagcccauugacgauagauuugcgaaugcccugcuugcucugaacgacaugggaaaggugcggaaagauaucccucaauggcagccgucuaagggcuggcaugacuggcagcagguucccuucuguucccaccacuuccaugaacucauuaugaaagaugggcgcaagcugguggucccuugcagaccccaagacgagcuuaucggacgggcccgcaucagccagggcgcuggguggucucugaaagaaacagccugucucggaaaggcuuaugcccagauguggucccugauguacuuucacagacgggaccugcgccucgcgagcaaugccauuugcucugcugugccuguucauugggugcccaccuccagaacaacguggagcauccacgcccaucaccaauggaugaccacagaggauaugcugaccgucuggaaccggguguggauugaagacaauccuuggauggaggauaagacacccgucaccacgugggagaacgugccguaucuuggcaaaagagaagaccaguggugugggucccugaucggccucaccagccgcgccacaugggcucagaauauuccuaccgccauccagcaaguucggucucugaucggaaacgaggaauuccuugauuacaugcccagcaugaagagauuucgcaaagaggaggaauccgagggcgcgauuugguga

SEQ ID NO: 20592 - RNA, 9873 nt, Artificial Sequence
  derived and/or modified CDS sequence (opt5) from DENV-3__JF937646__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggaauuggcaaccgggacuuuguggaagggcucagcggagcuaccugggucgauguggugcuggagcacggcgggugcgucaccacaauggccaagaauaaacccacgcuggacaucgagcuccagaagaccgaagcuacacaacuggccacccuucgcaaacuguguauugagggaaagaucacaaacauuaccacggauuccagaugcccuacacagggcgaagcgacccucccggaggaacaggaccagaauuauguuuguaaacacaccuacguggaucggggcugggggaacggaugcggccuguucgggaagggaagccuugugacaugcgccaaguuucaaugucuggagcccaucgagggcaaagucgugcaguaugaaaaucucaaguacaccguuaucauuacagugcauacgggggaccagcaccaggucggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguucauagacagugguuuuucgaucucccccugccguggaccagcggcgccacaaccgaaacgccuacauggaaucggaaagagcuucuggugaccuuuaagaacgcucacgcgaaaaagcaagaagucgugguccucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacgccuuugugcugaagaaagagguuuccgaaacccagcacgggacaauccucauuaagguggaguacaagggagaagauguccccuguaaaaucccuuucagcaccgaggacggccaagggaaggcgcauaacggaagacugauuacagcuaaucccgugguuaccaaaaaggaggaacccgugaacaucgaggccgaaccuccguucggcgaguccaauauugucaucgggaucggcgauaacgcccugaaaauuaauugguauaagaagggaucuagcaucggcaaaauguuugaagcuacggccagaggggcuagacgcauggccauucuuggagacacagcgugggauuucggcuccgucggcggggugcucaacagccuggggaagaugguucaccagaucuuugggucugccuacaccgcucuguucuccggcgucagcugggugaugaaaauuggaaucggcgugcuccugaccuggauugggcuuaauucuaagaacacaagcauguccuuuucuugcaucgccaucggaauuaucacccuguaucucggcgcugucgugcaggccgacaugggguguguuauuaauuggaaaggaaaggagcugaagugcggcagcgggaucuucgugacaaacgagguccauacguggaccgaacaguacaaauuucaagcggauucccccaagcggcuggccacagcuauugccggcgcuugggagaauggaguguguggcaucagaagcaccacacgcauggaaaaccuucucuggaaacagaucgccaaugagcugaacuauauucugugggaaaauaacaucaagcucaccguuguggucggggacauuaucggagugcuggagcagggcaaacggacgcuuaccccucagcccauggagcugaaguacucuuggaaaacaugggggaaggccaagauuguuaccgcugaaacacaaaacuccagcuucaucaucgauggaccuaauacccccgagugcccgucuguguccagagcguggaacgucugggaaguggaggacuauggcuuuggcguguucacaaccaauauuuggcucaaacugcgcgaagucuacacgcagcugugugaccaccggcuuaugagcgccgcuguuaaggaugagagagccgugcacgccgacaugggguacuggaucgagucccagaaaaacggaucuuggaagcucgaaaaagcuagccugauugaggugaagacaugcaccuggccuaagucccauacccuguggucuaauggcguccucgaaagcgauaugaucauucccaaaucccuggccgggccuaucagccagcacaaccaucgccccggauaucacacacaaaccgcgggcccuuggcaccuugggaagcuggagcucgacuuuaauuacugcgagggaacgacagugguuaucaccgaaaacuguggcacacggggccccucucugagaaccacaaccguguccgggaaacugauucaugaguggugcugucgcagcugcacgcuuccgccucuccgguauaugggagaagauggcuguugguacgggauggagaucagacccauuucugaaaaggaggagaauauggucaaaucccuggugagcgcuggaucuggcaagguugacaacuucaccaugggggugcugugccucgccauccuguuugaagaggucaugcggggaaaguucggcaaaaagcacaugauugccggcguguucuuuacauucguucuucugcucagcgggcagaucaccuggcgcgauauggcucauacacugauuaugaucggauccaaugccagcgacagaaugggcaugggggugaccuaucuggcgcuuaucgcuacguuuaaaauucagcccuuccuggcccucggauuuuuccugcggaagcucacaucuagagaaaaccugcuucugggcgucgggcucgccauggugaccacacugcaacugccugaggauaucgaacagauggcuaauggaauugcccuuggccugauggcucucaaacugaucacccaguuugagaccuaccagcucuggacagcccugauuucccuuacguguagcaacaccaucuucacacugaccguggcguggcgcacagccacccucauccuggcuggcgucucccugcuuccgguuugccaaucuagcuccaugcggaagacggacuggcugcccauggccguggcugccaugggggugccuccccucccucuguuuauuuucggacucaaggauacacugaaaagacgcucuuggccccuuaaugagggcgucauggccguggggcugguuagcauccuggcuuccucucuccugagaaacgacgugccuauggcgggaccccuugucgccggcgggcugcucauugcuuguuaugugaucaccggaaccagcgccgaucugacaguugaaaaggccgcugacauuaccugggaggaagaggccgaacagacaggcgugucccacaaccucaugaucacggucgacgaugacggcaccaugcggaucaaagaugacgagacagagaauauucugaccgugcuucugaagacagcgcugcucaucgucagcgggauuuuuccguacucuaucccugcuacccugcuuguguggcauacguggcagaaacagacccaacgcuccggaguucugugggaugugcccagcccucccgaaacacagaaggccgagcucgaagagggcgucuacagaauuaaacagcaggggaucuucggaaagacccaagugggcguuggggugcagaaggagggagucuuucacacaauguggcacgugacccggggcgccgugcugacauauaacggcaaacgccucgaaccgaauugggcuucuguuaagaaagaccugauuuccuacgggggaggcuggagacuuagcgcccaguggcaaaagggggaggaaguccaggugaucgcgguggagccuggcaagaaccccaagaauuuccagacgaugccuggcaccuuccagacaaccaccggggaaaucggagcuauugcccuggauuuuaagcccggcacaucuggcucccccaucauuaaccgggaggggaaagucgugggacuguauggcaaugggguugugacgaagaacggaggcuacgucagcgggaucgcccaaaccaaugcugagccugacggcccgacacccgaacucgaggaagagauguucaaaaagcgcaaccugaccauuauggaucuucauccuggauccggcaaaacaagaaaguaucugcccgccaucgugcgggaagcuaucaagcgcagacuccggacccugauucucgccccuacgagaguuguggcggccgagauggaggaagcucugaaagggcuucccauccgcuaccagacaaccgccaccaagagcgagcacacaggacgggaaauugucgaccugaugugccaugcuaccuuuacaaugagacugcucucuccugugcgcguuccgaauuauaaccugaucauuauggaugaggcccacuucaccgaccccgccagcaucgcugcgcggggcuacaucuccacgagaguggggaugggagaagccgcugccauuuuuaugacagccaccccucccggcacagcugaugccuucccucagucuaaugcgcccauccaggacgaggagcgcgacauuccggaacggagcuggaacuccgggaaugaguggaucaccgauuuugcuggcaaaacggucugguucgugccuucuauuaaggugggaaacgacaucgccaacugucuucgcaaaaauggcaagaaggucauucaacugagcagaaaaaccuuugauacagaauaccagaagaccaaacucaacgacugggauuucguugugacaaccgacaucuccgagaugggggccaauuuuaaggcugaucgggugaucgaccccagacggugccugaaacccgucauucugacagauggaccugagcgcgugauccucgccggccccaugccuguuaccgcggccucugcugcccagagacgggggcgcgugggaagaaacccgcagaaggaaaaugaccaauauauuuucacgggccagccccuuaacaaugaugaggaccaugcucacuggacagaagccaagaugcugcuggacaacaucaauaccccugaggggauuauccccgcucucuucgaaccugagcgggagaaaagcgccgcgaucgauggcgaauacagacugaagggagagucccgcaaaaccuuugucgaacuuaugcggagaggcgaccugcccguguggcucgcccacaagguugcuagcgaggggauuaaauauacagaucgcaaguggugcuucgacggacagcggaacaaucagauccuggaagagaacauggauguggagauuuggaccaaagaaggcgagaagaagaaacugagaccgcgcuggcucgacgcccggacauacucugauccucuugcucugaaggaauuuaaagaguucgccgccgggagaaaguccaucgcucuggaccucgucacggaaauuggacgcgugcccagccaucuggcgcacagaacccggaaugcccuugauaaccuggucaugcuccauacaucugagcacggcggccgcgcuuauagacacgccguggaggaacugccugagaccauggaaacacugcuccuucuggggcugaugauccuccugaccggaggcgccaugcuuuuucugaucuccgggaaaggaauuggcaagacgagcaucgggcucauuuguguuaucgcuuccucuggaaugcuguggauggccgagauuccccugcaauggaucgcgagcgccauugugcucgaguucuuuaugauggugcuucugaucccugaacccgagaagcagcggaccccgcaggacaaucaacuggcuuacgucguuaucggcauucucacacuggccgcuaucauugccgcgaacgaaaugggccuucuggagaccacaaaacgcgaucucgggauguccaaggaaccuggaguggugagccccaccucuuaucuggacgucgaucugcaucccgccuccgcuuggacgcucuacgccguggcuacaaccguuaucacaccuaugcuuagacacaccauugagaauagcaccgccaacgugucucuggcugccaucgcgaaccaggccgucgugcugaugggccucgacaaaggguggccgaucagcaagauggaccugggagucccccuucuggcucucggcugcuacucccaggugaauccucugacacugacggccgcuguucuccuucugauuacccauuaugccaucauugggcccggacugcaggccaaagcgacacgggaggcucaaaagagaaccgccgcuggcaucaugaagaacccuacaguggauggcauuaugaccaucgaccucgaucccgucaucuacgacucuaaauucgaaaagcagcugggacaggugaugcuucugguucucugugccgugcagcugcugcucaugcgcacgagcugggcccuuugcgaggcucugacacuggccaccggaccuauuaccacacucugggaaggcuccccggggaaauuuuggaauaccacaaucgcggucucuauggccaacauuuuccggggaagcuaucuggcuggcgccgggcuugcuuuuuccaucaugaaaagcgugggaacgggcaaaagaggcaccgggucucaaggagagacacugggcgaaaaguggaagaaaaagcucaaucagcugucccgcaaagauuucgaccuguacaagaaaagcgggauuaccgagguggaucggacagaggccaaggaaggacucaaaagaggcgagaucacccaccaugcgguuucccgggggucugccaaacuucagugguuugucgaacgcaacauggugauucccgagggaagagugaucgaccugggcuguggcagagggggauggagcuauuacugcgcuggccugaagaaagucacggaaguucgcggguauaccaagggaggcccugggcacgaggagcccgugccuauguccacauacggauggaauaucgugaaacucaugucuggcaaggaugucuucuaccugcccccggaaaaaugugacacccuucugugcgauauuggcgagagcuccccuagccccacaguggaagagucuagaaccauccggguucucaagaugguggagcccuggcugaagaacaaucaguucuguauuaaaguccugaacccuuauaugcccacagugaucgaacaccucgagcgccuucaaagaaagcaugggggaaugcugguucggaauccucugucccgcaacagcacccacgaaauguacuggauuucuaauggcacggggaacaucguggccuccgucaauauggugagcagacuccugcuuaaccgguuuacaaugacccauagacgcccgaccaucgagaaagacguggaucugggagcuggcacacggcacgucaacgccgaacccgagacgccuaauauggacguuauuggggagagaaucaagcgcauuaaagaagaacacaacucuaccuggcauuaugacgaugaaaaucccuacaagacaugggcuuaucacggaagcuacgaggugaaggccaccggcuccgcgucuagcaugaucaacggcguggucaaacuccugacaaagccuugggacgugguucccauggugacccagauggccaugacagauaccacgccguucgggcagcaacgggucuuuaaagaaaagguggacaccagaacaccucgcuccaugcccggaacccggagaguuaugggcauuacagcugaguggcuguggcgcacccucgggcggaauaaaaagccuagacugugcacgcgcgaggaguucacaaagaaagugcggaccaacgccgcuaugggagccgucuuuacagaggaaaaucagugggauagcgccaaggcggcuguggaggacgaagauuucuggaaacuuguugacagagagcgcgagcugcauaagcucggcaaauguggguccugcguguauaacaugaugggcaagagagagaagaagcugggagaguuuggcaaggccaaagggucucgggccaucugguacauguggcuuggagcucgcuaccuggaguucgaggcccucggcuuucugaaugaggaucacugguucagcagagaaaacuccuauucuggggucgagggagaaggccugcauaagcucggguacauccugcgggacauuagcaaaauccccggcggagcuauguaugccgaugacaccgcgggcugggacacgagaauuaccgaggaugaccuucacaaugaagagaagaucacacagcagauggauccugagcaccggcaacuggccaacgcuauuuuuaaacucaccuaccagaauaagguggucaaggugcagcgccccacaccgaccgggacaguuauggacaucaucuccagaaaagaucagcggggaucuggccaaguggggaccuauggacugaacacguucacaaauauggaagcccagcuuauucgccagauggagggcgaagggguccugagcaaggcugaccucgagaacccucaucugcccgagaaaaagaucacccaguggcuggagaccaaaggcguggagagacucaagcggauggccauuuccggagaugacugcgugguuaagcccaucgaugaccgcuuugcgaacgcccugcuugcucugaaugauaugggcaaagugagaaaggacauuccucaauggcagccgagcaaaggguggcacgauuggcagcagguccccuucuguucucaucacuuccacgaacucaucaugaaggacggacggaaacuggugguuccuugccgcccccaagacgagcuuauuggcagagcccggaucucccagggggcuggauggagccugaaggaaacagccugucucggcaaggcuuacgcccagauguggucucugauguauuuucaucgcagagaucugcggcucgcguccaacgccaucugcagcgcugugccuguccacugggugcccaccucucgcacaacgugguccauucaugcccaccaucaauggaugaccacagaggacaugcugaccgucuggaauagaguguggaucgaagauaacccuuggauggaggacaaaacacccguuaccacgugggagaaugugccguaccuugggaagcgggaagaucagugguguggcagccugauuggacucaccuccagagccacaugggcucagaacaucccuaccgccauucagcaaguccgcagccugaucggcaaugaggaguuccuugacuacaugcccucuaugaaacgguuuagaaaggaggaggaaagcgagggggcgaucugguga

SEQ ID NO: 20593 - RNA, 9873 nt, Artificial Sequence
  derived and/or modified CDS sequence (opt5) from DENV-3__JF937633__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaaaaggccgcugacaucacaugggaggaagaggccgaacagacgggcgugucccacaaccucaugauuaccgucgacgaugacggcacaaugcggaucaaagaugacgagaccgagaauauccugacagugcuucugaagaccgcgcugcucauugucagcgggaucuuuccguacucuauuccugcuacgcugcuuguguggcauaccuggcagaaacagacacaacgcuccggaguucugugggaugugcccagcccucccgaaacccagaaggccgagcucgaagagggcgucuacagaaucaaacagcaggggauuuucggaaagacacaagugggcguuggggugcagaaggagggagucuuucacaccauguggcacgugacacggggcgccgugcugacguauaacggcaaacgccucgaaccgaauugggcuucuguuaagaaagaccugaucuccuacgggggaggcuggagacuuagcgcccaguggcaaaagggggaggaaguccaggugauugcgguggagccuggcaagaaccccaagaauuuccagaccaugccuggcacauuccagaccaccacaggggaaaucggagcuaucgcccuggauuuuaagcccggcacgucuggcucccccauuaucaaccgggaggggaaagucgugggacuguauggcaaugggguugugaccaagaacggaggcuacgucagcgggauugcccaaacaaaugcugagccugacggcccgacccccgaacucgaggaagagauguucaaaaagcgcaaccugacaaucauggaucuucauccuggauccggcaaaaccagaaaguaucugcccgccauugugcgggaagcuaucaagcgcagacuccggacgcugauccucgccccuacaagaguuguggcggccgagauggaggaagcucugaaagggcuucccauucgcuaccagaccaccgccacaaagagcgagcacaccggacgggaaaucgucgaccugaugugccaugcuacauuuaccaugagacugcucucuccugugcgcguuccgaauuauaaccugauuaucauggaugaggcccacuucacggaccccgccagcauugcugcgcggggcuacaucuccacaagaguggggaugggagaagccgcugccaucuuuaugaccgccacaccucccggcaccgcugaugccuucccucagucuaaugcgcccauucaggacgaggagcgcgacaucccggaacggagcuggaacuccgggaaugaguggauuacggauuuugcuggcaaaaccgucugguucgugccuucuaucaaggccggaaacgacauugccaacugucuucgcaaaaauggcaagaaggugauccaacugagcagaaaaacauuugauaccgaauaccagaagacaaaacucaacgacugggauuucgucguuaccacagacauuuccgagaugggggcuaauuuuaaggccgaucgggugaucgaccccagacggugccugaaacccgugauccugaccgauggaccugagcgcgucauucucgcgggccccaugccugugacggccgcuucugccgcucagagacgggggcgcguuggaagaaacccgcagaaggaaaaugaccaauauaucuucacaggccagccccuuaacaaugaugaggaccaugcccacuggaccgaagcuaagaugcugcuggacaacauuaauaccccugaggggaucauucccgcccucuucgaaccugagcgggagaaaagcgcggccaucgauggcgaauacagacugaagggagagucccgcaaaacauuuguggaacuuaugcggagaggcgaccugcccgucuggcucgcucacaagguggccagcgaggggaucaaauauaccgaucgcaaguggugcuucgacggacagcggaacaaucagauucuggaagagaacauggauguugagaucuggacaaaagaaggcgagaagaagaaacugagaccgcgcuggcucgacgcucggacguacucugauccucuugcccugaaggaauuuaaagaguucgccgcugggagaaaguccauuacccuggaccucgugacagaaaucggacgcguccccagccaucuggcgcacagaacccggaaugcccuugauaaccuggugaugcuccauacaucugagcacggcggccgcgcuuauagacacgccgucgaggaacugccugagaccauggaaacgcugcuccuucuggggcugaugauucuccugaccggaggcgccaugcuuuuucugaucuccgggaaaggaaucggcaagacaagcauugggcucaucugugugauugcuuccucuggaaugcuguggauggccgagaucccccugcaauggauugcgagcgccaucguucucgaguucuuuaugauggugcuucugauuccugaacccgagaagcagcggaccccgcaggacaaucaacuggcuuacguggucaucggcauccucacacuggccgcuauuaucgccgcgaacgaaaugggccuucuggagaccacgaaacgcgaucucgggauguccaaggaaccuggaguugugagccccacaucuuaucuggacguggaucugcaucccgccuccgcuuggacccucuacgccgucgcuacaaccgugauuaccccuaugcuuagacacacaaucgagaauagcacggccaacguuucucuggcugccauugcgaaccaggccgugguccugaugggccucgacaaaggguggccgaucagcaagauggaccugggagugccccuucuggcucucggcugcuacucccaggucaauccucugacccugacagccgcugugcuccuucugaucacccauuaugccauuaucgggcccggacugcaggccaaagcgacacgggaggcucaaaagagaaccgccgcuggcauuaugaagaacccuacgguugauggcaucaugacaauugaccucgaucccgugaucuacgacucuaaauucgaaaagcagcuggggcaggucaugcuucuggugcucugugccguucagcugcugcucaugcgcaccagcugggcccuuugcgaggcucugacccuggccacaggaccuaucaccacacucugggaaggcuccccggggaaauuuuggaauacgaccauugcggugucuauggccaacaucuuccggggaagcuaucuggcuggcgccgggcuugcuuuuuccauuaugaaaagcgucggaacaggcaaaagaggcaccgggucucaaggagagacacugggcgaaaaguggaagaaaaagcucaaucagcugucccgcaaagauuucgaccuguacaagaaaagcgggaucaccgagguggaucggacggaggccaaggaaggacucaaaagaggcgagauuacccaccaugcggugucccgggggucugccaaacuucagugguuuguugaacgcaacauggucauccccgagggaagagugauugaccugggcuguggcagagggggauggagcuauuacugcgcuggccugaagaaagugacagaaguccgcggguauaccaagggaggcccugggcacgaggagcccguuccuauguccacauacggauggaauaucgugaaacucaugucuggcaaggauguguucuaccugcccccggaaaaaugugacacccuucugugcgauaucggcgagagcuccccuagccccacagucgaagagucuagaaccauucgggugcucaagaugguugagcccuggcugaagaacaaucaguucuguaucaaagugcugaacccuuauaugcccacggucauugaacaccucgagcgccuucaaagaaagcaugggggaaugcuggugcggaauccucugucccgcaacagcacacacgaaauguacuggaucucuaauggcaccgggaacauuguugccuccgugaauauggucagcagacuccugcuuaaccgguuuaccaugacacauagacgcccgacgaucgagaaagacguggaucugggagcuggcacccggcacgugaacgccgaacccgagacaccuaauauggacgucaucggggagagaauuaagcgcaucaaagaagaacacaacucuaccuggcauuaugacgaugaaaaucccuacaagacaugggcuuaucacggaagcuacgagguuaaggccaccggcuccgcgucuagcaugauuaacggcguggugaaacuccugacaaagccuugggacgucgugcccaugguuacccagauggccaugacggauaccacaccguucgggcagcaacggguguuuaaagaaaaggucgacaccagaacaccucgcuccaugcccggaacccggagagugaugggcaucacggcugaguggcuguggcgcacacucgggcggaauaaaaagccuagacugugcacccgcgaggaguucacaaagaaaguucggaccaacgccgcuaugggagccguguuuacggaggaaaaucagugggauagcgccaaggcggcugucgaggacgaagauuucuggaaacuuguggacagagagcgcgagcugcauaagcucggcaaauguggguccugcguuuauaacaugaugggcaagagagagaagaagcugggagaguuuggcaaggccaaagggucucgggccauuugguacauguggcuuggagcucgcuaccuggaguucgaggcccucggcuuucugaaugaggaucacugguucagcagagaaaacuccuauucugggguggagggagaaggccugcauaagcucggguacauccugcgggacaucagcaaaauucccggcggagcuauguaugccgaugacaccgcgggcugggacacaagaaucaccgaggaugaccuucacaaugaagagaagauuacacagcagauggauccugagcaccggcaacuggccaacgcuaucuuuaaacucaccuaccagaauaaggucgugaagguccagcgccccacaccgaccgggacggugauggacauuaucuccagaaaagaucagcggggaucuggccaaguugggacauauggacugaacaccuucaccaauauggaagcccagcuuauccgccagauggagggcgaaggggugcugagcaaggcugaccucgagaacccucaucugcccgagaaaaagauuacacaguggcuggagaccaaaggcgucgagagacucaagcggauggccaucuccggagaugacugcguggugaagcccauugaugaccgcuuugcgaacgcccugcuugcucugaaugauaugggcaaaguuagaaaggacaucccucaauggcagccgagcaaaggguggcacgauuggcaacaggugcccuucuguucucaucacuuccacgaacucauuaugaaggacggacggaaacuggucgugccuugccgcccccaagacgagcuuaucggcagagcccggauuucccagggggcuggauggagccugaaggaaacagccugucucggcaaggcuuacgcccagauguggucucugauguauuuucaucgcagagaucugcggcucgcguccaacgccaucugcagcgcuguuccugugcacuggguccccacgucucgcaccacaugguccauccaugcccaccaucaauggaugaccacagaggacaugcugaccguguggaauagagucuggauugaagauaacccuuggauggaggacaaaacgcccgugaccacaugggagaauguuccguaccuugggaagcgggaagaucagugguguggcagccugaucggacucaccuccagagccacaugggcucagaacauuccuaccgccauccagcaagugcgcagccugauuggcaaugaggaguuccuugacuacaugcccucuaugaaacgguuuagaaaggaggaggaaagcgagggggcgaucugguga

SEQ ID NO: 20594 - RNA, 9873 nt, Artificial Sequence
  derived and/or modified CDS sequence (opt5) from DENV-3__JF937634__SS-prME
accagccugugccucaugaugauccugcccgccgcucuugccuuccaccugacaucccgggacggagagccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucauguggggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucggcgggguucucaacagccuggggaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgugaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggcuaagaucgucacagccgaaacccaaaacuccagcuucauuaucgauggaccuaauacacccgagugcccgucuguguccagagccuggaacgugugggaagucgaggacuauggcuuuggcguuuucaccacgaauaucuggcucaaacugcgcgaaguguacacacagcugugugaccaccggcuuaugagcgcugcggugaaggaugagagagccguccacgcugacaugggguacuggauugagucccagaaaaacggaucuuggaagcucgaaaaagccagccugaucgaggugaagaccugcaccuggccuaagucccauacacuguggucuaauggcguucucgaaagcgauaugauuauccccaaaucccuggccgggccuauuagccagcacaaccaucgccccggauaucacacccaaacggcuggcccuuggcaccuugggaagcuggagcucgacuuuaauuacugcgagggaacaaccguggucaucacagaaaacuguggcacccggggccccucucugagaacaaccacgguguccgggaaacugauccaugaguggugcugucgcagcugcacccuuccgccucuccgguauaugggagaagauggcuguugguacgggauggagauuagacccaucucugaaaaggaggagaauaugguuaaaucccuggugagcgccggaucuggcaaggucgacaacuucacaaugggggugcugugccucgcgauucuguuugaagagguuaugcggggaaaguucggcaaaaagcacaugaucgcuggcguguucuuuaccuucguccuucugcucagcgggcagauuacauggcgcgauauggcccauacccugaucaugauuggauccaaugccagcgacagaaugggcaugggggugacguaucuggcucuuaucgccacauuuaaaauccagcccuuccuggcgcucggauuuuuccugcggaagcucaccucuagagaaaaccugcuucugggcguggggcucgcuauggccacaacccugcaacugccugaggauauugaacagauggccaauggaaucgcucuuggccugauggcccucaaacugauuacccaguuugagacauaccagcucuggacggcucugaucucccuuaccuguagcaacacaauuuucacccugacagucgccuggcgcaccgcgacgcucauccuggccggcguuucccugcuuccggugugccaaucuagcuccaugcggaagacagacuggcugcccauggcuguggccgcuaugggggucccuccccucccucuguuuaucuucggacucaaggauacccugaaaagacgcucuuggccccuuaaugagggcgugauggccguugggcuggugagcauucuggccuccucucuccugagaaacgacgucccuauggcuggaccccuuguggcgggcgggcugcucaucgccuguuauguuauuaccggaacaagcgcugaucugaccguggaaaaggccgccgacaucacaugggaggaagaggcugaacagacgggcgucucccacaaccucaugauuaccguggacgaugacggcacaaugcggaucaaagaugacgagaccgagaauauccugacaguccuucugaagaccgcccugcucauugugagcgggaucuuuccguacucuauuccugcgacgcugcuuguuuggcauaccuggcagaaacagacacaacgcuccggagugcugugggauguccccagcccucccgaaacccagaaggcugagcucgaagagggcguguacagaaucaaacagcaggggauuuucggaaagacacaaguuggcguggggguccagaaggagggaguguuucacaccauguggcacgugacacggggcgccguucugacguauaacggcaaacgccucgaaccgaauugggccucugucaagaaagaccugaucuccuacgggggaggcuggagacuuagcgcucaguggcaaaagggggaggaaguccaggugauugccgucgagccuggcaagaaccccaagaauuuccagaccaugccuggcacauuccagaccaccacaggggaaaucggagcgaucgcucuggauuuuaagcccggcacgucuggcucccccauuaucaaccgggaggggaaagugguuggacuguauggcaaugggguggucaccaagaacggaggcuacgugagcgggauugcccaaacaaaugccgagccugacggcccgacccccgaacucgaggaagagauguucaaaaagcgcaaccugacaaucauggaucuucauccuggauccggcaaaaccagaaaguaucugcccgcuauuguucgggaagccaucaagcgcagacuccggacgcugauccucgcuccuacaagaguggucgccgcggagauggaggaagcccugaaagggcuucccauucgcuaccagaccaccgcuacaaagagcgagcacaccggacgggaaaucguggaccugaugugccaugccacauuuaccaugagacugcucucuccuguucgcgugccgaauuauaaccugauuaucauggaugaggcucacuucacggaccccgccagcauugccgcucggggcuacaucuccacaagagucgggaugggagaagcggccgcuaucuuuaugaccgccacaccucccggcaccgccgaugcuuucccucagucuaaugcccccauucaggacgaggagcgcgacaucccggaacggagcuggaacuccgggaaugaguggauuacggauuuugcgggcaaaaccgugugguucgugccuucuaucaaggcuggaaacgacauugccaacugucuucgcaaaaauggcaagaaggucauccaacugagcagaaaaacauuugauaccgaauaccagaagacaaaacucaacgacugggauuucguugugaccacagacauuuccgagaugggggccaauuuuaaggcugaucgggugaucgaccccagacggugccugaaacccgucauccugaccgauggaccugagcgcgugauucucgccggccccaugccuguuacggcggccucugcugcccagagacgggggcgcgugggaagaaacccgcagaaggaaaaugaccaauauaucuucacaggccagccccuuaacaaugaugaggaccaugcucacuggaccgaagccaagaugcugcuggacaacauuaauaccccugaggggaucauucccgcucucuucgaaccugagcgggagaaaagcgccgcgaucgauggcgaauacagacugaagggagagucccgcaaaacauuugucgaacuuaugcggagaggcgaccugcccguguggcucgcccacaagguugcuagcgaggggaucaaauauaccgaucgcaaguggugcuucgacggacagcggaacaaucagauucuggaagagaacauggauguggagaucuggacaaaagaaggcgagaagaagaaacugagaccgcgcuggcucgacgcccggacguacucugauccucuugcucugaaggaauuuaaagaguucgccgccgggagaaaguccauugcucuggaccucgucaccgaaaucggacgcgugcccagccaucuggcgcacagaacacggaaugcccuugauaaccuggucaugcuccauaccucugagcacggcggccgcgcuuauagacacgccguggaggaacugccugagacaauggaaacccugcuccuucuggggcugaugauucuccugacgggaggcgccaugcuuuuucugaucuccgggaaaggaaucggcaagaccagcauugggcucaucuguguuauugcuuccucuggaaugcuguggauggccgagaucccccugcaauggauugcgagcgccaucgugcucgaguucuuuaugauggugcuucugauuccugaacccgagaagcagcggacaccgcaggacaaucaacuggcuuacgucguuaucggcauccucacccuggccgcuauuaucgccgcgaacgaaaugggccuucuggagacaaccaaacgcgaucucgggauguccaaggaaccuggaguggugagccccacgucuuaucuggacgucgaucugcaucccgccuccgcuuggacacucuacgccguggcuaccacaguuauuaccccuaugcuuagacacaccaucgagaauagcacagccaacgugucucuggcugccauugcgaaccaggccgucgugcugaugggccucgacaaaggguggccgaucagcaagauggaccugggagucccccuucuggcucucggcugcuacucccaggugaauccucugacgcugaccgccgcuguucuccuucugaucacacauuaugccauuaucgggcccggacugcaggccaaagcgacccgggaggcucaaaagagaacagccgcuggcauuaugaagaacccuaccguggauggcaucaugacgauugaccucgaucccgucaucuacgacucuaaauucgaaaagcagcugggacaggugaugcuucugguucucugugccgugcagcugcugcucaugcgcacaagcugggcccuuugcgaggcucugacccuggccaccggaccuaucacaacccucugggaaggcuccccggggaaauuuuggaauacaacgauugcggucucuauggccaacaucuuccggggaagcuaucuggcuggcgccgggcuugcuuuuuccauuaugaaaagcgugggaaccggcaaaagaggcacagggucucaaggagagacccugggcgaaaaguggaagaaaaagcucaaucagcugucccgcaaagauuucgaccuguacaagaaaagcgggaucacagagguggaucggaccgaggccaaggaaggacucaaaagaggcgagauuacgcaccaugcgguuucccgggggucugccaaacuucagugguuugucgaacgcaacauggugauccccgagggaagagugauugaccugggcuguggcagagggggauggagcuauuacugcgcuggccugaagaaagucaccgaaguucgcggguauacaaagggaggcccugggcacgaggagcccgugccuauguccaccuacggauggaauaucgugaaacucaugucuggcaaggaugucuucuaccugcccccggaaaaaugugacacacuucugugcgauaucggcgagagcuccccuagccccaccguggaagagucuagaacaauucggguucucaagaugguggagcccuggcugaagaacaaucaguucuguaucaaaguccugaacccuuauaugcccaccgugauugaacaccucgagcgccuucaaagaaagcaugggggaaugcugguucggaauccucugucccgcaacagcacgcacgaaauguacuggaucucuaauggcacagggaacauuguggccuccgucaauauggugagcagacuccugcuuaaccgguuuaccaugacccauagacgcccgacaaucgagaaagacguggaucugggagcuggcacgcggcacgucaacgccgaacccgagaccccuaauauggagguuaucggggaaagaauuaagcgcaucaaagaggaacacaacucuacauggcauuaugacgacgagaaucccuacaagaccugggcuuaucacggaagcuacgaagugaaggccacaggcuccgcgucuagcaugauuaacggcguggucaaacuccugaccaagccuugggaugugguucccauggugacacagauggccaugaccgacacgaccccguucgggcagcaacgggucuuuaaagagaagguggauacaagaaccccucgcuccaugcccggaacacggagaguuaugggcaucaccgcugaguggcuguggcgcacgcucgggcggaauaaaaagccuagacugugcacacgcgaagaguucaccaagaaagugcggacaaacgccgcuaugggagccgucuuuaccgaagagaaucagugggacagcgccaaggcggcuguggaagaugaggacuucuggaaacuuguugauagagagcgcgaacugcauaagcucggcaaauguggguccugcguguauaacaugaugggcaagagagagaaaaagcugggagaauuuggcaaggccaaagggucucgggccauuugguacauguggcuuggagcucgcuaccuggaguucgaggcccucggcuuucugaaugaagaccacugguucagcagagagaacuccuauucuggggucgaaggagagggccugcauaagcucggguacauccugcgggauaucagcaaaauucccggcggagcuauguaugccgacgauacggcgggcugggacaccagaaucacagaagacgaucuucacaaugaggagaagauuacccagcagauggacccugaacaccggcaacuggccgaugcuaucuuuaaacucacauaccagaacaagguggucaaggugcagcgccccaccccgacagggaccguuauggacauuaucuccagaaaagaucagcggggaucuggccaaguggggacguauggacugaauacauucaccaacauggaggcccagcuuauccgccagauggaaggcgaggggguccugagcaaggcugaccucgaaaauccucaucugcccgagaaaaagauuacccaguggcuggagacaaaaggcguggaaagacucaagcggauggccaucuccggagaugacugcgugguuaagcccauugaugaccgcuuugcgaacgcccugcuugcucugaacgauaugggcaaagugagaaaggacaucccucaauggcagccgagcaaaggguggcacgauuggcagcagguccccuucuguucucaucacuuccacgagcucauuaugaaggacggacggaaacuggugguuccuugccgcccccaagacgaacuuaucggcagagcccggauuucccagggggcuggauggagccugaaggagaccgccugucucggcaaggcuuacgcccagauguggucucugauguauuuucaucgcagagaucugcggcucgcguccaaugccaucugcagcgcugugccuguccacugggugcccacaucucgcacgaccugguccauccaugcccaccaucaauggaugacaaccgaagacaugcugacagucuggaacagaguguggauugaggauaauccuuggauggaggacaaaacccccguuacgaccugggaaaacgugccguaccuugggaagcgggaggaucagugguguggcagccugaucggacucacauccagagccaccugggcucagaauauuccuacagccauccagcaaguccgcagccugauuggcaacgaagaguuccuugacuacaugcccucuaugaaacgguuuagaaaggaggaagagagcgaaggggcgaucugguga

SEQ ID NO: 20595 - RNA, 9873 nt, Artificial Sequence
  derived and/or modified CDS sequence (opt5) from DENV-3__JF937636__SS-prME
accagccugugccucaugaugauccugcccgccgcucuugccuuccaccugacgucccgggacggagaaccucggaugauuguggggaagaacgaacgcggaaagucucuccuguuuaagacggcgagcggcaucaauauguguacccuuauugcuauggaucugggggaaaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggauucugugccucgcuauccuguuugaagaggucaugcggggaaaguucggcaaaaagcacaugauugccggcguguucuuuaccuucguucuucugcucagcgggcagaucacauggcgcgauauggcccauacccugauuaugaucggauccaaugcuagcgacagaaugggcaugggggugacguaucuggcccuuaucgcgacauuuaaaauucagcccuuccuggcucucggauuuuuccugcggaagcucaccucuagagaaaaccugcuucugggcgucgggcucgccauggccacaacccugcaacugccugaggauaucgaacagauggcuaauggaauugcccuuggccugauggcucucaaacugaucacccaguuugagacauaccagcucuggacggcccugauuucccuuaccuguagcaacacaaucuucacccugacaguggcguggcgcaccgccacgcucauccuggcuggcgugucccugcuuccggucugccaaucuagcuccaugcggaagacagacuggcugcccauggccguugcugccaugggggugccuccccucccucuguuuauuuucucucucaaggauacccugaaaagacgcagcuggccccuuaaugagggagugauggccgucggccugguguccauccuggcuucuagccuccugagaaacgacguuccuauggcggggccccuuguggccggaggccugcucauugcuuguuaugucaucaccgggacauccgccgaucugaccguggaaaaggccgcugacauuacaugggaggaagaggccgaacagacgggaguuagccacaaccucaugaucaccguggacgaugacggcacaaugcggaucaaagaugacgagaccgagaauauucugacaguccuucugaagaccgcgcugcucaucgugucuggcauuuuuccguacuccaucccugcuacgcugcuugucuggcauaccuggcagaaacagacacaacgcagcggggugcugugggauguucccucuccucccgaaacccagaaggccgagcucgaagagggaguguacagaauuaaacagcagggcaucuucgggaagacacaagucggagugggcguucagaaggaggggguguuucacaccauguggcacgucacacggggagccgugcugacguauaacggcaaacgccucgaaccgaauugggcuuccgugaagaaagaccugauuagcuacggcgggggauggagacuuucugcccaguggcaaaagggcgaggaaguucaggucaucgcgguggagccugggaaaaaccccaagaauuuccagaccaugccuggaacauuccagaccaccacaggcgaaaucggggcuauugcccuggauuuuaagcccggaacguccggcagccccaucauuaaccgggagggcaaaguggucgggcuguauggaaauggcgugguuaccaagaacgggggauacguguccggcaucgcccaaacaaaugcugagccugacgggccgacccccgaacucgaggaagagauguucaaaaagcgcaaccugacaauuauggaucuucauccuggcagcggaaaaaccagaaaguaucugcccgccaucguccgggaagcuauccgcagacggcucagaacgcugauucucgccccuacacgcgugguugcggccgagauggaggaagcucugaagggccuucccauccgguaccagaccaccgccacaaaaucugagcacaccgggagagaaauuguggaccugaugugccaugcuacauuuaccaugcgccugcucagcccuguccgggugccgaauuauaaccugaucauuauggaugaggcccacuucacggaccccgccuccaucgcugcgagaggauacaucucuacacgcguuggcaugggggaagccgcugccauuuuuaugaccgccacaccucccggaaccgcugaugccuucccucagagcaaugcgcccauccaggacgaggagcgggacauuccggaaagauccuggaacucuggcaaugaguggaucacggauuuugcugggaagaccgugugguucgucccuagcauuaaagccggcaacgacaucgccaacugucuucgcaagaauggcaaaaaggugauucaacugucccggaagacauuugauaccgaauaccagaaaacaaagcucaacgacugggauuucguggucaccacagacaucucugagaugggagcuaauuuuaaagccgauagaguuaucgacccccggcgcugccugaagcccgugauucugaccgaugggccugagagagugauccucgcgggacccaugccugucacggccgcuagcgccgcucagcggcgcggcagaguggggcggaacccgcagaaagaaaaugaccaauauauuuucacaggacagccccuuaacaaugaugaggaccaugcccacuggaccgaagcuaagaugcugcuggacaacaucaauaccccugagggcauuauccccgcccucuucgaaccugagagagagaaguccgcggccaucgauggggaauaccgccugaaaggcgagagccggaagacauuuguugaacuuaugagacgcggagaccugcccguguggcucgcucacaaagucgccucugagggcauuaaguauaccgaucggaaauggugcuucgacgggcagagaaacaaucagauccuggaagagaacauggauguggagauuuggacaaaggaaggagagaaaaagaagcugcgcccgcgguggcucgacgcuagaacguacuccgauccucuugcccugaaagaauuuaaggaguucgccgcuggccgcaaaagcaucgcgcuggaccucguuaccgaaauugggagagugcccucucaucuggcccaccggacacgcaaugcucuugauaaccuggucaugcuccauaccuccgagcacggaggcagagccuaucggcacgccguggaggaacugccugagacaauggaaacccugcuccuucugggccugaugauccuccugacagggggagcuaugcuuuuucugaucagcggcaaggggauuggaaaaaccuccaucggccucauuugugucaucgccucuagcgggaugcuguggauggcggagauuccccugcaauggaucgccuccgcuauugugcucgaguucuuuaugaugguucuucugaucccugaacccgagaagcagcgcacaccgcaggacaaucaacuggccuacguggugaucggcauucucacccuggcugccaucauugcggccaacgaaaugggccuucuggagacaaccaagagagaucucggcaugagcaaagaaccuggggucguuucucccacguccuaucuggacguggaucugcaucccgcuagcgccuggacacucuacgcuguggccaccacagucaucaccccuaugcuucggcacaccauugaaaauucuacagcuaacgugagccuggccgcgaucgccaaccaggcuguugugcugaugggacucgacaagggcuggccgaucuccaaaauggaccugggggucccccuucuggcccucggaugcuacucucaggugaauccucugacgcugaccgcugccguccuccuucugauuacacauuaugccaucauuggccccgggcugcaggcgaaggcuaccagagaggcccaaaaacgcacagcugccggaaucaugaagaacccuaccguggauggcauuaugacgaucgaccucgaucccguuaucuacgacagcaaguucgaaaaacagcugggccaggugaugcuucugguccucugugccgugcagcugcugcucaugcggacauccugggcucuuugcgaggcccugacccuggcgaccgggccuauuacaacccucugggaaggaucuccgggcaaguuuuggaauacaacgaucgccguuagcauggcuaacauuuucagaggguccuaucuggccggagcuggccuugccuuuagcaucaugaaaucuguggggaccggaaagcgcggcacaggcucccaaggggagacccugggagaaaaauggaagaagaaacucaaucagcugagccggaaggauuucgaccuguacaaaaaguccggcauuacagaggucgauagaaccgaggcgaaagaagggcucaagcggggagagaucacgcaccaugccgugucucgcggcagcgcuaaacuucagugguuuguggaaagaaacaugguuauucccgaggggcgggucaucgaccugggauguggccgcggcgggugguccuauuacugcgccggacugaagaaggugaccgaagugagaggcuauacaaaagggggaccuggccacgaggagcccgucccuaugucuaccuacggguggaauaucguuaagcucaugagcggaaaagauguguucuaccugcccccggaaaagugugacacacuucugugcgauauuggcgaguccagcccuucucccaccguggaagagucccggacaauccgcguccucaaaaugguggagcccuggcugaagaacaaucaguucuguauuaagguucugaacccuuauaugcccaccgugaucgaacaccucgagagacuucaacggaaacauggcgggaugcugguccgcaauccucugagcagaaacucuacgcacgaaauguacuggauuuccaauggaacaggcaacaucguggcuagcguuaauauggugucucggcuccugcuuaacagauuuaccaugacccaucgccggccgacaaucgagaaggacgucgaucugggggccggaacgagacacgugaacgcugaacccgagaccccuaauauggacgugauuggcgagcgcaucaaacggauuaaggaggaacacaacagcacauggcauuaugacgaugaaaaucccuacaaaaccugggccuaucacggguccuacgaggucaaggcgacaggaucugccagcuccaugaucaacggcguugugaagcuccugaccaaaccuugggacgugguccccauggugacacagauggcuaugaccgauacgaccccguucggccagcaaagaguuuuuaaggaaaaaguggacacacgcaccccucggagcaugcccgggacaagacgcgucaugggaauuaccgccgaguggcuguggcggacgcucggcagaaauaagaaaccucgccugugcacacgggaggaguucaccaagaaggugagaacaaacgcugccaugggggccguuuuuaccgaggaaaaucagugggauuccgcgaaagcugccguggaggacgaagauuucuggaaacuugucgaccgcgagagagagcugcauaaacucggaaaguguggcucuugcguguauaacaugauggggaaacgggaaaagaaacugggcgaguuuggaaaggccaagggcagccgcgcuaucugguacauguggcuuggggccagauaccuggaguucgaggcucucggauuucugaaugaggaucacugguucucccgggaaaacucuuauagcggcguugagggggaaggacugcauaaacucggcuacauccugagagacauuuccaagauccccgggggcgccauguaugcggaugacacggccggaugggacacccggauuacagaggaugaccuucacaaugaagagaaaaucacccagcagauggauccugagcaccgccaacuggcuaacgccauuuuuaagcucacauaccagaauaaaguggucaaggugcagagacccaccccgacaggcaccgucauggacaucaucucucggaaggaucagcgcgggagcggacaagugggcacguaugggcugaacacauucaccaauauggaagcucagcuuauuagacagauggagggagaaggcguucuguccaaagccgaccucgagaacccucaucugcccgaaaagaaaaucacccaguggcuggagacaaaggggguggagcggcucaaacgcauggcgauuagcggcgaugacugcgucgugaagcccaucgaugacagauuugccaacgcucugcuugcccugaaugauaugggaaaggugcggaaagacauuccucaauggcagccgucuaagggcuggcacgauuggcagcagguucccuucuguucccaucacuuccacgaacucaucaugaaagacgggcgcaagcugguggucccuugcagaccccaagacgagcuuauuggacgggcucgcaucagccagggcgccggguggucucugaaagaaaccgcuugucucggaaaggccuacgcgcagauguggucccugauguauuuucauagacgggaucugcgccucgccagcaacgcuaucugcucugccgugccuguucacugggugcccacauccagaacgaccuggagcauucaugcccaccaucaauggaugacaaccgaggacaugcugacagucuggaaucggguguggaucgaagauaacccuuggauggaggacaagacccccgucacgaccugggagaaugugccguaccuuggcaaaagagaagaucaguggugugggucccugauuggccucacaagccgcgcuaccugggcccagaacaucccuacagcgauucagcaaguucggucucugaucggaaaugaggaguuccuugacuacaugcccagcaugaagagauuucgcaaagaggaggaauccgagggcgcuaucugguga

SEQ ID NO: 20596 - RNA, 9873 nt, Artificial Sequence
  derived and/or modified CDS sequence (opt5) from DENV-3__JF937626__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaaaaggccgcugacaugacaugggaggaagaggccgaacagacgggcgugucccacaaccucaugaucaccgucgacgaugacggcacaaugcggauuaaagaugacgagaccgagaauauccugacagugcuucugaagaccgcgcugcucaucgucagcgggauuuuuccguacucuaucccugcuacgcugcuuguguggcauaccuggcagaaacagacacaacgcuccggaguucugugggaugugcccagcccucccgaaacccagaaggccgagcucgaagagggcgucuacagaauuaaacagcaggggaucuucggaaagacacaagugggcguuggggugcagaaggagggagucuuucacaccauguggcacgugacacggggcgccgugcugacguauaacggcaaacgccucgaaccgaauugggcuucuguuaagaaagaccugauuuccuacgggggaggcuggagacuuagcgcccaguggcaaaagggggaggaaguccaggugaucgcgguggagccuggcaagaaccccaagaauuuccagaccaugccuggcacauuccagaccaccacaggggaaauuggagcuaucgcccuggauuuuaagcccggcacgucuggcucccccaucauuaaccgggaggggaaagucgugggacuguauggcaaugggguugugaccaagaacggaggcuacgucagcgggaucgcccaaacaaaugcugagccugacggcccgacccccgaacucgaggaagagauguucaaaaagcgcaaccugacaauuauggaucuucauccuggauccggcaaaaccagaaaguaucugcccgccaucgugcgggaagcuauuaagcgcagacuccggacgcugauccucgccccuacaagaguuguggcggccgagauggaggaagcucugaaagggcuucccauccgcuaccagaccaccgccacaaagagcgagcacaccggacgggaaauugucgaccugaugugccaugcuacauuuaccaugagacugcucucuccugugcgcguuccgaauuauaaccugaucauuauggaugaggcccacuucacggaccccgccagcaucgcugcgcggggcuacauuuccacaagaguggggaugggagaagccgcugccaucuuuaugaccgccacaccucccggcaccgcugaugccuucccucagucuaaugcgcccauccaggacgaggagcgcgacauuccggaacggagcuggaacuccgggaaugaguggaucacggauuuugcuggcaaaaccgucugguucgugccuucuauuaaggccggaaacgacaucgccaacugucuucgcaaaaauggcaagaaggugauucaacugagcagaaaaacauuugauaccgaauaccagaagacaaaacucaacgacugggauuucgucguuaccacagacaucuccgagaugggggcuaauuuuaaggccgaucgggugauugaccccagacggugccugaaacccgugauccugaccgauggaccugagcgcgucauccucgcgggccccaugccugugacggccgcuucugccgcucagagacgggggcgcguuggaagaaacccgcagaaggaaaaugaccaauauauuuucacaggccagccccuuaacaaugaugaggaccaugcccacuggaccgaagcuaagaugcugcuggacaacaucaauaccccugaggggauuauccccgcccucuucgaaccugagcgggagaaaagcgcggccauugauggcgaauacagacugaagggagagucccgcaaaacauuuguggaacuuaugcggagaggcgaccugcccgucuggcucgcucacaagguggccagcgaggggaucaaauauaccgaucgcaaguggugcuucgacggacagcggaacaaucagauccuggaagagaacauggauguugagauuuggacaaaagaaggcgagaagaagaaacugagaccgcgcuggcucgacgcucggacguacucugauccucuugcccugaaggaauuuaaagaguucgccgcugggagaaaguccaucgcgcuggaccucgugaccgaaauuggacgcguccccagccaucuggcccacagaacacggaaugcucuugauaaccuggugaugcuccauaccucugagcacggcggccgcgccuauagacacgccgucgaggaacugccugagacaauggaaacccugcuccuucuggggcugaugauccuccugacgggaggcgcuaugcuuuuucugauuuccgggaaaggaaucggcaagaccagcaucgggcucauuugugugaucgccuccucuggaaugcuguggauggcggagauuccccugcaauggaucgccagcgcuauuguucucgaguucuuuaugauggugcuucugaucccugaacccgagaagcagcggacaccgcaggacaaucaacuggccuacguggucauuggcauccucacccuggcugccaucauugcggccaacgaaaugggccuucuggagacaaccaaacgcgaucucgggauguccaaggaaccuggaguugugagccccacgucuuaucuggacguggaucugcaucccgcuuccgccuggacacucuacgcugucgccaccacagugaucaccccuaugcuuagacacaccauugagaauagcacagcuaacguuucucuggccgcgaucgccaaccaggcugugguccugaugggccucgacaaaggguggccgauuagcaagauggaccugggagugccccuucuggcccucggcugcuacucccaggucaauccucugacgcugaccgcugccgugcuccuucugaucacacauuaugccaucauugggcccggacugcaggcgaaagcuacccgggaggcccaaaagagaacagcugccggcaucaugaagaacccuaccguugauggcauuaugacgaucgaccucgaucccgugauuuacgacucuaaauucgaaaagcagcuggggcaggucaugcuucuggugcucugugccguucagcugcugcucaugcgcacaagcugggcucuuugcgaggcccugacccuggcgaccggaccuaucacaacccucugggaaggcuccccggggaaauuuuggaauacaacgaucgccgugucuauggcuaacauuuuccggggaagcuaucuggccggcgcugggcuugccuuuuccaucaugaaaagcgucggaaccggcaaaagaggcacagggucucaaggagagacccugggcgaaaaguggaagaaaaagcucaaucagcugucccgcaaagauuucgaccuguacaagaaaagcgggauuacagagguggaucggaccgaggcgaaggaaggacucaaaagaggcgagaucacgcaccaugccgugucccgggggucugcuaaacuucagugguuuguugaacgcaacauggucgugcccgagggaagagugauugaccugggcuguggcagagggggauggagcuauuacugcgccggccugaagaaagucaccgaaguucgcggguauacaaagggaggcccugggcacgaggagcccgugccuauguccaccuacggauggaauaucgugaaacucaugucuggcaaggaugucuucuaccugcccccggaaaaaugugacacacuucugugcgauauuggcgagagcuccccuagccccaccguggaagagucuagaacaauccggguucucaagaugguggagcccuggcugaagaacaaucaguucuguaucaaaguccugaacccuuauaugcccaccgugauugaacaccucgagcgccuucaaagaaagcaugggggaaugcugguucggaauccucugucccgcaacagcacgcacgaaauguacuggaucucuaauggcacagggaacauuguggcuuccgucaauauggugagcagacuccugcuuaaccgguuuaccaugacccauagacgcccgacaaucgagaaagacguggaucugggagccggcacgcggcacgucaacgcugaacccgagaccccuaauauggacguuauuggggagagaaucaagcgcaucaaagaagaacacaacucuacauggcauuaugacgaugaaaaucccuacaagaccugggccuaucacggaagcuacgaggugaaggcgacaggcuccgccucuagcaugauuaacggcguggucaaacuccugaccaagccuugggacgugguucccauggugacacagauggcuaugaccgauacgaccccguucgggcagcaacgggucuuuaaagaaaagguggacacaagaaccccucgcuccaugcccggaacacggagaguuaugggcaucaccgccgaguggcuguggcgcacgcucgggcggaauaaaaagccuagacugugcacacgcgaggaguucaccaagaaagugcggacaaacgcugccaugggagccgucuuuaccgaggaaaaucagugggauagcgcgaaggcugccguggaggacgaagauuucuggaaacuuguugacagagagcgcgagcugcauaagcucggcaaauguggguccugcguguauaacaugaugggcaagagagagaagaagcugggagaguuuggcaaggccaaagggucucgggcuauuugguacauguggcuuggagcccgcuaccuggaguucgaggcucucggcuuucugaaugaggaucacugguucagcagagaaaacuccuauucuggggucgagggagaaggccugcauaagcucggguacauccugcgggacauuagcaaaauccccggcggagccauguaugcggaugacacggccggcugggacaccagaaucacagaggaugaccuucacaaugaagagaagauuacccagcagauggauccugagcaccggcaacuggcuaacgccaucuuuaaacucacauaccagaauaagguggucaaggugcagcgccccaccccgacagggaccguuauggacauuaucuccagaaaagaucagcggggaucuggccaaguggggacguauggacugaacacauucaccaauauggaagcucagcuuauucgccagauggagggcgaagggguccugagcaaggccgaccucgagaacccucaucugcccgagaaaaagaucacccaguggcuggagacaaaaggcguggagagacucaagcggauggcgaucuccggagaugacugcgugguuaagcccauugaugaccgcuuugccaacgcucugcuugcccugaaugauaugggcaaagugagaaaggacaucccucaauggcagccgagcaaaggguggcacgauuggcagcagguccccuucuguucucaucacuuccacgaacucauuaugaaggacggacggaaacuggugguuccuugccgcccccaagacgagcuuaucggcagagcucggauuucccagggggccggauggagccugaaggaaaccgcuugucucggcaaggccuacgcgcagauguggucucugauguauuuucaucgcagagaucugcggcucgccuccaacgcuaucugcagcgccgugccuguccacugggugcccacaucucgcacgaccugguccauucaugcccaccaucaauggaugacaaccgaggacaugcugacagucuggaauagaguguggaucgaagauaacccuuggauggaggacaaaacccccguuacgaccugggagaaugugccguaccuugggaagcgggaagaucagugguguggcagccugaucggacucacauccagagcuaccugggcccagaacauuccuacagcgauccagcaaguccgcagccugauuggcaaugaggaguuccuugacuacaugcccucuaugaaacgguuuagaaaggaggaggaaagcgagggggcuaucugguga

SEQ ID NO: 20597 - RNA, 9873 nt, Artificial Sequence
  derived and/or modified CDS sequence (opt5) from DENV-3__JF937621__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcucggggggccagacgcauggcuauccuuggagacaccgccugggauuucggcuccguggggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaacgggccgcugacaucacaugggaggaagaggccgaacagacgggcgugucccacaaccucaugauuaccgucgacgaugacggcacaaugcgcaucaaggaugacgagaccgagaauauccugacagugcuucugaaaaccgcgcugcucauugucagcgggaucuuuccguacucuauuccugcuacgcugcuuguguggcauaccuggcagaagcagacacaaagauccggaguucugugggaugugcccagcccucccgaaacccagaaagccgagcucgaagagggcgucuaccggaucaagcagcaggggauuuucggaaaaacacaagugggcguuggggugcagaaggagggagucuuucacaccauguggcacgugacacgcggcgccgugcugacguauaacggcaagagacucgaaccgaauugggcuucuguuaaaaaggaccugaucuccuacgggggaggcuggcggcuuagcgcccaguggcaaaaaggggaggaaguccaggugauugcgguggagccuggaaagaaccccaaaaauuuccagaccaugccuggcacauuccagaccaccacaggggaaaucggagcuaucgcccuggauuuuaagcccggcacgucuggcucccccauuaucaaccgcgaggggaaggucgugggacuguauggcaaugggguugugaccaaaaacggaggcuacgucagcgggauugcccaaacaaaugcugagccugacggcccgacccccgaacucgaggaagagauguucaagaaaagaaaccugacaaucauggaucuucauccuggauccggcaagacccggaaauaucugcccgccauugugcgcgaagcuaucaagagacggcucagaacgcugauccucgccccuacacgcguuguggcggccgagauggaggaagcucugaaggggcuucccauucgguaccagaccaccgccacaaaaagcgagcacaccggaagagaaaucgucgaccugaugugccaugcuacauuuaccaugcgccugcucucuccugugcggguuccgaauuauaaccugauuaucauggaugaggcccacuucacggaccccgccagcauugcugcgagaggcuacaucuccacacgcguggggaugggagaagccgcugccaucuuuaugaccgccacaccucccggcaccgcugaugccuucccucagucuaaugcgcccauucaggacgaggagcgggacaucccggaaagaagcuggaacuccgggaaugaguggauuacggauuuugcuggcaagaccgucugguucgugccuucuaucaaagccggaaacgacauugccaacugucuucgcaagaauggcaaaaaggugauccaacugagccggaagacauuugauaccgaauaccagaaaacaaagcucaacgacugggauuucgucguuaccacagacauuuccgagaugggggcuaauuuuaaagccgauagagugaucgacccccggcgcugccugaagcccgugauccugaccgauggaccugagagagucauucucgcgggccccaugccugugacggccgcuucugccgcucagcggcgcgggagaguuggacggaacccgcagaaagaaaaugaccaauauaucuucacaggccagccccuuaacaaugaugaggaccaugcccacuggaccgaagcuaagaugcugcuggacaacauuaauaccccugaggggaucauucccgcccucuucgaaccugagagagagaagagcgcggccaucgauggcgaauaccgccugaaaggagagucccggaagacauuuguggaacuuaugagacgcggcgaccugcccgucuggcucgcucacaaaguggccagcgaggggaucaaguauaccgaucggaaauggugcuucgacggacagagaaacaaucagauucuggaagagaacauggauguugagaucuggacaaaggaaggcgagaaaaagaagcugcgcccgcgguggcucgacgcuagaacguacucugauccucuugcccugaaagaauuuaaggaguucgccgcugggcgcaaauccauugcgcuggaccucgugaccgaaaucggaagaguccccagccaucuggcccaccggacacgcaaugcucuugauaaccuggugaugcuccauaccucugagcacggcggcagagccuaucggcacgccgucgaggaacugccugagacaauggaaacccugcuccuucuggggcugaugauucuccugacgggaggcgcuaugcuuuuucugaucuccgggaagggaaucggcaaaaccagcauugggcucaucugugugauugccuccucuggaaugcuguggauggcggagaucccccugcaauggauugccagcgcuaucguucucgaguucuuuaugauggugcuucugauuccugaacccgagaagcagcgcacaccgcaggacaaucaacuggccuacguggucaucggcauccucacccuggcugccauuaucgcggccaacgaaaugggccuucuggagacaaccaagagagaucucgggauguccaaagaaccuggaguugugagccccacgucuuaucuggacguggaucugcaucccgcuuccgccuggacacucuacgcugucgccaccacagugauuaccccuaugcuucggcacaccaucgagaauagcacagcuaacguuucucuggccgcgauugccaaccaggcugugguccugaugggccucgacaagggguggccgaucagcaaaauggaccugggagugccccuucuggcccucggcugcuacucccaggucaauccucugacgcugaccgcugccgugcuccuucugaucacacauuaugccauuaucgggcccggacugcaggcgaaggcuaccagagaggcccaaaaacgcacagcugccggcauuaugaagaacccuaccguugauggcaucaugacgauugaccucgaucccgugaucuacgacucuaaguucgaaaaacagcuggggcaggucaugcuucuggugcucugugccguucagcugcugcucaugcggacaagcugggcucuuugcgaggcccugacccuggcgaccggaccuaucacaacccucugggaaggcuccccggggaaguuuuggaauacaacgauugccgugucuauggcuaacaucuucagaggaagcuaucuggccggcgcugggcuugccuuuuccauuaugaaaagcgucggaaccggcaagcgcggcacagggucucaaggagagacccugggcgaaaaauggaagaagaaacucaaucagcugucccggaaggauuucgaccuguacaaaaagagcgggaucacagagguggauagaaccgaggcgaaagaaggacucaagcggggcgagauuacgcaccaugccgugucccgcgggucugcuaaacuucagugguuuguugaaagaaacauggucauccccgagggacgggugauugaccugggcuguggccgcgggggauggagcuauuacugcgccggccugaagaaggugaccgaagucagaggguauacaaaaggaggcccugggcacgaggagcccguuccuauguccaccuacggauggaauaucgugaagcucaugucuggcaaagauguguucuaccugcccccggaaaagugugacacacuucugugcgauaucggcgagagcuccccuagccccaccgucgaagagucucggacaauucgcgugcucaaaaugguugagcccuggcugaagaacaaucaguucuguaucaaggugcugaacccuuauaugcccaccgucauugaacaccucgagagacuucaacggaaacaugggggaaugcuggugcgcaauccucuguccagaaacagcacgcacgaaauguacuggaucucuaauggcacagggaacauuguugcuuccgugaauauggucagccggcuccugcuuaacagauuuaccaugacccaucgccggccgacaaucgagaaggacguggaucugggagccggcacgagacacgugaacgcugaacccgagaccccuaauauggacgucaucggggagcgcauuaaacggaucaaggaagagcacaacucuacauggcauuaugacgaugaaaaucccuacaaaaccugggccuaucacggaagcuacgagguuaaggcgacaggcuccgccucuagcaugauuaacggcguggugaagcuccugaccaaaccuugggacgucgugcccaugguuacacagauggcuaugaccgauacgaccccguucgggcagcaaagaguguuuaaggaaaaagucgacacacgcaccccucgguccaugcccggaacaagacgcgugaugggcaucaccgccgaguggcuguggcggacgcucgggagaaauaagaaaccucgccugugcacacgggaggaauucaccaagaagguuagaacaaacgcugccaugggagccguguuuaccgaggaaaaucagugggauagcgcgaaagcugccgucgaggacgaagauuucuggaagcuuguggaccgcgagagagagcugcauaaacucggcaaguguggguccugcguuuauaacaugaugggcaaacgggaaaagaaacugggagaguuuggcaaggccaaggggucucgcgcuauuugguacauguggcuuggagccagauaccuggaauucgaggcucucggcuuucugaaugaggaucacugguucagccgggaaaacuccuauucugggguggagggagaaggccugcauaaacucggguacauccugagagacaucagcaagauucccggcggagccauguaugcggaugacacggccggcugggacacccggaucacagaggaugaccuucacaaugaagagaaaauuacccagcagauggauccugagcaccgccaacuggcuaacgccaucuuuaagcucacauaccagaauaaagucgugaagguccagagacccaccccgacagggaccgugauggacauuaucucccggaaggaucagcgcggaucuggccaaguugggacguauggacugaacacauucaccaauauggaagcucagcuuaucagacagauggagggcgaaggggugcugagcaaagccgaccucgagaacccucaucugcccgaaaagaaaauuacccaguggcuggagacaaagggcgucgagcggcucaaacgcauggcgaucuccggagaugacugcguggugaagcccauugaugacagauuugccaacgcucugcuugcccugaaugauaugggcaagguucggaaagacaucccucaauggcagccgagcaagggguggcacgauuggcagcaggugcccuucuguucucaucacuuccacgaacucauuaugaaagacggacgcaagcuggucgugccuugcagaccccaagacgagcuuaucggccgggcucgcauuucccagggggccggauggagccugaaagaaaccgcuugucucggcaaggccuacgcgcagauguggucucugauguauuuucauagacgggaucugcgccucgccuccaacgcuaucugcagcgccguuccugugcacuggguccccacaucuagaacgaccugguccauccaugcccaccaucaauggaugacaaccgaggacaugcugacaguguggaaucgggucuggauugaagauaacccuuggauggaggacaagacccccgugacgaccugggagaauguuccguaccuugggaaaagagaagaucagugguguggcagccugaucggacucacaucccgcgcuaccugggcccagaacauuccuacagcgauccagcaagugcggagccugauuggcaaugaggaauuccuugacuacaugcccucuaugaagagauuucgcaaagaggaggaaagcgagggggcuaucugguga

SEQ ID NO: 20598 - RNA, 9873 nt, Artificial Sequence
  derived and/or modified CDS sequence (opt5) from DENV-3__JF937623__SS-prME
gcgagccugugccucaugaugauccugcccgcugcccuugcguuccaccugaccucccgggacggagaaccucggaugauuguggggaagaacgaacgcggaaaaucucuccuguuuaagacagcuagcggcaucaauauguguacgcuuauugccauggaucugggggaaaugugcgacgauaccgucacauacaaauguccgcauaucaccgaaguugaacccgaagacauugauugcugguguaaccucacauccaccugggugacauauggaaccugcaaucaggccggcgaacaccggcgggacaagcgcucuguggcucuggccccucaugucgggaugggacuggauacgcggacccagacauggaugagcgcugagggcgccuggagacagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccagcuggcgacacuucgcaaacuguguaucgagggaaagauuaccaacaucacaaccgauuccagaugcccuacgcagggcgaagccacacucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugucuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcauuuucuuuacauucguucuucugcucagcgggcagaucaccuggcgcgauauggcucauacacugauuaugaucggauccaaugccagcgacagaaugggcaugggggugaccuaucuggcgcuuaucgcuacguuuaaaauucagcccuuccuggcccucggauuuuuccugcggaagcucacaucuagagaaaaccugcuucugggcgucgggcucgccauggcuaccacacugcaacugccugaggauaucgaacagauggccaauggaauugcucuuggccugauggcccucaaacugaucacccaguuugagaccuaccagcucuggacagcgcugauuucccuuacguguagcaacaccaucuucacacugaccguggccuggcgcacagcuacccucauccuggccggcgugucccugcuuccggucugccaaucuagcuccaugcggaagacggacuggcugcccauggcuguugccgccaugggggugccuccccucccucuguuuauuuucggacucaaggauacacugaaaagacgcucuuggccccuuaaugagggcgugauggcugucgggcuggugagcauccuggcguccucucuccugagaaacgacguuccuauggccggaccccuuguggcuggcgggcugcucauugccuguuaugucaucaccggaaccagcgccgaucugacaguggaaaaggcugccgacaugaccugggaggaagaggcggaacagacaggcguuucccacaaccucaugauuacgguggacgaugacggcaccaugcggaucaaagaugacgagacagagaauauccugaccguccuucugaagacagcucugcucauugugagcgggaucuuuccguacucuauuccugccacccugcuugucuggcauacguggcagaaacagacccaacgcuccggagugcugugggauguucccagcccucccgaaacacagaaggccgagcucgaagagggcaucuacagaauuaaacagcaggggaucuucggaaagacccaagugggcgucggggugcagaaggagggaguuuuucacacaauguggcacgugacccggggcgcuguccugacauauaacggcaaacgccucgaaccgaauugggccucugugaagaaagaccugauuuccuacgggggaggcuggagacuuagcgcgcaguggcaaaagggggaggaagugcagguuaucgcugucgagccuggcaagaaccccaagaauuuccagacgaugccuggcaccuuccagacaaccaccggggaaaucggagccauugcccuggauuuuaagcccggcacaucuggcucccccaucauuaaccgggaggggaaaguggugggacuguauggcaauggggucgugacgaagaacggaggcuacguuagcgggaucgcucaaaccaaugccgagccugacggcccgacacccgaacucgaggaagagauguucaaaaagcgcaaccugaccauuauggaucuucauccuggauccggcaaaacaagaaaguaucugcccgcuaucgugcgggaagccaucaagcgcagacuccggacccugauucucgcgccuacgagagucguggccgcugagauggaggaagcccugaaagggcuucccauccgcuaccagacaaccgcuaccaagagcgagcacacaggacgggaaauuguugaccugaugugccaugccaccuuuacaaugagacugcucucuccugugcgcgucccgaauuauaaccugaucauuauggaugaggcccacuucaccgaccccgcuagcaucgcggcccggggcuacaucuccacgagaguggggaugggagaagcugccgccauuuuuaugacagcuaccccucccggcacagccgaugcguucccucagucuaaugcucccauccaggacgaggagcgcgacauuccggaacggagcuggaacuccgggaaugaguggaucaccgauuuugccggcaaaacgguuugguucgugccuucuauuaaggccggaaacgacaucgcuaacugucuucgcaaaaauggcaagaaggucauucaacugagcagaaaaaccuuugauacagaauaccagaagaccaaacucaacgacugggauuucguggugacaaccgacaucuccgagaugggggccaauuuuaaggcggaucgggucaucgaccccagacggugccugaaacccguuauucugacagauggaccugagcgcgugauccucgccggccccaugccugugaccgcugccucugcugcccagagacgggggcgcgucggaagaaacccgcagaaggaaaaugaccaauauauuuucacgggccagccccuuaacaaugaugaggaccaugcucacuggacagaagccaagaugcugcuggacaacaucaauaccccugaggggauuauccccgcccucuucgaaccugagcgggagaaaagcgccgcuaucgauggcgaauacagacugaagggagagucccgcaaaaccuuuguggaacuuaugcggagaggcgaccugcccguuuggcucgcccacaagguggcuagcgaggggauuaaauauacagaucgcaaguggugcuucgacggacagcggaacaaucagauccuggaagagaacauggaugucgagauuuggaccaaagaaggcgagaagaagaaacugagaccgcgcuggcucgacgcccggacauacucugauccucuugcccugaaggaauuuaaagaguucgcugcggggagaaaguccaucgcccuggaccucgugacggaaauuggacgcguucccagccaucuggcucacagaacccggaaugcccuugauaaccuggugaugcuccauacaucugagcacggcggccgcgccuauagacacgcugucgaggaacugccugagaccauggaaacacugcuccuucuggggcugaugauccuccugaccggaggcgccaugcuuuuucugaucuccgggaaaggaauuggcaagacgagcaucgggcucauuugugugaucgcguccucuggaaugcuguggauggccgagauuccccugcaauggaucgcuagcgccauuguccucgaguucuuuaugauggugcuucugaucccugaacccgagaagcagcggaccccgcaggacaaucaacuggcuuacguugugaucggcauucucacacuggccgcgaucauugccgcuaacgaaaugggccuucuggagaccacaaaacgcgaucucgggauguccaaggaaccuggaguggucagccccaccucuuaucuggacguugaucugcaucccgccuccgcuuggacgcucuacgccguggcuacaaccgugaucacaccuaugcuuagacacaccauugagaauagcaccgccaacgucucucuggcggccaucgcuaaccaggccgugguucugaugggccucgacaaaggguggccgaucagcaagauggaccugggagugccccuucuggcucucggcugcuacucccaggucaauccucugacacugacggccgccgugcuccuucugauuacccauuaugcgaucauugggcccggacugcaggcuaaagccacacgggaggcucaaaagagaaccgccgccggcaucaugaagaacccuacagucgauggcauuaugaccaucgaccucgaucccgugaucuacgacucuaaauucgaaaagcagcuggggcagguuaugcuucuggugcucugugcuguccagcugcugcucaugcgcacgagcugggcccuuugcgaggcgcugacacuggccaccggaccuauuaccacacucugggaaggcuccccggggaaauuuuggaauaccacaaucgcugugucuauggccaacauuuuccggggaagcuaucuggcuggcgccgggcuugcguuuuccaucaugaaaagcguuggaacgggcaaaagaggcaccgggucucaaggagagacacugggcgaaaaguggaagaaaaagcucaaucagcugucccgcaaagauuucgaccuguacaagaaaagcgggauuaccgagguggaucggacagaggccaaggaaggacucaaaagaggcgagaucacccaccaugcugucucccgggggucugccaaacuucagugguuuguggaacgcaacauggugauucccgagggaagaguuaucgaccugggcuguggcagagggggauggagcuauuacugcgcuggccugaagaaagucacggaagugcgcggguauaccaagggaggcccugggcacgaggagcccgugccuauguccacauacggauggaauaucgucaaacucaugucuggcaaggauguuuucuaccugcccccggaaaaaugugacacccuucugugcgauauuggcgagagcuccccuagccccacaguggaagagucuagaaccauccgggugcucaagauggucgagcccuggcugaagaacaaucaguucuguauuaaagugcugaacccuuauaugcccacaguuaucgaacaccucgagcgccuucaaagaaagcaugggggaaugcuggugcggaauccucugucccgcaacagcacccacgaaauguacuggauuucuaauggcacggggaacaucgucgccuccgugaauaugguuagcagacuccugcuuaaccgguuuacaaugacccauagacgcccgaccaucgagaaagacguggaucugggagcuggcacacggcacgucaacgccgaacccgagacgccuaauauggacgugauuggggagagaaucaagcgcauuaaagaagaacacaacucuaccuggcauuaugacgaugaaaaucccuacaagacaugggcguaucacggaagcuacgaggugaaggccaccggcuccgcuucuagcaugaucaacggcgucguuaaacuccugacaaagccuugggacguggugcccauggucacccagauggccaugacagauaccacgccguucgggcagcaacggguguuuaaagaaaagguugacaccagaacaccucgcuccaugcccggaacccggagagugaugggcauuacagcugaguggcuguggcgcacccucgggcggaauaaaaagccuagacugugcacgcgcgaggaguucacaaagaaaguccggaccaacgccgccaugggagcgguguuuacagaggaaaaucagugggauagcgcuaaggccgccguugaggacgaagauuucuggaaacuuguggacagagagcgcgagcugcauaagcucggcaaauguggguccugcgucuauaacaugaugggcaagagagagaagaagcugggagaguuuggcaaggcuaaagggucucgggccaucugguacauguggcuuggagcucgcuaccuggaguucgaggcccucggcuuucugaaugaggaucacugguucagcagagaaaacuccuauucugggguggagggagaaggccugcauaagcucggguacauccugcgggacauuagcaaaauccccggcggagcgauguaugccgaugacaccgcuggcugggacacgagaauuaccgaggaugaccuucacaaugaagagaagaucacacagcagauggauccugagcaccggcaacuggccaacgcuauuuuuaaacucaccuaccagaauaagguugugaagguccagcgccccacaccgaccgggacagugauggacaucaucuccagaaaagaucagcggggaucuggccaagucgggaccuauggacugaacacguucacaaauauggaagcccagcuuauucgccagauggagggcgaaggggugcugagcaaggcggaccucgagaacccucaucugcccgagaaaaagaucacccaguggcuggagaccaaaggcguugagagacucaagcggauggccauuuccggagaugacugcguggucaagcccaucgaugaccgcuuugcuaacgcccugcuugcucugaaugauaugggcaaagugagaaaggacauuccucaauggcagccgagcaaaggguggcacgauuggcaacaggugcccuucuguucucaucacuuccacgaacucaucaugaaggacggacggaaacugguugugccuugccgcccccaagacgagcuuauuggcagagcccggaucucccagggggcuggauggagccugaaggaaacagccugucucggcaaggcguacgcccagauguggucucugauguauuuucaucgcagagaucugcggcucgcuuccaacgccaucugcagcgccgucccugugcacuggguucccaccucucgcacaacgugguccauucaugcucaccaucaauggaugaccacagaggacaugcugaccguguggaauagagucuggaucgaagauaacccuuggauggaggacaaaacacccgugaccacgugggagaaugucccguaccuugggaagcgggaagaucagugguguggcagccugauuggacucaccuccagagccacaugggcgcagaacaucccuaccgcuauucagcaagugcgcagccugaucggcaaugaggaguuccuugacuacaugcccucuaugaaacgguuuagaaaggaggaggaaagcgagggggccaucugguga

SEQ ID NO: 20599 - RNA, 9873 nt, Artificial Sequence
  derived and/or modified CDS sequence (opt5) from DENV-3__JF937637__SS-prME
accagccugugccucaugaugauccugcccgcggcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacgccuuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugucuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucggacucaaggauacacugaaaagacgcucuuggccccuuaaugagggcgucauggcuguggggcugguuagcauucuggcguccucucuccugagaaacgacgugccuauggccggaccccuugucgcuggcgggcugcucaucgccuguuaugugauuaccggaaccagcgccgaucugacaguugaaaaggcugccgacaucaccugggaggaagaggcggaacagacaggcgugucccacaaccucaugauuacggucgacgaugacggcaccaugcggaucaaagaugacgagacagagaauauccugaccgugcuucugaagacagcucugcucauugucagcgggaucuuuccguacucuauuccugccacccugcuuguguggcauacguggcagaaacagacccaacgcuccggaguucugugggaugugcccagcccucccgaaacacagaaggccgagcucgaagagggcgucuacagaaucaaacagcaggggauuuucggaaagacccaagugggcguuggggugcagaaggagggagucuuucacacaauguggcacgugacccggggcgcugugcugacauauaacggcaaacgccucgaaccgaauugggccucuguuaagaaagaccugaucuccuacgggggaggcuggagacuuagcgcgcaguggcaaaagggggaggaaguccaggugauugcuguggagccuggcaagaaccccaagaauuuccagacgaugccuggcaccuuccagacaaccaccggggaaaucggagccaucgcccuggauuuuaagcccggcacaucuggcucccccauuaucaaccgggaggggaaagucgugggacuguauggcaaugggguugugacgaagaacggaggcuacgucagcgggauugcucaaaccaaugccgagccugacggcccgacacccgaacucgaggaagagauguucaaaaagcgcaaccugaccaucauggaucuucauccuggauccggcaaaacaagaaaguaucugcccgcuauugugcgggaagccaucaagcgcagacuccggacccugauccucgcgccuacgagaguuguggccgcugagauggaggaagcccugaaagggcuucccauucgcuaccagacaaccgcuaccaagagcgagcacacaggacgggaaaucgucgaccugaugugccaugccaccuuuacaaugagacugcucucuccugugcgcguuccgaauuauaaccugauuaucauggaugaggcccacuucaccgaccccgcuagcauugcggcccggggcuacaucuccacgagaguggggaugggagaagcugccgccaucuuuaugacagcuaccccucccggcacagccgaugcguucccucagucuaaugcucccauucaggacgaggagcgcgacaucccggaacggagcuggaacuccgggaaugaguggauuaccgauuuugccggcaaaacggucugguucgugccuucuaucaaggccggaaacgacauugcuaacugucuucgcaaaaauggcaagaaggugauccaacugagcagaaaaaccuuugauacagaauaccagaagaccaaacucaacgacugggauuucgucguuacaaccgacauuuccgagaugggggccaauuuuaaggcggaucgggugaucgaccccagacggugccugaaacccgugauccugacagauggaccugagcgcgucauucucgccggccccaugccugugaccgcugccucugcugcccagagacgggggcgcguuggaagaaacccgcagaaggaaaaugaccaauauaucuucacgggccagccccuuaacaaugaugaggaccaugcucacuggacagaagccaagaugcugcuggacaacauuaauaccccugaggggaucauucccgcccucuucgaaccugagcgggagaaaagcgccgcuaucgauggcgaauacagacugaagggagagucccgcaaaaccuuuguggaacuuaugcggagaggcgaccugcccgucuggcucgcccacaagguggcuagcgaggggaucaaauauacagaucgcaaguggugcuucgacggacagcggaacaaucagauucuggaagagaacauggauguugagaucuggaccaaagaaggcgagaagaagaaacugagaccgcgcuggcucgacgcccggacauacucugauccucuugcccugaaggaauuuaaagaguucgcugcggggagaaaguccauugcccuggaccucgugacggaaaucggacgcguccccagccaucuggcucacagaacccggaaugcccuugauaaccuggugaugcuccauacaucugagcacggcggccgcgccuauagacacgcugucgaggaacugccugagaccauggaaacacugcuccuucuggggcugaugauucuccugaccggaggcgccaugcuuuuucugaucuccgggaaaggaaucggcaagacgagcauugggcucaucugugugauugcguccucuggaaugcuguggauggccgagaucccccugcaauggauugcuagcgccaucguucucgaguucuuuaugauggugcuucugauuccugaacccgagaagcagcggaccccgcaggacaaucaacuggcuuacguggucaucggcauccucacacuggccgcgauuaucgccgcuaacgaaaugggccuucuggagaccacaaaacgcgaucucgggauguccaaggaaccuggaguugugagccccaccucuuaucuggacguggaucugcaucccgccuccgcuuggacgcucuacgccgucgcuacaaccgugauuacaccuaugcuuagacacaccaucgagaauagcaccgccaacguuucucuggcggccauugcuaaccaggccgugguccugaugggccucgacaaaggguggccgaucagcaagauggaccugggagugccccuucuggcucucggcugcuacucccaggucaauccucugacacugacggccgccgugcuccuucugaucacccauuaugcgauuaucgggcccggacugcaggcuaaagccacacgggaggcucaaaagagaaccgccgccggcauuaugaagaacccuacaguugauggcaucaugaccauugaccucgaucccgugaucuacgacucuaaauucgaaaagcagcuggggcaggucaugcuucuggugcucugugcuguucagcugcugcucaugcgcacgagcugggcccuuugcgaggcgcugacacuggccaccggaccuaucaccacacucugggaaggcuccccggggaaauuuuggaauaccacaauugcugugucuauggccaacaucuuccggggaagcuaucuggcuggcgccgggcuugcguuuuccauuaugaaaagcgucggaacgggcaaaagaggcaccgggucucaaggagagacacugggcgaaaaguggaagaaaaagcucaaucagcugucccgcaaagauuucgaccuguacaagaaaagcgggaucaccgagguggaucggacagaggccaaggaaggacucaaaagaggcgagauuacccaccaugcugugucccgggggucugccaaacuucagugguuuguugaacgcaacauggucauccccgagggaagagugauugaccugggcuguggcagagggggauggagcuauuacugcgcuggccugaagaaagugacggaaguccgcggguauaccaagggaggcccugggcacgaggagcccguuccuauguccacauacggauggaauaucgugaaacucaugucuggcaaggauguguucuaccugcccccggaaaaaugugacacccuucugugcgauaucggcgagagcuccccuagccccacagucgaagagucuagaaccauucgggugcucaagaugguugagcccuggcugaagaacaaucaguucuguaucaaagugcugaacccuuauaugcccacagucauugaacaccucgagcgccuucaaagaaagcaugggggaaugcuggugcggaauccucugucccgcaacagcacccacgaaauguacuggaucucuaauggcacggggaacauuguugccuccgugaauauggucagcagacuccugcuuaaccgguuuacaaugacccauagacgcccgaccaucgagaaagacguggaucugggagcuggcacacggcacgugaacgccgaacccgagacgccuaauauggacgucaucggggagagaauuaagcgcaucaaagaagaacacaacucuaccuggcauuaugacgaugaaaaucccuacaagacaugggcguaucacggaagcuacgagguuaaggccaccggcuccgcuucuagcaugauuaacggcguggugaaacuccugacaaagccuugggacgucgugcccaugguuacccagauggccaugacagauaccacgccguucgggcagcaacggguguuuaaagaaaaggucgacaccagaacaccucgcuccaugcccggaacccggagagugaugggcaucacagcugaguggcuguggcgcacccucgggcggaauaaaaagccuagacugugcacgcgcgaggaguucacaaagaaaguucggaccaacgccgccaugggagcgguguuuacagaggaaaaucagugggauagcgcuaaggccgccgucgaggacgaagauuucuggaaacuuguggacagagagcgcgagcugcauaagcucggcaaauguggguccugcguuuauaacaugaugggcaagagagagaagaagcugggagaguuuggcaaggcuaaagggucucgggccauuugguacauguggcuuggagcucgcuaccuggaguucgaggcccucggcuuucugaaugaggaucacugguucagcagagaaaacuccuauucugggguggagggagaaggccugcauaagcucggguacauccugcgggacaucagcaaaauucccggcggagcgauguaugccgaugacaccgcuggcugggacacgagaaucaccgaggaugaccuucacaaugaagagaagauuacacagcagauggauccugagcaccggcaacuggccaacgcuaucuuuaaacucaccuaccagaauaaggucgugaagguccagcgccccacaccgaccgggacagugauggacauuaucuccagaaaagaucagcggggaucuggccaaguugggaccuauggacugaacacguucacaaauauggaagcccagcuuauccgccagauggagggcgaaggggugcugcucaaggcggaccuggagaacccucaucugcccgagaaaaagauuacccaguggcucgagaccaaaggcgucgagagacugaagcggauggccaucagcggagaugacugcguggugaagcccauugaugaccgcuuugcuaacgcccuucuggcucucaaugauaugggcaaaguuagaaaggacaucccucaauggcagccguccaaaggguggcacgauuggcaacaggugcccuucuguagccaucacuuccacgaacugauuaugaaggacggacggaaacuugucgugccuugccgcccccaagacgagcugaucggcagagcccggauuucucagggggcuggauggucccucaaggaaacagccugucugggcaaggcguacgcccagauguggagccugauguauuuucaucgcagagaucuccggcuggcuucuaacgccaucugcuccgccguuccugugcacuggguccccaccagccgcacaacguggucuauccaugcucaccaucaauggaugaccacagaggacaugcuuaccguguggaauagagucuggauugaagauaacccuuggauggaggacaaaacacccgugaccacgugggagaauguuccguaccuggggaagcgggaagaucagugguguggcucccucaucggacugaccagcagagccacaugggcgcagaacauuccuaccgcuauccagcaagugcgcucccuuauuggcaaugaggaguuccuggacuacaugcccagcaugaaacgguuuagaaaggaggaggaaucugagggggccaucugguga

SEQ ID NO: 20600 - RNA, 9873 nt, Artificial Sequence
  derived and/or modified CDS sequence (opt5) from DENV-3__JF937638__SS-prME
acaagccugugccugcugaugauccuucccgccgcucuggccuuccaccucacauccagagacggcgaaccucggaugauuguggggaagaacgaacgcggaaaaucucugcuuuuuaagacggcgagcggcaucaauauguguacccugauugcuauggaucucggggaaaugugcgacgauacagugaccuacaaauguccgcauaucacagaaguugaacccgaagacauugauugcugguguaaccugaccuccacaugggugaccuauggaacgugcaaucaggccggcgagcacagacgggacaagcgcucuguggcccuggcuccucaugucgggaugggacucgauaccagaacacagaccuggaugagcgccgagggcgcuuggcggcaaguggaaaaaguugagacaugggcccugcgccaccccggcuucaccauccuugcgcuguuucucgcccauuacaucgggacgucccugacacagaagguggucauuuucauccuucugaugcucgugaccccuucuaugacaaugagauguguuggagugggcaaccgggacuuugucgaagggcugagcggagcuaccuggguggaugugguccuggagcacggcgggugcguuaccacaauggccaagaauaaacccacgcucgacauugagcugcagaagaccgaagcuacacagcuugccacccugcgcaaacucuguaucgagggaaagauuacaaacaucaccacggauuccagaugcccuacacagggcgaagcgacccugccggaggaacaggaccagaauuauguguguaaacacaccuacguggaucggggcugggggaacggaugcggccuuuucgggaagggaagccuggucacaugcgccaaguuucagugucucgagcccauugagggcaaagugguucaguaugaaaaucugaaguacaccgugaucaucacaguccauacgggggaccagcaccaggugggaaacgagacccaaggcguuacagcugaaauuaccccucaggccucuacaaccgaggcuauccugcccgaauauggcacgcucgggcuggagugcuccccucgcaccggacuugacuucaaugagaugauucugcucacaaugaaaaacaaggccuggauggugcauagacagugguuuuucgaucugccccuuccguggaccagcggcgccacaaccgaaacgccuacauggaaucggaaagagcugcucgucaccuuuaagaacgcucacgcgaaaaagcaagaaguggucgugcuggggucucaggagggagccaugcacacagcucugaccggcgccaccgaaauccaaaauuccgggggcacaagcauuuucgccggacaucucaagugucgccugaaaauggacaaacuugagcugaaaggcaugucuuacgcuaugugcacgaacaccuuuguucucaagaaagagguguccgaaacacagcacgggaccauccugaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccuuaaaaucaauugguauaagaagggaucuagcauuggcaaaauguuugaagccacagcuagaggggcuagacgcauggcuauccucggagacaccgccugggauuucggcuccgucgggggaguucugaacagccugggcaagaugguccaccagauuuuugggucugcguacaccgcccucuucuccggcgugagcugggugaugaaaaucggaauuggcguccugcuuacauggaucgggcucaauucuaagaacaccagcauguccuuuucuugcauugcuaucggaaucauuacacucuaucugggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuugcgaccgccaucgcuggcgccugggagaauggaguuuguggcauuagaagcacaacccgcauggaaaaccuccuguggaaacagaucgcuaaugagcugaacuauauccucugggaaaauaacauuaagcugacgguggucgugggggacaucauuggaguucuugagcagggcaaacggacccugacaccucagcccauggagcucaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcugaaacugcgcgaaguuuacacacagcuuugugaccaccggcucaugagcgcggccgugaaggaugagagagcugugcacgccgacaugggguacuggauugagucccagaaaaacggaucuuggaagcuggaaaaagccagccugaucgaggucaagaccugcaccuggccuaagucccauacacucuggucuaauggcgugcuggaaagcgauaugauuauccccaaaucccuugcugggccuauuagccagcacaaccaucgccccggauaucacacccaaacggccggcccuuggcaccuggggaagcucgagcuggacuuuaauuacugcgagggaacaaccguugugaucacagaaaacuguggcacccggggccccucucugagaacaaccacggucuccgggaaacuuauccaugaguggugcugucgcagcugcacccucccgccucugcgguauaugggagaagauggcuguugguacgggauggagauuagacccaucucugaaaaggaggagaauauggugaaaucccugguuagcgcgggaucuggcaagguggacaacuucacaauggggguccucugccuggcuauucuuuuugaagaggugaugcggggaaaguucggcaaaaagcacaugaucgccggcguuuucuuuaccuucgugcugcuccugagcgggcagauuacauggcgcgauauggcccauacccugaucaugauuggauccaaugcuagcgacagaaugggcaugggggucacguaucuugcccugaucgcgacauuuaaaauccagcccuuccucgcucugggauuuuuccuccggagacugaccucucgcgaaaaccuucugcucggcguggggcuggccauggccacaacccugcaacuuccugaggauauugaacagauggcuaauggaaucgcccugggccucauggcucugaagcucauuacccaguuugagacauaccagcuguggacggcccuuaucucccugaccuguagcaacacaauuuucacccucacaguggcguggcggaccgccacgcugauccuggcuggcgucucccuucugccgguuugcagaucuagcuccaugcgcaaaacagacuggcuccccauggccguggcugccaugggggugccuccccugccucucuuuaucuucucucugaaggauacccuuaagagacggagcuggccccugaaugagggagucauggccgugggccugguuuccauucucgcuucuagccugcuucgcaacgacgugccuauggcggggccccuggucgccggaggccuccugaucgcuuguuaugugauuaccgggacauccgccgaucucaccguugaaaaagccgcugacaucacaugggaggaagaggccgaacaaacgggagugagccacaaccugaugauuaccgucgacgaugacggcacaaugagaaucaaggaugacgagaccgagaauauccuuacagugcugcugaaaaccgcgcuccugauugucucuggcaucuuuccguacuccauuccugcuacgcuucugguguggcauaccuggcagaagcagacacagcggagcgggguucucugggaugugcccucuccucccgaaacccaaaaagccgagcuggaagagggagucuaccgcaucaagcagcagggcauuuucgggaaaacacaggugggaguuggcgugcaaaaggagggggucuuucacaccauguggcacgugacaagaggagccgugcucacguauaacggcaagcggcuggaaccgaauugggcuuccguuaaaaaggaccuuaucagcuacggcgggggauggcgccugucugcccaguggcagaaaggcgaggaaguccaagugauugcgguggagccugggaagaaccccaaaaauuuccagaccaugccuggaacauuccagaccaccacaggcgaaaucggggcuaucgcccuggauuuuaagcccggaacguccggcagccccauuaucaacagagagggcaaggucguggggcucuauggaaauggcguugugaccaaaaacgggggauacgucuccggcauugcccagacaaaugcugagccugacgggccgacccccgaacuggaggaagagauguucaagaaacggaaccuuacaaucauggaucugcauccuggcagcggaaagacccgcaaauaucuccccgccauugugagagaagcuaucaagcggagacugcgcacgcucauccuggccccuacacggguuguggcggccgagauggaggaagcucuuaagggccugcccauuagauaccaaaccaccgccacaaaaucugagcacaccgggcgcgaaaucgucgaccugaugugccaugcuacauuuaccaugcggcuccugagcccugugagaguuccgaauuauaaccuuauuaucauggaugaggcccacuucacggaccccgccuccauugcugcgcgcggauacaucucuacacgggugggcaugggggaagccgcugccaucuuuaugaccgccacaccucccggaaccgcugaugccuucccucagagcaaugcgcccauucaggacgaggagagagacaucccggaacgcuccuggaacucuggcaaugaguggauuacggauuuugcugggaagaccgucugguucgugccuagcaucaaagccggcaacgacauugccaacugucugcggaagaauggcaaaaaggugauccagcucuccagaaagacauuugauaccgaauaccagaagacgaagcugaacgacugggauuucgucguuaccacagacauuucugagaugggagcuaauuuuaaagccgaucgggugaucgacccccgcagaugccugaagcccgugauccucaccgaugggccugagcgggucauucuugcgggacccaugccugugacggccgcuagcgccgcucagcgcagaggccggguugggagaaacccgcagaaagaaaaugaccaguauaucuucacaggacaaccccugaacaaugaugaggaccaugcccacuggaccgaagcuaagaugcugcucgacaacauuaauaccccugagggcaucauucccgcccuguucgaaccugagcgcgagaaguccgcggccaucgauggggaauaccggcuuaaaggcgagagcagaaagacauuuguggaacugaugcgccggggagaccuccccgucuggcuggcucacaaaguggccucugagggcaucaaguauaccgauagaaaauggugcuucgacgggcagcgcaacaaucagauucuggaagagaacauggauguugagaucuggacaaaggaaggagagaaaaagaagcuccggccgagauggcuugacgcucgcacguacuccgauccucuggcccugaaagaauuuaaggaguucgccgcuggcagaaaaagcauugcgcucgaccuggugaccgaaaucgggcggguccccucucaucuugcccaccgcacaagaaaugcucuggauaaccucgugaugcugcauaccuccgagcacggaggccgggccuaucgccacgccgucgaggaacugccugagacaauggaaacccuccuucugcugggccucaugauucugcuuacagggggagcuaugcuguuucucaucagcggcaaggggaucggaaaaaccuccauuggccugaucugugugauugccucuagcgggaugcuguggauggcggagaucccccuccaguggauugccuccgcuaucguucuugaguucuuuaugauggugcugcugauuccugaacccgagaagcaaagaacaccgcaggacaaucagcucgccuacguggucaucggaauccugacccuugcugccauuaucgcggccaacgaaaugggccugcucgagacaaccaagcgggaucugggcaugagcaaagaaccugggguugugucucccacguccuaucuggacguggaucuccaucccgcuagcgccuggacacuuuacgcugucgccaccacagugauuaccccuaugcugagacacaccaucgaaaauucuacagcuaacguuagccuggccgcgauugccaaccaagcugugguccucaugggacuggacaagggcuggccgaucuccaaaauggaccuuggggugccccugcucgcccugggaugcuacucucaggucaauccucugacgcucaccgcugccgugcuucugcugaucacacauuaugccauuaucggccccgggcuccaggcgaaggcuacccgcgaggcccagaaacggacagcugccggaauuaugaagaacccuaccguugauggcaucaugacgauugaccuggaucccgugaucuacgacagcaaguucgaaaaacaacuuggccaggucaugcugcucgugcugugugccguucagcugcuccuuaugagaacauccugggcucugugcgaggcccugacccucgcgaccgggccuaucacaacccugugggaaggaucuccgggcaaguuuuggaauacaacgauugccgugagcauggcuaacaucuuccgcggguccuaucuugccggagcuggccuggccuuuagcauuaugaaaucugucgggaccggaaagcggggcacaggcucccagggggagacccucggagaaaaauggaagagaaagcugaaucaacugagccggaaagauuucgaccucuacaagaaauccggcaucacagagguggaucgcaccgaggcgaaggaagggcuuaaaagaggagagauuacgcaccaugccgugucucggggcagcgcuaagcugcagugguuuguugaacgcaacauggucacccccgaggggagagugaucgaccugggauguggccggggcgggugguccuauuacugcgccggacucaaaaaggugacagaaguccgcggcuauaccaaagggggaccuggccacgaggagcccguuccuaugucuacauacggguggaauauugugaaacugaugagcggaaaggauguguucuaccuucccccggaaaaaugugacacccugcucugcgauaucggcgaguccagcccuucucccacagucgaagaguccagaaccauccgggugcugaagaugguugagcccuggcugaaaaacaaucaguucuguauuaaggugcucaacccuuauaugcccacggucaucgaacaccuugagcgccugcagagaaagcauggcgggaugcuggugcggaauccucucagcagaaacucuacacacgaaauguacuggauuuccaauggaaccggcaacaucguugcuagcgugaauauggucucucgccugcuucugaaccgguuuaccaugacacauagacgcccgacgauugagaaagacguggaucucggggccggaacccggcacgugaacgcugaacccgagacaccuaauauggacgucaucggcgagagaaucaagcgcauuaaagaagaacacaaccugaccuggcauuaugacgaugaaaaucccuacaagacaugggccuaucacgggagcuacgagguuaaagcgaccggauccgccucuagcaugaucaacggcguggugaagcugcucacaaagccuugggacgucgugcccaugguuacccaaauggcuaugacggauaccacaccguucggccagcagcggguguuuaaagaaaaggucgacaccagaacaccucgcuccaugcccgggacccggagagugaugggaauuacggccgaguggcuguggcgcacacuuggccggaauaaaaagccuagacugugcacccgcgaggaguucaccaagaagguuagaaccaacgcugccaugggggccguguuuacggaggaaaaucaaugggauagcgcgaaggcugccgucgaggacgaagauuucuggaaacucguggaccgggagcgcgagcugcauaaacuuggaaaauguggcuccugcguuuauaacaugauggggaagagagagaagaagcugggcgaguuuggaaaagccaagggcucucgggcuaucugguacauguggcucggggccagauaccuggaguucgaggcucugggauuucucaaugaggaucacugguucagccgggaaaacuccuauucuggcguggagggggaaggacugcauaaacuuggcuacauucugcgcgacaucagcaaaauccccgggggcgccauguaugcggaugacaccgccggaugggacacaagaauuaccgaggaugaccuccacaaugaagagaagaucacacagcagauggauccugagcaccggcagcuggcuaacgccauuuuuaaacuuaccuaccaaaauaaggucgugaaaguccagcgccccacaccgaccggcacggugauggacaucauuuccagaaaggaucagcgggggucuggacagguuggcacauaugggcugaacaccuucaccaauauggaagcucaaaucauccgccagauggagggagaaggcgugcucagcaaggccgaccuggagaacccucaucugcccgagaagaagauuacacaguggcucgagaccaaaggggucgagagacugaagcggauggcgaucuccggcgaugacugcguggugaaacccauugaugaccgcuuugccaacgcccuucuggcccucaaugauaugggaaagguuagaaaggacaucccucaguggcaaccgagcaaaggcuggcacgauuggcaacaggugcccuucuguucucaucacuuccacgaacugauuaugaaggacgggcggaaacuugucgugccuugccgcccccaggacgagcugaucggacgggcucggauuucccaaggcgccggguggagccucaaggaaacagcuugucugggaaaagccuacgcgcagauguggucucugauguauuuucaucgcagagaucuccggcuggccuccaacgcuaucugcagcgccguuccugugcacuggguccccacgucuagaaccacaugguccauccaugcccaccaucaguggaugaccacagaggacaugcuuaccguguggaaucgcgucuggauugaagauaacccuuggauggaggacaagacgcccgugaccacaugggagaauguuccguaccugggcaagcgggaagaucaauggugugggagccucaucggccugaccuccagagcuacaugggcccagaacauuccuaccgcgauccaacaggugcgcagccuuauuggaaaugaggaguuccuggacuacaugcccucuaugaaacgguuuagaaaggaggaggaaagcgagggcgcuaucugguga

SEQ ID NO: 20601 - RNA, 9873 nt, Artificial Sequence
  derived and/or modified CDS sequence (opt5) from DENV-3__JF937639__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugcccccuguaaaauuccuuucagcacagaggacggccaagggaaggcgcauaacggaagacugaucaccgcuaaucccgugguuacgaaaaaggaggaacccgugaacauugaggccgaaccuccguucggcgaguccaauaucgucauugggaucggcgauaacgcccugaaaaucaauugguauaagaagggaucuagcauuggcaaaauguuugaagcuacagcccggggggcuagacgcauggccauccuuggagacaccgcgugggauuucggcuccguggggggagugcucaacagccugggcaagaugguucaccagauuuuugggucugccuacaccgcucuguucuccggcgucagcugggugaugaaaaucggaauuggcgugcuccugacauggaucgggcuuaauucucggaacaccagcauguccuuuucuugcauugccaucggaaucauuacacuguaucucggcgcugucgugcaggccgacaugggguguguuaucaauuggaagggaaaagagcugaagugcggcagcgggauuuucgugacgaacgagguccauaccuggacagaacaguacaaguuucaagcggauucccccaaaagacuggccaccgcuaucgccggcgcuugggagaauggaguguguggcauucgcagcacaacccggauggaaaaccuucucuggaagcagaucgccaaugagcugaacuauauccugugggaaaauaacauuaaacucacgguuguggucggggacaucauuggagugcuggagcagggcaagagaacccuuacaccucagcccauggagcugaaauacucuuggaagaccugggggaaagccaagaucguuacagcugaaacccaaaacuccagcuucauuaucgauggaccuaauacacccgagugcccgucugugucccgcgcguggaacgucugggaaguggaggacuauggcuuuggcguguucaccacgaauaucuggcucaagcugcgggaagccuacacacagcugugugaccacagacuuaugagcgcugccgucaaagaugagcgcgccguucacgcugacaugggguacuggauugagucccagaagaacggaucuuggaaacucgaaaaggccagccugaucgaggugaaaaccugcaccuggccuaagucccauacaauuuggucuaauggcgugcuggaaagcgauaugaucauucccaagucccucgcggggccuaucagccagcacaaccaucggcccggauaucacacccaaacggcuggcccuuggcaccuggggaaacuugagcuggacuuuaauuacugcgagggaacaaccgucgugaucacagaaaacuguggcaccagaggccccucucuccgcacaaccacgguuuccgggaagcugauucaugaguggugcugucggagcugcacccugccgccucuuagauauaugggagaagauggcuguugguacgggauggagauccggcccauuucugaaaaagaggagaauauggugaagucccucgucagcgccggaucuggcaaaguggacaacuucacaauggggguucugugccuggccauccucuuugaagaggugaugcgcggaaaguucggcaagaaacacaugauugcuggcgucuuccugaccuuugugcuucugcucagcgggcagaucacauggagagauauggcccauacccugauuaugaucggauccaaugcgagcgaccggaugggcauggggguuacguaucuggcucuuaucgccacauucaagauucagcccuuucuggcccucggauucuuucugagaaaacucaccucucgcgaaaaccugcuucugggcguggggcucgcuauggccacaacccugcaacugccugaggauaucgaacagauggcuaauggaauugcccuuggccugauggcgcucaagcugaucacccaguucgagacauaccagcucuggacggcccugauuucccuuaccuguagcaacacaaucuuuacccugacagucgcuuggcggaccgccacgcucauccuggcuggcgugucccugcuuccggugugccaaucuagcuccaugagaaaaacagacuggcugcccauggccgucgccgcuauggggguuccuccccucccucuguucauuuuuucucucaaggauacccugaagcgcagaagcuggccccuuaaugagggagugauggcggugggccuggucuccauccuggccucuagccuccugcggaacgacgugccuauggcugggccccuuguugccggaggccugcucauugccuguuaugugaucaccgggacauccgcugaucugaccgucgaaaaagccgcggacauuacaugggaggaagaggcugaacagacgggagugagccacaaccucaugaucaccguugacgaugacggcacaaugcgcaucaaggaugacgagaccgagaauauucugacagugcuucugaaaaccgcccugcucaucgucucuggcauuuucccguacuccaucccugccacgcugcuuguguggcauaccuggcagaagcagacaaaaagaagcgggguccugugggaugugcccucuccucccgaaacccaaaaggcugagcucgaagagggaguuuaccggauuaaacagcagggcaucuuugggaagacacaggugggagucggcgugcaaaaggaggggguuuuccacaccauguggcacgugacacgcggagccguccugacguauaacggcaaaagacucgaaccgaauugggcguccgugaagaaagaccugauuagcuacggcgggggauggcggcuuucugcucaguggcagaagggcgaggaagugcaaguuaucgccgucgagccugggaaaaaccccaagaauuuucagaccaugccuggaacauuccagaccaccacaggcgaaaucggggccauugcucuggauuucaagcccggaacguccggcagccccaucauuaaccgcgagggcaaagugguggggcuguauggaaauggcgucgugaccaagaacgggggauacguuuccggcaucgcccagacaaaugcugagccugacgggccgacccccgaacucgaggaagagauguuuaaaaagagaaaccugacaauuauggaucuucauccuggcagcggaaaaacccggaaguaucugcccgccaucgugcgcgaagcgaucaagagacggcucagaacgcugauucucgccccuacacgcgucguggcugccgagauggaggaagcucugaaaggccuucccauccgguaccaaaccaccgccacaaagucugagcacaccgggagagaaauuguugaccugaugugccaugccacauucaccaugcgccugcucagcccugugcgggucccgaauuauaaccugaucauuauggaugaggcucacuuuacggaccccgcguccaucgccgcuagaggauacaucucuacacgcgugggcaugggggaagccgccgcuauuuucaugaccgccacaccucccggaaccgcggaugcuuuuccucagagcaaugcccccauccaggacgaggagcgggacauuccggaaagauccuggaacucuggcaaugaguggaucacggauuucgccgggaaaaccguuugguuugugccuagcauuaaggcuggcaacgacaucgccaacugucuucgcaaaaauggaaagaaggucauucagcugucccggaaaacauucgauaccgaauaccaaaagacaaaacucaacgacugggauuuuguggugaccacagacaucucugagaugggcgcgaauuucaaggccgauagagucaucgacccccggcgcugccugaaacccguuauucugaccgaugggccugagagagugauccucgcuggacccaugccugugacggccgcuagcgccgcucagcggcgcggcagagucgggcggaacccgcagaaggaaaaugaccaguauauuuuuacaggacaaccccuuaacaaugaugaggaccaugcccacuggaccgaagcgaagaugcugcuggacaacaucaauaccccugagggcauuauccccgcccucuucgaaccugagagagagaaauccgcugccaucgauggggaauaccgccugaagggcgagagccggaaaacauucguggaacuuaugagacgcggagaccugcccguuuggcucgcucacaagguggccucugagggcauuaaauauaccgaucggaaguggugcuuugacgggcagagaaacaaucagauccuggaagagaacauggaugucgagauuuggacaaaagaaggagagaagaagaaacugcgcccgcgguggcucgacgccagaacguacuccgauccucuugcucugaaggaauucaaagaguuugcggccggccgcaagagcaucgcucuggaccucgugaccgaaauugggagaguucccucucaucuggcccaccggacacgcaaugcccuugauaaccuggugaugcuccauaccuccgagcacggaggcagagcuuaucggcacgccgucgaggaacugccugagacaauggaaacccugcuccuucugggccugaugauccuccugacggggggagcgaugcuuuuccugaucagcggcaaagggauuggaaagaccuccaucggccucauuugugugaucgccucuagcgggaugcuguggauggcugagauuccccugcaguggaucgccuccgcuauuguccucgaguuuuucaugauggugcuucugaucccugaacccgagaagcaacgcacaccgcaggacaaucagcuggccuacguugugaucggaauucucacccuggcggccaucauugcugccaacgaaaugggccuucuggagacaaccaaaagagaucucggcaugagcaaggaaccugggguggucucucccacguccuaucuggacguugaucugcaucccgcuagcgccuggacacucuacgcuguggccaccacagugaucaccccuaugcuucggcacaccauugagaauucuacagcgaacgucagccuggccgcuaucgccaaccaagcugugguucugaugggacucgacaaaggcuggccgaucuccaagauggaccugggggugccccuucuggcccucggaugcuacucucaggucaauccucugacgcugaccgccgcggugcuccuucugauuacacauuaugcuaucauuggccccgggcugcaggccaaagcuaccagagaggcccagaagcgcacagccgcuggaaucaugaagaacccuaccgucgauggcauuaugacgaucgaccucgaucccgugaucuacgacagcaaauuugaaaagcaacugggccagguuaugcuucuggugcucugugccguccagcugcugcucaugcggacauccugggcgcuuugcgaggcccugacccuggcuaccgggccuauuacaacccucugggaaggaucuccgggcaaauucuggaauacaacgaucgccgugagcauggcuaacauuuuuagaggguccuaucuggccggagcgggccuugccuucagcaucaugaagucuguugggaccggaaaacgcggcacaggcucccagggggagacccugggagaaaaguggaagaaaaagcucaaucaacugagccggaaagauuuugaccuguacaagaaauccggcauuacagagguggauagaaccgaggcuaaggaagggcucaaacggggagagaucacgcaccaugccgucucucgcggcagcgcuaagcuucagugguucguggaaagaaacauggugauucccgaggggcggguuaucgaccugggauguggccgcggcgggugguccuauuacugcgccggacugaagaaagucaccgaagugagaggcuauacaaaggggggaccuggccacgaggagcccgugccuaugucuaccuacggguggaauaucgucaaacucaugagcggaaaggauguuuuuuaccugcccccggaaaaaugugacacacuucugugcgauauuggcgaguccagcccuucucccaccguggaagagucccggacaauccgcgugcucaagauggucgagcccuggcugaagaacaaucaguucuguauuaaagugcugaacccuuauaugcccaccguuaucgaacaccucgagagacuucagcggaagcauggcgggaugcuggugcgcaauccucugagcagaaacucuacgcacgaaauguacuggauuuccaauggaacaggcaacaucgucgcuagcgugaauaugguuucucggcuccugcuuaacagauucaccaugacccaucgccggccgacaaucgagaaagacguggaucugggggccggaacgagacacgucaacgcggaacccgagaccccuaauauggacgugauuggcgagcgcaucaagcggauuaaagaagagcacaacagcacauggcauuaugacgaugaaaaucccuacaagaccugggccuaucacggguccuacgaggugaaggcuacaggaucugccagcuccaugaucaacggcgucguuaaacuccugaccaagccuugggacguggugcccauggucacacaaauggcuaugaccgauacgaccccguuuggccagcagagaguguucaaagaaaagguugacacacgcaccccucggagcaugcccgggacaagacgcgugaugggaauuaccgccgaguggcuguggcggacgcucggcagaaauaaaaagccucgccugugcacacgggaggaauuuaccaagaaagucagaacaaacgccgcgaugggggcuguguucaccgaggaaaaucaaugggauuccgccaaggccgcuguugaggacgaagauuuuuggaaacuuguggaccgcgagagagagcugcauaagcucggaaaauguggcucuugcgucuauaacaugauggggaagcgggaaaaaaagcugggcgaguucggaaaggccaaaggcagccgcgcuaucugguacauguggcuuggggccagauaccuggaauuugaggcgcucggauuccugaaugaggaucacugguuuucccgggaaaacucuuauagcggcguggagggggaaggacugcauaagcucggcuacauccugagagacauuuccaaaauccccgggggcgccauguaugcugaugacacggccggaugggacacccggauuacagaggaugaccuucacaaugaagagaagaucacccagcagauggauccugagcaccgccagcuggcuaacgccauuuucaaacucacauaccaaaauaagguugugaagguccagagacccaccccgacaggcaccgugauggacaucaucucucggaaagaucagcgcgggagcggacaggucggcacguaugggcugaacacauuuaccaauauggaagcgcaacuuauuagacagauggagggagaaggcgugcuguccaaggccgaccucgagaacccucaucugcccgaaaaaaagaucacccaguggcuggagacaaaagggguugagcggcucaagcgcauggcuauuagcggcgaugacugcguggucaagcccaucgaugacagauucgccaacgcucugcuugcccugaaugauaugggaaaagugcggaaggacauuccucaguggcaaccgucuaaaggcuggcacgauuggcagcaggugcccuuuuguucccaucacuuccacgaacucaucaugaaggacgggcgcaaacugguugugccuugcagaccccaggacgagcuuauuggacgggcucgcaucagccaaggcgccggguggucucugaaggaaaccgcgugucucggaaaggccuacgcucagauguggucccugauguauuuccauagacgggaucugcgccucgccagcaacgccaucugcucugcugucccugugcacuggguucccacauccagaacgaccuggagcauucaugcccaccaucaguggaugacaaccgaggacaugcugacaguguggaaucgggucuggaucgaagauaacccuuggauggaggacaaaacccccgugacgaccugggagaaugucccguaccuuggcaagagagaagaucaauggugugggucccugauuggccucacaagccgcgcgaccugggcucagaacaucccuacagccauucagcaggugcggucucugaucggaaaugaggaauuucuugacuacaugcccagcaugaaaagauuccgcaaggaggaggaauccgagggcgccaucugguga

SEQ ID NO: 20602 - RNA, 9873 nt, Artificial Sequence
  derived and/or modified CDS sequence (opt5) from DENV-3__JF937627__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccagaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaacgggaggaacccgucaacauugaggcugaaccuccguucggcgaguccaauaucgugauugggaucggcgauaacgcccugaagaucaauugguacaaaaagggaucuagcauuggcaagauguuugaagccacagcuagaggggcccgccggauggcuauccuuggagacaccgccugggauuucggcuccguggggggaguucucaacagccugggcaaaaugguccaucagauuuuugggucugcguauaccgcccuguucuccggcgugagcugggugaugaagaucggaauuggcguccuccugacauggaucgggcuuaauucuaaaaacaccagcauguccuuuucuugcauugcuaucggaaucauuacacuguaccucggcgccgugguucaggcugacauggggugugugaucaauuggaagggaaaagagcugaagugcggcagcgggauuuucgucacgaacgaggugcacaccuggacagaacaguauaaguuucaagccgauucccccaaaagacuggcgaccgccaucgcuggcgccugggagaauggaguuuguggcauucgcagcacaacccggauggaaaaccuucucuggaagcagaucgcuaaugagcugaacuacauccugugggaaaauaacauuaaacucacgguggucgugggggacaucauuggaguucuggagcagggcaagagaacccuuacaccucagcccauggagcugaaauauucuuggaagaccugggggaaagccaagaucgugacagccgaaacccaaaacuccagcuucauuaucgauggaccuaauacacccgagugcccgucugucucccgcgcuuggaacgugugggaaguggaggacuacggcuuuggcgucuucaccacgaauaucuggcucaagcugcgggaaguuuauacacagcugugugaccacagacuuaugagcgcggccgugaaagaugagcgcgcugugcaugccgacaugggguacuggauugagucccagaagaacggaucuuggaaacucgaaaaggccagccugaucgaggucaaaaccugcaccuggccuaagucccacacacuguggucuaauggcgugcucgaaagcgauaugauuauccccaagucccuggcugggccuauuagccagcauaaccaccggcccggauaccacacccaaacggccggcccuuggcaucuugggaaacuggagcucgacuuuaauuauugcgagggaacaaccguugugaucacagaaaacuguggcaccagaggccccucucugcgcacaaccacggucuccgggaagcugauccacgaguggugcugucggagcugcacccuuccgccucucagauacaugggagaagauggcuguugguaugggauggagauucggcccaucucugaaaaagaggagaauauggugaagucccugguuagcgcgggaucuggcaaaguggacaacuucacaauggggguccugugccucgcuauucuguuugaagaggugaugcgcggaaaguucggcaagaaacauaugaucgccggcguuuucuuuaccuucgugcuucugcucagcgggcagauuacauggagagauauggcccacacccugaucaugauuggauccaaugcuagcgaccggaugggcaugggggucacguaccuggcccuuaucgcgacauuuaagauccagcccuuccuggcucucggauuuuuccugagaaaacucaccucucgcgaaaaccugcuucugggcguggggcucgccauggccacaacccugcaacugccugaggauauugaacagauggcuaauggaaucgcccuuggccugauggcucucaagcugauuacccaguuugagaucuaucagcucuggacagcccugauuucccuuacguguagcaacaccaucuucacacugaccguggcguggcggacagccacccucauccuggcuggcgucucccugcuuccgaugugccaaucuagcuccaugagaaaaacggacuggcugcccauggccguugcugccaugggggugccuccccucccucuguuuauuuucucucucaaggauacacugaagcgcagaagcuggccccuuaaugagggagugauggccgucggccugguguccauccuggcuucuagccuccugcggaacgacguuccuauggcggggccccuuguggccggaggccugcucauugcuuguuacgucaucaccgggaccuccgccgaucugacaguggaaaaagccgcugacauuaccugggaggaagaggccgaacagacaggaguuagccauaaccucaugaucacgguggacgaugacggcaccaugcgcaucaaggaugacgagacagagaauauucugaccguccuucugaaaacagcgcugcucaucgugucuggcauuuuuccguauuccaucccugcuacccugcuugucuggcacacguggcagaagcagacccaaagaagcggggugcugugggauguucccucuccucccgaaacacagaaagccgagcucgaagagggaguguaccggauuaagcagcagggcaucuucgggaaaacccaagucggagugggcguucagaaggaggggguguuucacacaauguggcaugucacccgcggagccgugcugacauacaacggcaagagacucgaaccgaauugggcuuccgugaaaaaggaccugauuagcuauggcgggggauggcggcuuucugcccaguggcaaaaaggcgaggaaguucaggucaucgcgguggagccugggaagaaccccaaaaauuuccagacgaugccuggaaccuuccagacaaccaccggcgaaaucggggcuauugcccuggauuuuaagcccggaacauccggcagccccaucauuaaccgcgagggcaagguggucgggcuguacggaaauggcgugguuacgaaaaacgggggauauguguccggcaucgcccaaaccaaugcugagccugacgggccgacacccgaacucgaggaagagauguucaagaaaagaaaccugaccauuauggaucuucacccuggcagcggaaagacacggaaauaccugcccgccaucguccgcgaagcuaucaagagacggcucagaacccugauucucgccccuacgcgcgugguugcggccgagauggaggaagcucugaagggccuucccauccgguaucagacaaccgccaccaaaucugagcauacagggagagaaauuguggaccugaugugccacgcuaccuuuacaaugcgccugcucagcccuguccgggugccgaauuacaaccugaucauuauggaugaggcccauuucaccgaccccgccuccaucgcugcgagaggauauaucucuacgcgcguuggcaugggggaagccgcugccauuuuuaugacagccaccccucccggaacagcugaugccuucccucagagcaaugcgcccauccaggacgaggagcgggacauuccggaaagauccuggaacucuggcaaugaguggaucaccgauuuugcugggaagacggugugguucgucccuagcauuaaagccggcaacgacaucgccaacugucuucgcaagaauggaaaaaaggugauucaacugucccggaagaccuuugauacagaauaccagaaaaccaagcucaacgacugggauuucguggucacaaccgacaucucugagaugggcgcuaauuuuaaagccgauagaguuaucgacccccggcgcugccugaagcccgugauucugacagaugggccugagagagugauccucgcgggacccaugccugucaccgccgcuagcgccgcucagcggcgcggcagaguggggcggaacccgcagaaagaaaaugaccaauacauuuucacgggacagccccuuaacaaugaugaggaccacgcccacuggacagaagcuaagaugcugcuggacaacaucaauaccccugagggcauuauccccgcccucuucgaaccugagagagagaaguccgcggccaucgauggggaauaucgccugaaaggcgagagccggaagaccuuuguugaacuuaugagacgcggagaccugcccguguggcucgcucauaaagucgccucugagggcauuaaguacacagaucggaaauggugcuucgacgggcagagaaacaaucagauccuggaagagaacauggauguggagauuuggaccaaggaaggagagaaaaagaagcugcgcccgcgguggcucgacgcuagaacauauuccgauccucuugcccugaaagaauuuaaggaguucgccgcuggccgcaaaagcaucgcgcuggaccucguuacggaaauugggagagugcccucucaccuggcccaucggacccgcaaugcucuugauaaccuggucaugcuccacacauccgagcacggaggcagagccuaccggcaugccguggaggaacugccugagaccauggaaacacugcuccuucugggccugaugauccuccugaccgggggagcuaugcuuuuucugaucagcggcaaggggauuggaaaaacguccaucggccucauuugugucaucgccucuagcgggaugcuguggauggcggagauuccccugcaauggaucgccuccgcuauugugcucgaguucuuuaugaugguucuucugaucccugaacccgagaagcagcgcaccccgcaggacaaucaacuggccuauguggugaucggaauucucacacuggcugccaucauugcggccaacgaaaugggccuucuggagaccacaaagagagaucucggcaugagcaaagaaccuggggucguuucucccaccuccuaccuggacguggaucugcaccccgcuagcgccuggacgcucuaugcuguggccacaaccgucaucacaccuaugcuucggcauaccauugagaauucuaccgcuaacgugagccuggccgcgaucgccaaccaggcuguugugcugaugggacucgacaagggcuggccgaucuccaaaauggaccugggggucccccuucuggcccucggaugcuacucucaggugaauccucugacacugacggcugccguccuccuucugauuacccacuacgccaucauuggccccgggcugcaggcgaaggcuacaagagaggcccaaaaacgcaccgcugccggaaucaugaagaacccuacaguggauggcauuaugaccaucgaccucgaucccguuaucuaugacagcaaguucgaaaaacagcugggccaggugaugcuucugguccucugugugguucagcugcugcucaugcggacguccugggcccuuugcgaggcucugacacuggccaccgggccuauuaccacacucugggaaggaucuccgggcaaguuuuggaauaccacaaucgcggugagcauggccaacauuuucagaggguccuaccuggcuggagccggccuugcuuuuagcaucaugaaaucugucgggacgggaaagcgcggcaccggcucccaaggggagacacugggagaaaaauggaagaagaaacucaaucagcugagccggaaggauuucgaccuguauaaaaaguccggcauuaccgagguggauagaacagaggccaaagaagggcucaagcggggagagaucacccaucacgcggugucucgcggcagcgccaaacuucagugguuuguugaaagaaacauggucauucccgaggggcgggugaucgaccugggauguggccgcggcgggugguccuacuauugcgcuggacugaagaaggugacggaagucagaggcuacaccaaagggggaccuggccacgaggagcccguuccuaugucuacauauggguggaauaucgugaagcucaugagcggaaaagauguguucuaccugcccccggaaaagugugacacccuucugugcgauauuggcgaguccagcccuucucccacagucgaagagucccggaccauccgcgugcucaaaaugguugagcccuggcugaagaacaaucaguucuguauuaaggugcugaacccuuacaugcccacagucaucgaacaucucgagagacuucaacggaaacacggcgggaugcuggugcgcaauccucugagcagaaacucuacccaugaaauguauuggauuuccaauggaacgggcaacaucguugccagcgugaauauggucucucggcuccugcuuaacagauuuacaaugacccaccgccggccgaccaucgagaaggacguggaucugggggcuggaacaagacacgugaacgccgaacccgagacgccuaauauggacauuaucggcgagcgcauuaaacggaucaaggaagagcauaacagcaccuggcacuacgacgaugaaaaucccuauaaaacaugggcuuaccauggguccuaugaggucaaggccaccggaucugcgagcuccaugauuaacggcguugugaagcuccugacaaaaccuugggacgugguccccauggugacccagauggccaugacagauaccacgccguucggccagcaaagaguuuuuaaggaaaaaguggacacccgcacaccucggagcaugcccgggaccagacgcgucaugggaaucacagcugaguggcuguggcggacccucggcagaaauaagaaaccucgccugugcacgcgggaggaauucacaaagaaggugagaaccaacgccgcuaugggggccguuuuuacagaggaaaaucagugggauuccgccaaagcggcuguggaggacgaagauuucuggaagcuugucaacaaagagcgcgagcugcacaagcucggaaaauguggcucuugcguguacaauaugauggggaagagagaaaaaaagcugggcgaguuuggaaaggccaaaggcagccgggccaucugguauauguggcuuggggcucgcuaccuggaauucgaggcccucggauuucugaacgaggaccauugguucuccagagaaaauucuuacagcggcguugagggggaaggacugcacaagcucggcuauauucugcgggauaucuccaaaauucccgggggcgcuauguacgccgacgauaccgcgggaugggacacgagaaucaccgaggacgaucuucacaacgaagagaagauuacacagcagauggacccugagcaucggcaacuggccaaugcuaucuuuaaacucaccuaucagaacaagguggucaaggugcagcgccccacaccgaccggcacagucauggauaucauuucuagaaaagaccagcgggggagcggacaagugggcaccuacgggcugaauacguucacaaacauggaagcccagcuuauccgccagauggagggagaaggcguucuguccaaggcugaucucgagaacccucaccugcccgaaaaaaagauuacccaguggcuggagaccaaagggguggagagacucaagcggauggccaucagcggcgacgauugcgucgugaagcccauugacgaucgcuuugcgaaugcccugcuugcucugaacgacaugggaaaagugagaaaggauaucccucaauggcagccgucuaaaggcuggcaugacuggcagcagguucccuucuguucccaccacuuccaugaacucauuaugaaggaugggcggaaacugguggucccuugccgcccccaagacgagcuuaucggaagagcccggaucagccagggcgcuggguggucucugaaggaaacagccugucucggaaaggcuuaugcccagauguggucccugauguacuuucaccgcagagaccugcggcucgcgagcaaugccauuugcucugcugugccuguucauugggugcccaccucccgcacaacguggagcauccacgcccaucaccaauggaugaccacagaggauaugcugaccgucuggaacagaguguggauugaagacaauccuuggauggaggauaaaacacccgucaccacgugggagaacgugccguaucuuggcaagcgggaagaccaguggugugggucccugaucggccucaccagcagagccacaugggcucagaauauuccuaccgccauccagcaaguucgcucucugaucggaaacgaggaauuccuugauuacaugcccagcaugaaacgguuuagaaaggaggaggaauccgagggcgcgauuugguga

SEQ ID NO: 20603 - RNA, 9873 nt, Artificial Sequence
  derived and/or modified CDS sequence (opt5) from DENV-3__KF973476__SS-prME
accagccugugccucaugaugauccugcccgccgcucuugccuuccaccugacaucccgggacggcgagccucggaugauuguggggaagaacgaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucggcgggguucucaacagccuggggaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauauuggagaagauggcuguugguacgggauggagaucagacccauuucugaaaaggaggagaauauggugaaaucccugguuagcgcgggaucuggcaagguggacaacuucacaauggggguccugugccucgcuauccuguuugaagaggugaugcggggaaaguucggcaaaaagcacaugauugccggcguuuucuuuaccuucgugcuucugcucagcgggcagaucacauggcgcgauauggcccauacccugauuaugaucggauccaaugcuagcgacagaaugggcaugggggucacguaucuggcccuuaucgcgacauuuaaaauucagcccuuccuggcucucggauuuuuccugcggagacucaccucucgcgaaaaccugcuucugggcguggggcucgccauggccacaacccugcaacugccugaggauaucgaacagauggcuaauggaauugcccuuggccugauggcucucaagcugaucacccaguuugagacauaccagcucuggacggcccugauuucccuuaccuguagcaacacaaucuucacccugacaguggcguggcggaccgccacgcucauccuggcuggcgucucccugcuuccgguuugccaaucuagcuccaugagaaaaacagacuggcugcccauggccguggcugccaugggggugccuccccucccucuguuuauuuucucucucaaggauacccugaagcgcagaagcuggccccuuaaugagggagucauggccgugggccugguuuccauccuggcuucuagccuccugcggaacgacgugccuauggcggggccccuugucgccggaggccugcucauugcuuguuaugugaucaccgggacauccgccgaucugaccguugaaaaagccgcugacauuacaugggaggaagaggccgaacagacgggagugagccacaaccucaugaucaccgucgacgaugacggcacaaugcgcaucaaggaugacgagaccgagaauauucugacagugcuucugaaaaccgcgcugcucaucgucucuggcauuuuuccguacuccaucccugcuacgcugcuuguguggcauaccuggcagaagcagacacaaagaagcgggguucugugggaugugcccucuccucccgaaacccagaaagccgagcucgaagagggagucuaccggauuaagcagcagggcaucuucgggaaaacacaagugggaguuggcgugcagaaggagggggucuuucacaccauguggcacgugacacgcggagccgugcugacguauaacggcaagagacucgaaccgaauugggcuuccguuaaaaaggaccugauuagcuacggcgggggauggcggcuuucugcccaguggcaaaaaggcgaggaaguccaggugaucgcgguggagccugggaagaaccccaaaaauuuccagaccaugccuggaacauuccagaccaccacaggcgaaaucggggcuauugcccuggauuuuaagcccggaacguccggcagccccaucauuaaccgcggcgggaaggucgugggacuguauggcaaugggguugugaccaaaaacggaggcuacgucuccgggaucgcccaaacaaaugcugagccugacggcccgacccccgagcucgaagaggaaauguucaagaaaagaaaccugacaauuauggaucuucauccuggaagcggcaagacccggaaauaucugcccgccaucgugcgcgaggcuaucacgagacggcucagaacacugauucucgccccuacccgcguuguggcggccgaaauggaggaggcucugaaggggcuucccauccgguaccagaccacagccaccaagucugaacacacaggaagagagauugucgaccugaugugccaugcuaccuuuacgaugcgccugcucagcccugugcggguuccgaauuauaaccugaucauuauggaugaagcccacuucacagaccccgccuccaucgcugcgagaggcuacaucucuacccgcguggggaugggagaggccgcugccauuuuuaugacagccaccccucccggcacggcugaugccuucccucagagcaaugcgcccauccaggacgaagaacgggacauuccggagagauccuggaacucugggaaugaauggaucaccgauuuugcuggcaaaacagucugguucgugccuagcauuaaggccggaaacgacaucgccaacugucuucgcaaaaauggcaagaaagugauucaacugucccggaagaccuuugauacagaguaccagaagaccaaacucaacgacugggauuucgucguuacaaccgacaucucugaaaugggggcuaauuuuaaggccgauagagugaucgacccccggcgcugccugaaacccgugauucugacggauggaccugagagagucauccucgcgggccccaugccugugacagccgcuagcgccgcucagcggcgcgggagaguuggacggaacccgcagaaggagaaugaccaauauauuuucaccggccagccccuuaacaaugaugaagaccaugcccacuggaccgaggcuaaaaugcugcuggacaacaucaauacaccugaagggauuauccccgcccucuucgagccugaaagagagaaguccgcggccguggauggcgaguaccgccugaagggagaaagccggaaaaccuuugucgagcuuaugagacgcggcgaccugcccguguggcucgcucacaagguugccucugaagggaucaaauauacagaucggaaguggugcuucgacggacagagaaacaaucagauucuggaggaaaacauggauguggagaucuggacgaaagagggcgaaaagaaaaagcugcgcccgcgguggcucgacgcuagaaccuacuccgauccucuugcccugaaggaguuuaaagaguucgccgcugggcgcaagagcauugcgcuggaccucgucacagagaucggaagagugcccucucaucuggcccaccggacccgcaaugcucuugauaaccuggucaugcuccauacauccgaacacggcggcagagccuaucggcacgccguggaggagcugccugaaaccauggagacgcugcuccuucuggggcugaugauucuccugaccggaggcgcuaugcuuuuucugaucagcgggaaaggaaucggcaagacauccauugggcucaucuguguuauugccucuagcggaaugcuguggauggcggaaaucccccugcaauggauugccuccgcuaucgugcucgaguucuuuaugauggugcuucugauuccugagcccgaaaaacagcgcaccccgcaggacaaucaacuggccuacgucguuaucggcauccucacacuggcugccauuaucgcggccaacgagaugggccuucuggaaaccacgaagagagaucucgggaugagcaaggagccuggaguggugucucccacauccuaucuggacgucgaucugcaucccgcuagcgccuggacccucuacgcuguggccacaaccguuauuaccccuaugcuucggcacacaaucgaaaauucuacggcuaacgugagccuggccgcgauugccaaccaggcugucgugcugaugggccucgacaaaggguggccgaucuccaagauggaccugggagucccccuucuggcccucggcugcuacucucaggugaauccucugacccugacagcugccguucuccuucugaucacccauuaugccauuaucgggcccggacugcaggcgaaagcuacaagagaggcccaaaagcgcaccgcugccggcauuaugaaaaacccuacgguggauggcaucaugacaauugaccucgaucccgucaucuacgacagcaaguucgagaagcagcugggacaggugaugcuucugguucucugugccgugcagcugcugcucaugcggaccuccugggcucuuugcgaagcccugacccuggcgacaggaccuaucaccacacucugggagggcucuccggggaaauuuuggaauacgaccauugccgucagcauggcuaacaucuucagaggauccuaucuggccggcgcugggcuugccuuuagcauuaugaagucugugggaacaggcaaacgcggcaccgggucccaaggagaaacacugggcgagaaguggaaacggaagcucaaucagcugagcagaaaggauuucgaccuguacaaaaaguccgggaucaccgaaguggaucggacggaggcgaaagagggacucaagcgcggcgaaauuacccaccaugccguuucuagagggagcgcuaaacuucagugguuugucgagcggaacauggugauccccgaaggacgcgugauugaccugggcuguggcagagggggaugguccuauuacugcgccggccugaagaaagucacagagguucggggguauaccaagggaggcccugggcacgaagaacccgugccuaugucuacauacggauggaauaucgugaagcucaugagcggcaaagaugucuucuaccugcccccggagaagugugacacccuucugugcgauaucggcgaauccagcccuucucccacaguggaggaaucccgcaccauuagaguucucaaaaugguggagcccuggcugaagaacaaucaguucuguaucaaaguccugaacccuuauaugcccacggugauugagcaccucgaacggcuucaacgcaagcaugggggaaugcugguuagaaauccucugagccggaacucuacacacgagauguacuggaucuccaauggcaccgggaacauuguggcuagcgucaauauggugucuagacuccugcuuaaccgcuuuaccaugacacaucggagaccgacgaucgaaaaggacguggaucugggagccggcacccgccacgucaacgcugagcccgaaacaccuaauauggacguuaucggggagcggauuaaaagaaucaaggaggaacacaacagcaccuggcauuaugacgaugagaaucccuacaaaacaugggccuaucacggauccuacgaagugaaggcgaccggcucugccagcuccaugauuaacggcguggucaaacuccugacaaagccuugggacgugguucccauggugacccagauggcuaugacggauaccacaccguucgggcagcaacgcgucuuuaaggagaaaguggacacccggacaccuagaagcaugcccggaacccgccggguuaugggcaucacggccgaauggcuguggagaacacucgggcgcaauaagaaaccucggcugugcaccagagaggaguucacaaagaaagugcgcaccaacgcugccaugggagccgucuuuacggaagagaaucagugggauuccgcgaaggcugccguggaagacgaggauuucuggaaacuuguugacagagaacgggagcugcauaaacucggcaagugugggucuugcguguauaacaugaugggcaaacgcgagaagaaacugggagaauuuggcaaggccaaagggagcagagcuauuugguacauguggcuuggagcccgguaccuggaguucgaagcucucggcuuucugaaugaggaucacugguucuccagagagaacucuuauagcggggucgaaggagagggccugcauaagcucggguacauccugcgggacaucuccaagauucccggcggagccauguaugcggaugacaccgccggcugggacacacgcaucaccgaagaugaccuucacaaugaggagaagauuacacagcagauggauccugagcacagacaacuggcuaacgccaucuuuaagcucaccuaccagaauaaaguggucaaggugcagcggcccacaccgaccgggacgguuauggacauuaucucucgcaaagaucagagaggaagcggccaaguggggacauauggacugaacaccuucaccaauauggaggcucagcuuauccggcagauggaaggcgaggggguccuguccaaggccgaccucgaaaacccuuaccugcccgagaagaaaauuacacaguggcuggaaaccaagggcguggagcgccucaaaagaauggcgaucagcggagaugacugcgugguuaagcccauugaugaccgguuugccaacgcucugcuugcccugaaugauaugggcaaagugcgcaaggacaucccucaauggcagccgucuaagggguggcaugauuggcagcagguccccuucuguucccaccauuuccacgagcucauuaugaaagacggaagaaagcuggugguuccuugccggccccaagacgaacuuaucggccgcgcuagaauuagccagggggccggauggucucugaaagagacagcuugucucggcaaggccuaugcgcagauguggucccugauguacuuucaccggcgcgaucugagacucgccagcaacgcuaucugcucugccgugccuguccauugggugcccacgucccggaccacauggagcauccacgcccaucaccaauggaugaccacagaagacaugcugaccgucuggaauagaguguggauugaggauaacccuuggauggaagacaaaacgcccguuaccacaugggagaaugugccguaccuugggaagcgcgaggaucagugguguggcucccugaucggacucaccagccgggcuacaugggcccagaacauuccuaccgcgauccagcaagucagaucucugauuggcaaugaagaguuccuugacuauaugcccagcaugaagcgcuuucggaaagaagaggaguccgaaggggcuaucugguga

SEQ ID NO: 20604 - RNA, 9873 nt, Artificial Sequence
  derived and/or modified CDS sequence (opt5) from DENV-3__KF973478__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucagcaugaaaaucucaaguauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccucgcaccggacuggacuucaaugagaugauucuucugacaaugaaaaacaaggccuggauggugcacagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaagugucgccucaaaauggacaagcuggagcuuaaaggcaugucuuaugcuaugugcacgaacaccuuuguucugaagaaagagguguccgaaacacagcaugggaccauccucaucaaggucgaguacaagggagaagaugugcccuguaaaauuccuuucagcacagaggacggccaagggaaggcccacaacggaagacugaucaccgcgaaucccguugugacgaaaaaggaggaacccgucaacauugaggcugaaccuccguucggcgaguccaauaucgugauugggaucggcgauaacgcccugaaaaucaauugguacaagaagggaucuagcauuggcaaaauguuugaagccacagcuagaggggccagacgcauggcuauccuuggagacaccgccugggauuucggcuccgucgggggaguucucaacagccugggcaagaugguccaucagauuuuugggucugcguauaccgcccuguucuccggcgugagcugggugaugaaaaucggaauuggcguccuccugacauggaucgggcuuaauucuaagaacaccagcauguccuuuucuugcauugcuaucggaaucauuacacuguaccucggcgccgugguucaggcugacauggggugugugaucaauuggaaaggaaaggagcugaagugcggcagcgggauuuucgucacgaacgaggugcacaccuggacagaacaguauaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuacauccugugggaaaauaacauuaagcucacgguggucgugggggacaucauuggaguucuggagcagggcaaacggacccuuacaucucagccuauggagcugaaguauuccuggaaaaccugggggaaggccaagaucgugacagccgaaacccaaaacagcucuuucauuaucgauggacccaauacaccugagugccccuccgucagcagagcuuggaacgugugggaaguggaggacuacggcuuuggcgucuucaccacgaauaucuggcucaaacugcgcgaaguuuauacacagcugugugaccaccggcuuauguccgcggccgugaaggaugagagagcugugcaugccgacaugggguacuggauugagucucagaaaaacggaagcuggaagcucgaaaaagccucccugaucgaggucaagaccugcaccuggccgaagucucacacacuguggagcaauggcgugcucgaauccgauaugauuaucccuaaaagccuggcugggcccauuucucagcauaaccaccgcccuggauaccacacccaaacggccggccccuggcaucuugggaagcuggagcucgacuuuaauuauugcgagggaacaaccguugugaucacagaaaacuguggcacccggggcccuucccugagaacaaccacggucagcgggaaacugauccacgaguggugcugucgcucuugcacccuucccccgcuccgguacaugggagaagauggcuguugguaugggauggagauuagaccuaucuccgaaaaggaggagaauauggugaaaagccugguuucugcgggaagcggcaagguggacaacuucacaauggggguccugugccucgcuauucuguuugaagaggugaugcggggaaaguucggcaaaaagcauaugaucgccggcguuuucuuuaccuucgugcuucugcucuccgggcagauuacauggcgcgauauggcccacacccugaucaugauuggaagcaaugcuucugacagaaugggcaugggggucacguaccuggcccuuaucgcgacauuuaaaauccagcccuuccuggcucucggauuuuuccugcggaagcucaccuccagagaaaaccugcuucugggcguggggcucgccauggccacaacccugcaacugcccgaggauauugaacagauggcuaauggaaucgcccuuggccugauggcucucaaacugauuacccaguuugagacauaucagcucuggacggcccugaucagccuuaccuguuccaacacaauuuucacccugacaguggcguggcgcaccgccacgcucauccuggcuggcgucucucugcuuccuguuugccaaagcuccucuaugcggaagacagacuggcugccgauggccguggcugccaugggggugcccccucucccccuguuuaucuucggacucaaggauacccugaaaagacgcagcuggccucuuaaugagggcgucauggccguggggcugguuuccauucuggcuucuagccuccugagaaacgacgugcccauggcgggaccucuugucgccggcgggcugcucaucgcuuguuacgugauuaccggaacauccgccgaucugaccguugaaaaggccgcugacaucacaugggaggaagaggccgaacagacgggcgugagccauaaccucaugauuaccgucgacgaugacggcacaaugcggaucaaagaugacgagaccgagaauauccugacagugcuucugaagaccgcgcugcucauugucucugggaucuuucccuauuccauuccggcuacgcugcuuguguggcacaccuggcagaaacagacacaacgcagcggaguucugugggaugugccuucucccccugaaacccagaaggccgagcucgaagagggcgucuacagaaucaaacagcaggggauuuucggaaagacacaagugggcguuggggugcagaaggagggagucuuucacaccauguggcaugugacacggggcgccgugcugacguacaacggcaaacgccucgaacccaauugggcuuccguuaagaaagaccugaucagcuaugggggaggcuggagacuuucugcccaguggcaaaagggggaggaaguccaggugauugcgguggagccgggcaagaacccuaagaauuuccagaccaugcccggcacauuccagaccaccacaggggaaaucggagcuaucgcccuggauuuuaagccuggcacguccggcagccccauuaucaaccgggaggggaaagucgugggacuguacggcaaugggguugugaccaagaacggaggcuaugucuccgggauugcccaaacaaaugcugagcccgacggcccuaccccggaacucgaggaagagauguucaaaaagcgcaaccugacaaucauggaucuucaccccggaagcggcaaaaccagaaaguaccugccugccauugugcgggaagcuaucaagcgcagacuccggacgcugauccucgcccccacaagaguuguggcggccgagauggaggaagcucugaaagggcuuccuauucgcuaucagaccaccgccacaaagucugagcauaccggacgggaaaucgucgaccugaugugccacgcuacauuuaccaugagacugcucagccccgugcgcguuccuaauuacaaccugauuaucauggaugaggcccauuucacggacccggccuccauugcugcgcggggcuauaucucuacaagaguggggaugggagaagccgcugccaucuuuaugaccgccacacccccuggcaccgcugaugccuucccccagagcaaugcgccuauucaggacgaggagcgcgacauccccgaacgguccuggaacucugggaaugaguggauuacggauuuugcuggcaaaaccgucugguucgugccgagcaucaaggccggaaacgacauugccaacugucuucgcaaaaauggcaagaaggugauccaacuguccagaaaaacauuugauaccgaauaccagaagacaaaacucaacgacugggauuucgucguuaccacagacauuucugagaugggggcuaauuuuaaggccgaucgggugaucgacccuagacggugccugaaacccgugauccugaccgauggacccgagcgcgucauucucgcgggcccuaugcccgugacggccgcuagcgccgcucagagacgggggcgcguuggaagaaacccucagaaggaaaaugaccaauacaucuucacaggccagccgcuuaacaaugaugaggaccacgcccacuggaccgaagcuaagaugcugcuggacaacauuaauacccccgaggggaucauuccugcccucuucgaacccgagcgggagaaauccgcggccaucgauggcgaauauagacugaagggagagagccgcaaaacauuuguggaacuuaugcggagaggcgaccugccugucuggcucgcucauaagguggccucugaggggaucaaauacaccgaucgcaaguggugcuucgacggacagcggaacaaucagauucuggaagagaacauggauguugagaucuggacaaaagaaggcgagaagaagaaacugagaccccgcuggcucgacgcucggacguauuccgauccgcuugcccugaaggaauuuaaagaguucgccgcugggagaaagagcauugcgcuggaccucgugaccgaaaucggacgcgucccuucucaccuggcccauagaacacggaaugcucuugauaaccuggugaugcuccacaccuccgagcacggcggccgcgccuacagacaugccgucgaggaacugcccgagacaauggaaacccugcuccuucuggggcugaugauucuccugacgggaggcgcuaugcuuuuucugaucagcgggaaaggaaucggcaagaccuccauugggcucaucugugugauugccucuagcggaaugcuguggauggcggagaucccucugcaauggauugccuccgcuaucguucucgaguucuuuaugauggugcuucugauucccgaaccugagaagcagcggacaccccaggacaaucaacuggccuauguggucaucggcauccucacccuggcugccauuaucgcggccaacgaaaugggccuucuggagacaaccaaacgcgaucucgggaugagcaaggaaccgggaguugugucuccuacguccuaccuggacguggaucugcaccccgcuagcgccuggacacucuaugcugucgccaccacagugauuacccccaugcuuagacauaccaucgaaaauucuacagcuaacguuagccuggccgcgauugccaaccaggcugugguccugaugggccucgacaaaggguggccuaucuccaagauggaccugggagugccgcuucuggcccucggcugcuacucucaggucaauccccugacgcugaccgcugccgugcuccuucugaucacacacuacgccauuaucgggccuggacugcaggcgaaagcuacccgggaggcccaaaagagaacagcugccggcauuaugaagaaccccaccguugauggcaucaugacgauugaccucgauccugugaucuaugacagcaaauucgaaaagcagcuggggcaggucaugcuucuggugcucugugccguucagcugcugcucaugcgcacauccugggcucuuugcgaggcccugacccuggcgaccggacccaucacaacccucugggaaggcucuccugggaaauuuuggaauacaacgauugccgugagcauggcuaacaucuuccggggauccuaccuggccggcgcugggcuugccuuuagcauuaugaagucugucggaaccggcaaaagaggcacagggucccaaggagagacccugggcgaaaaguggaagaaaaagcucaaucagcugagccgcaaagauuucgaccuguauaagaaauccgggaucacagagguggaucggaccgaggcgaaggaaggacucaaaagaggcgagauuacgcaucacgccgugucucgggggagcgcuaaacuucagugguuuguugaacgcaacauggucaucccggagggaagagugauugaccugggcuguggcagagggggaugguccuacuauugcgccggccugaagaaagugaccgaaguccgcggguacacaaagggaggccccgggcacgaggagccuguucccaugucuaccuauggauggaauaucgugaaacucaugagcggcaaggauguguucuaccugccucccgaaaaaugugacacacuucugugcgauaucggcgaguccagcccgucuccuaccgucgaagaguccagaacaauucgggugcucaagaugguugagcccuggcugaagaacaaucaguucuguaucaaagugcugaaccccuacaugccuaccgucauugaacaucucgagcgccuucaaagaaagcacgggggaaugcuggugcggaauccccugagccgcaacucuacgcaugaaauguauuggaucuccaauggcacagggaacauuguugcuagcgugaauauggucucuagacuccugcuuaaccgguuuaccaugacccacagacgcccuacaaucgagaaagacguggaucugggagccggcacgcggcacgugaacgcugaaccggagacccccaauauggacgucaucggggagagaauuaagcgcaucaaagaagaacacaacagcacauggcacuacgacgaugaaaauccuuauaagaccugggccuaccauggauccuaugagguuaaggcgacaggcucugccagcuccaugauuaacggcguggugaaacuccugaccaagcccugggacgucgugccuaugguuacacagauggcuaugaccgauacgacccccuucgggcagcaacggguguuuaaagaaaaggucgacacaagaaccccgcgcagcaugccuggaacacggagagugaugggcaucaccgccgaguggcuguggcgcacgcucgggcggaauaaaaagcccagacugugcacacgcgaggaguucaccaagaaaguucggacaaacgcugccaugggagccguguuuaccgaggaaaaucagugggauuccgcgaaggcugccgucgaggacgaagauuucuggaaacuuguggacagagagcgcgagcugcacaagcucggcaaaugugggucuugcguuuacaacaugaugggcaagagagagaaaaagcugggagaguuuggcaaggccaaagggagccgggcuauuugguauauguggcuuggagcccgcuaccuggaguucgaggcucucggcuuucugaaugaggaucauugguucuccagagaaaacucuuacagcgggguggagggagaaggccugcaccggcucggguauauccugagagacaucuccaagauuccuggcggagccauguacgcggaugacacggccggcugggacacccggaucacagaggaugaccuucacaaugaagagaaaauuacccagcagauggaucccgagcaucgccaacuggcuaacgccaucuuuaagcucacauaucagaauaaagucgugaagguccagagaccuacccccacagggaccgugauggacauuaucucucggaaggaucagcgcggaagcggccaaguugggacguacggacugaacacauucaccaauauggaagcucagcuuaucagacagauggagggcgaaggggugcuguccaaagccgaccucgagaacccgcaucugccugaaaagaaaauuacccaguggcuggagacaaagggcgucgagcggcucaaacgcauggcgaucagcggagaugacugcguggugaagcccauugaugacagauuugccaacgcucugcuugcccugaaugauaugggcaagguucggaaagacaucccccaauggcagccuucuaagggguggcaugauuggcaacaggugccguucuguucccaccacuuccaugaacucauuaugaaagacggacgcaagcuggucgugcccugcagaccucaagacgagcuuaucggccgggcucgcauuagccagggggccggauggucucugaaagaaaccgcuugucucggcaaggccuaugcgcagauguggucccugauguacuuucacagacgggaucugcgccucgccagcaacgcuaucugcucugccguucccgugcauugggucccuacauccagaacgaccuggagcauccacgcccaucaccaauggaugacaaccgaggacaugcugacaguguggaaucgggucuggauugaagauaaccccuggauggaggacaagaccccugugacgaccugggagaauguucccuaucuugggaaaagagaagaucagugguguggcucccugaucggacucacaagccgcgcuaccugggcccagaacauuccgacagcgauccagcaagugcggucucugauuggcaaugaggaguuccuugacuacaugccuagcaugaagagauuucgcaaagaggaggaauccgagggggcuaucugguga

SEQ ID NO: 20605 - RNA, 9873 nt, Artificial Sequence
  derived and/or modified CDS sequence (opt5) from DENV-3__KF973479__SS-prME
accagccugugccucaugaugauccugcccgccgcucuugccuuccaccugacaucccgggacggcgaaccucggaugauuguggggaagaaugaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccagaaucucgggggaacauccauuuucgccggacaucugaagugucgccugaaaauggacaaacuugagcugaaaggcaugagcuacgcuaugugcacgaacaccuuuguucucaagaaagaggugucugaaacacagcacgggaccauccugaucaaggucgaguacaagggagaagaugcccccuguaaaauuccuuucuccacagaggacggccaagggaaggcgcauaacggaagacugaucaccgcuaaucccgugguuacgaaaaaggaggaacccgugaacauugaggccgaaccuccguucggcgagagcaauaucgucauugggaucggcgauaacgcccuuaaaaucaauugguauaagaagggauccucuauuggcaaaauguuugaagcuacagccagaggggcuagacgcauggccauccucggagacaccgcgugggauuucggcagcgucggcggggugcugaacucccuggggaagaugguucaccagauuuuugggagcgccuacaccgcucucuucucuggcgucuccugggugaugaaaaucggaauuggcgugcugcuuacauggaucgggcugaauagcaagaacaccucuaugagcuuuuccugcauugccaucggaaucauuacacucuaucugggcgcugucgugcaggccgacaugggguguguuaucaauuggaaaggaaaggagcugaagugcggcucugggauuuucgugacgaacgagguccauaccuggacagaacaguacaaauuucaagcggauagccccaagcggcuugccaccgcuaucgccggcgcuugggagaauggaguguguggcauuagauccacaacccgcauggaaaaccuccuguggaaacagaucgccaaugagcugaacuauauccucugggaaaauaacauuaagcugacgguuguggucggggacaucauuggagugcuugagcagggcaaacggacccugacaccucagcccauggagcucaaguacagcuggaaaaccugggggaaggccaagaucguuacagcugaaacccaaaacucuuccuucauuaucgauggaccuaauacacccgagugcccgagcgugucuagagcguggaacgucugggaaguggaggacuauggcuuuggcguguucaccacgaauaucuggcugaaacugcgcgaagucuacacacagcuuugugaccaccggcucauguccgccgcuguuaaggaugagagagccgugcacgccgacaugggguacuggauugagagccagaaaaacggauccuggaagcuggaaaaggcuucucugaucgaggugaagaccugcaccuggccuaagagccauacacucugguccaauggcguccuggaaucugauaugauuauccccaaaagccuugccgggccuauuucccagcacaaccaucgccccggauaucacacccaaacggcgggcccuuggcaccuggggaagcucgagcuggacuuuaauuacugcgagggaacaaccgugguuaucacagaaaacuguggcacccggggccccagccugagaacaaccacggugucugggaaacuuauccaugaguggugcugucgcuccugcacccucccgccucugcgguauaugggagaagauggcuguugguacgggauggagauuagacccaucagcgaaaaggaggagaauauggucaaaucucugguguccgcuggaagcggcaagguugacaacuucacaaugggggugcucugccuggccauucuuuuugaagaggucaugcggggaaaguucggcaaaaagcacaugaucgccggcguguucuuuaccuucguucugcuccugucugggcagauuacauggcgcgauauggcucauacccugaucaugauuggaagcuccgccagcgacagaaugggcaugggggugacguaucuugcgcugaucgcuacauuuaaaauccagcccuuccucgcccugggauuuuuccuccggaagcugaccucuagagaaaaucuucugcucggcgucgggcuggccauggcuacaacccugcaacuuccugaggauauugaacagauggccaacggaaucgcucugggccucauggcccugaaacucauuacccaguuugagacauaccagcuguggacggcgcuuaucucccugaccuguagcaauacaauuuucacccucacaguggccuggcgcaccgcuacgcugauccuggccggcgugucccuucugccggucugccaaucuagcuccaugcggaagacagacuggcuccccauggcuguugccgccaugggggugccuccccugccucucuuuaucuucggacugaaggauacccuuaaaagacgcucuuggccccugaacgagggcgugauggcugucgggcuggugagcauucucgcguccucucugcuuagaaaugacguuccuauggccggaccccugguggcuggcgggcuccugaucgccuguuaugucauuaccggaacaagcgccgaucucaccguggaaaaggcugccgacaucacaugggaggaagaggcggaacagacgggcguuucccacaaccugaugauuaccguggacgaugacggcacaaugcggaucaaagaugacgagaccgagaacauccuuacaguccugcugaagaccgcucuccugauugugagcgggaucuuuccguacucuauuccugccacgcuucuggucuggcauaccuggcagaaacagacacaacgcuccggagugcucugggauguucccagcccucccgaaacccagaaggccgagcuggaagagggcguguacagaaucaaacagcaggggauuuucggaaagacacaagucggcguggggguucagaaggagggaguguuucacaccauguggcacgucacacggggcgcugugcucacguauaauggcaaacgccuggaaccgaacugggccucugugaagaaagaccuuaucuccuacgggggaggcuggagacugagcgcgcaguggcaaaagggggaggaaguucaggucauugcuguggagccuggcaagaaucccaagaacuuccagaccaugccuggcacauuccagaccaccacaggggaaaucggagccaucgcccuggauuuuaagcccggcacgucuggcucccccauuaucaaucgggaggggaaaguggucggacucuauggcaacggggugguuaccaagaauggaggcuacgugagcgggauugcucaaacaaacgccgagccugacggcccgacccccgaacuggaggaagagauguucaaaaagcgcaaucuuacaaucauggaucugcauccuggauccggcaaaaccagaaaguaucuccccgcuauuguccgggaagccaucaagcgcagacugcggacgcucauccuggcgccuacaagagugguugccgcugagauggaggaagcccuuaaagggcugcccauucgcuaccagaccaccgcuacaaagagcgagcacaccggacgggaaaucguggaccugaugugccaugccacauuuaccaugagacuccugucuccuguccgcgugccgaacuauaaucuuauuaucauggaugaggcccacuucacggaccccgcuagcauugcggcccggggcuacaucuccacaagaguugggaugggagaagcugccgccaucuuuaugaccgcuacaccucccggcaccgccgaugcguucccucagucuaacgcucccauucaggacgaggagcgcgacaucccggaacggagcuggaacuccgggaacgaguggauuacggauuuugccggcaaaaccgugugguucgucccuucuaucaaggccggaaaugacauugcuaacugucugcgcaaaaacggcaagaaggugauccaacucagcagaaaaacauuugauaccgaauaccagaagacaaaacugaaugacugggauuucguggucaccacagacauuuccgagaugggggccaacuuuaaggcggaucggguuaucgaccccagacggugccugaaacccgugauccucaccgauggaccugagcgcgugauucuugccggccccaugccugucacggcugccucugcugcccagagacgggggcgcgugggaagaaauccgcagaaggaaaacgaccaauauaucuucacaggccagccccugaauaacgaugaggaccaugcucacuggaccgaagccaagaugcugcucgacaauauuaacaccccugaggggaucauucccgcgcuguucgaaccugagcgggagaaaagcgccgcuaucgauggcgaauacagacuuaagggagagucccgcaaaacauuuguugaacugaugcggagaggcgaccuccccguguggcuggcccacaaggucgcuagcgaggggaucaaauauaccgaucgcaaguggugcuucgacggacagcggaauaaccagauucuggaagagaauauggauguggagaucuggacaaaagaaggcgagaagaagaaacucagaccgcgcuggcuugacgcccggacguacucugauccucuggcccugaaggaauuuaaagaguucgcugcggggagaaaguccauugcccucgaccugguuaccgaaaucggacgcgugcccagccaucuugcucacagaacacggaacgcccuggauaaucucgucaugcugcauaccucugagcacggcggccgcgccuauagacacgcuguggaggaacugccugagacaauggaaacccuccuucugcuggggcucaugauucugcuuacgggaggcgccaugcuguuucucaucuccgggaaaggaaucggcaagaccagcauugggcugaucugugucauugcguccucuggaaugcuguggauggccgagaucccccuccaauggauugcuagcgccaucgugcuugaguucuuuaugaugguucugcugauuccugaacccgagaagcagcggacaccgcaggacaaccaacucgcuuacguggugaucggcauccugacccuugccgcgauuaucgccgcuaaugaaaugggccugcucgagacaaccaaacgcgaucuggggauguccaaggaaccuggagucguuagccccacgucuuaucuggacguggaucuccaucccgccuccgcuuggacacuuuacgccguggcuaccacagucauuaccccuaugcugagacacaccaucgagaacagcacagccaaugugucucuggcggccauugcuaaccaggccguugugcucaugggccuggacaaaggguggccgaucagcaagauggaccuuggagucccccugcucgcucugggcugcuacucccaggugaacccucugacgcucaccgccgccguccuucugcugaucacacauuaugcgauuaucgggcccggacuccaggcuaaagccacccgggaggcucaaaagagaacagccgccggcauuaugaagaauccuaccguggauggcaucaugacgauugaccuggaucccguuaucuacgacucuaaauucgaaaagcagcuuggacaggugaugcugcucguccugugugcugugcagcugcuccuuaugcgcacaagcugggcccugugcgaggcgcugacccucgccaccggaccuaucacaacccugugggaaggcuccccggggaaauuuuggaacacaacgauugcuguuucuauggccaauaucuuccggggaagcuaucuugcuggcgccgggcuggcguuuuccauuaugaaaagcgugggaaccggcaaaagaggcacagggucucaaggagagacccucggcgaaaaguggaagaaaaagcugaaccagcugucccgcaaagauuucgaccucuacaagaaaagcgggaucacagaggucgaucggaccgaggccaaggaaggacuuaaaagaggcgagauuacgcaccaugcugugucccgggggucugccaagcugcagugguuuguggaacgcaauaugguuauccccgagggaagagucauugaccugggcuguggcagagggggauggagcuauuacugcgcuggccucaagaaagugaccgaagugcgcggguauacaaagggaggcccugggcacgaggagcccgucccuauguccaccuacggauggaacaucguuaaacugaugucuggcaaggauguguucuaccuucccccggaaaaaugugacacacugcucugcgauaucggcgagagcuccccuagccccaccguggaagagucuagaacaauucggguccugaagaugguggagcccuggcugaagaauaaccaguucuguaucaaaguucucaauccuuauaugcccaccgugauugaacaccuugagcgccugcaaagaaagcaugggggaaugcugguccggaacccucucucccgcaauagcacgcacgaaauguacuggaucucuaacggcacagggaauauuguggccuccguuaacauggugagcagacugcuucugaaucgguuuaccaugacccauagacgcccgacaaucgagaaagacgucgaucucggagcuggcacgcggcacgugaacgccgaacccgagaccccuaacauggacgugaucggggagagaauuaagcgcaucaaagaagaacacaauucuacauggcauuaugacgaugaaaaccccuacaagaccugggcguaucacggaagcuacgaggucaaggccacaggcuccgcuucuagcaugauuaauggcguugugaaacugcugaccaagccuugggacgugguccccauggugacacagauggccaugaccgauacgaccccguucgggcagcaacggguuuuuaaagaaaagguggacacaagaaccccucgcuccaugcccggaacacggagagucaugggcaucaccgcugaguggcucuggcgcacgcuggggcggaacaaaaagccuagacuuugcacacgcgaggaguucaccaagaaagugcggacaaaugccgccaugggagcgguuuuuaccgaggaaaaccagugggauagcgcuaaggccgccguggaggacgaagauuucuggaaacuggucgacagagagcgcgagcuccauaagcugggcaaauguggguccugcguguauaauaugaugggcaagagagagaagaaacuuggagaguuuggcaaggcuaaagggucucgggccauuugguacauguggcugggagcucgcuaccucgaguucgaggcccugggcuuucugaacgaggaucacugguucagcagagaaaauuccuauucugggguugagggagaaggccuccauaagcugggguacauccuucgggacaucagcaaaauucccggcggagcgauguaugccgaugacacggcuggcugggacaccagaaucacagaggaugaccugcacaacgaagagaagauuacccagcagauggauccugagcaccggcaacucgccaaugcuaucuuuaaacugacauaccagaacaagguggucaaggugcagcgccccaccccgacagggaccgucauggacauuaucuccagaaaagaucagcggggaucuggccaaguggggacguauggacuuaauacauucaccaacauggaagcccagcugauccgccagauggagggcgaagggguucucagcaaggcggaccuggagaauccucaucugcccgagaaaaagauuacccaguggcucgagacaaaaggcguggagagacugaagcggauggccaucuccggagaugacugcgucgugaagcccauugaugaccgcuuugcuaacgcccuucuggcucucaacgauaugggcaaagugagaaaggacaucccucaauggcagccgagcaaaggguggcacgauuggcagcagguucccuucuguucucaucacuuccacgaacugauuaugaaggacggacggaaacuuguggucccuugccgcccccaagacgagcugaucggcagagcccggauuucccagggggcuggauggagccucaaggaaaccgccugucugggcaaggcguacgcccagauguggucucugauguauuuucaucgcagagaucuccggcuggcuuccaaugccaucugcagcgccgugccuguucacugggugcccacaucucgcacgaccugguccauccaugcucaccaucaauggaugacaaccgaggacaugcuuacagucuggaacagaguguggauugaagauaauccuuggauggaggacaaaacccccgucacgaccugggagaacgugccguaccuggggaagcgggaagaucagugguguggcagccucaucggacugacauccagagccaccugggcgcagaauauuccuacagcuauccagcaaguucgcagccuuauuggcaacgaggaguuccuggacuacaugcccucuaugaaacgguuuagaaaggaggaggaaagcgagggggccaucugguga

SEQ ID NO: 20606 - RNA, 9873 nt, Artificial Sequence
  derived and/or modified CDS sequence (opt5) from DENV-3__KF973480__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucacccugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccaacuggccacacuucgcaaacuguguauugagggaaagaucaccaacauuacgacagauuccagaugcccuacccagggcgaagcgacccucccggaggaacaggaccagaauuauguguguaaacacacauacguggaucggggcugggggaacggaugcggccuguucgggaagggaagccuugugacaugcgccaaguuucaaugucuggagcccaucgagggcaaagugguucaguaugaaaaucucaaguacacagugauuaucacgguccauaccggggaccagcaccaggugggaaacgagacacaaggcguuaccgcugaaaucacaccucaggccucuaccacggaggcuauucugcccgaauauggcacccuggggcucgagugcuccccucgcacaggacuggacuucaaugagaugauccuucugaccaugaaaaacaaggccuggauggugcauagacagugguuuuucgaucucccccugccguggacaagcggcgccaccacggaaacaccuaccuggaaucggaaagagcuucuggucacauuuaagaacgcucacgcgaaaaagcaagaaguggucgugcucgggucucaggagggagccaugcacaccgcucugaccggcgccacagaaauucaaaauuccgggggcacgagcaucuucgccggacaucugaagugucgccucaaaauggacaagcuggagcuuaaaggcaugucuuacgcuaugugcaccaacacauuuguucugaagaaagagguguccgaaacccagcacgggacaauucucaucaaggucgaguacaagggagaagaugugcccuguaaaaucccuuucagcaccgaggacggccaagggaaggcccauaacggaagacugauuacggcgaaucccguugugaccaagaaggaggaacccgucaacaucgaggcugaaccuccguucggcgaguccaauauugugaucgggauuggcgauaacgcccugaaaaucaauugguauaagaagggaucuagcaucggcaaaauuuuugaagccaccgcuagaggggcgagacgcauggcuauccuuggagacaccgccugggauuucggcuccgucggcgggguucucaacagccuggggaagaugguccaccagauuuuugggucugcguacacagcccuguucuccggcgugagcugggugaugaaaaucggaauuggcguccuccugaccuggaucgggcuuaauucuaagaacacaagcauguccuuuucuugcauugcuaucggaaucauuacgcuguaucucggcgccgugguucaggcugacauggggugugugaucaauuggaaaggaaaggagcugaagugcggcagcgggauuuucgucaccaacgaggugcauacauggaccgaacaguacaaauuucaagccgauucccccaagcggcuggcgacagccaucgcuggcgccugggagaauggaguuuguggcauuagaagcaccacgcgcauggaaaaccuucucuggaaacagaucgcuaaugagcugaacuauauccugugggaaaauaacauuaagcucaccguggucgugggggacaucauuggaguucuggagcagggcaaacggacacuuaccccucagcccauggagcugaaguacucuuggaaaacaugggggaaggccaagaucgugaccgccgaaacacaaaacuccagcuucauuaucgauggaccuaauacccccgagugcccgucugucuccagagcuuggaacgugugggaaguggaggacuauggcuuuggcgucuucacgacaaauaucuggcucaaacugcgcgaaguuuacacccagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcacauggccuaagucccauacccuguggucuaauggcgugcucgaaagcgauaugauuauccccaaaucccuggcugggccuauuagccagcacaaccaucgccccggauaucacacgcaaacagccggcccuuggcaccuugggaagcuggagcucgacuuuaauuacugcgagggaaccacaguugugaucaccgaaaacuguggcacacggggccccucucugagaaccacgaccgucuccgggaaacugauccaugaguggugcugucgcagcugcacacuuccgccucuccgguauaugggagaagauggcuguugguacgggauggagauuagacccaucucugaaaaggaggagaauauggugaaaucccugguuagcgcgggaucuggcaagguggacaacuucaccauggggguccugugccucgcuauucuguuugaagaggugaugcggggaaaguucggcaaaaagcacaugaucgccggcguuuucuuuacauucgcccuucugcucagcgggcagauuaccuggcgcgauauggcucauacgcugaucaugauuggauccaaugccagcgacagaaugggcaugggggugacauaucuggcgcuuaucgcuaccuuuaaaauccagcccuuccuggcccucggauuuuuccugcggaagcucacaucuagagaaaaccugcuucugggcgucgggcucgccauggcuaccacccugcaacugccugaggauauugaacagauggccaauggaaucgcucuuggccugauggcccucaaacugauuacacaguuugagacguaccagcucuggaccgcgcugaucucccuuacauguagcaacaccauuuucacacugaccguggccuggcgcacggcuacacucauccuggccggcgugucccugcuuccggucugccaaucuagcuccaugcggaagaccgacuggcugcccauggcuguugccgccaugggggugccuccccucccucuguuuaucuucggacucaaggauacccugaaaagacgcucuuggccccuuaaugagggcgugauggcugucgggcuggugagcauucuggcguccucucuccugagaaacgacguuccuauggccggaccccuuguggcuggcgggcugcucaucgccuguuaugucauuacaggaaccagcgccgaucugacaguggaaaaggcugccgacaucacgugggaggaagaggcggaacagaccggcguuucccacaaccucaugauuacaguggacgaugacggcaccaugcggaucaaagaugacgagacagagaauauccugaccguccuucugaagacggcucugcucauugugagcgggaucuuuccguacucuauuccugccacccugcuugucuggcauacauggcagaaacagacccaacgcuccggagugcugugggauguucccagcccucccgaaacacagaaggccgagcucgaagagggcguguacagaaucaaacagcaggggauuuucggaaagacccaagucggcguggggguucagaaggagggaguguuucacacaauguggcacgucacgcggggcgcugugcugaccuauaacggcaaacgccucgaaccgaauugggccucugugaagaaagaccugaucuccuacgggggaggcuggagacuuagcgcgcaguggcaaaagggggaggaaguucaggucauugcuguggagccuggcaagaaccccaagaauuuccagacaaugccuggcaccuuccagaccacaacgggggaaaucggagccaucgcccuggauuuuaagcccggcaccucuggcucccccauuaucaaccgggaggggaaaguggucggacuguauggcaauggggugguuacaaagaacggaggcuacgugagcgggauugcucaaaccaaugccgagccugacggcccgacacccgaacucgaggaagagauguucaaaaagcgcaaccugaccaucauggaucuucauccuggauccggcaaaacgagaaaguaucugcccgcuauuguccgggaagccaucaagcgcagacuccggacacugauccucgcgccuaccagagugguugccgcugagauggaggaagcccugaaagggcuucccauucgcuaccagaccacagcuaccaagagcgagcacacaggacgggaaaucguggaccugaugugccaugccaccuuuacgaugagacugcucucuccuguccgcgugccgaauuauaaccugauuaucauggaugaggcccacuucacagaccccgcuagcauugcggcccggggcuacaucuccaccagaguugggaugggagaagcugccgccaucuuuaugacagcuaccccucccggcacggccgaugcguucccucagucuaaugcucccauucaggacgaggagcgcgacaucccggaacggagcuggaacuccgggaaugaguggauuaccgauuuugccggcaaaacagugugguucgucccuucuaucaaggccggaaacgacauugcuaacugucuucgcaaaaauggcaagaaggugauccaacugagcagaaaaaccuuugauacagaauaccagaagaccaaacucaacgacugggauuucguggucacaaccgacauuuccgagaugggggccaauuuuaaggcggaucggguuaucgaccccagacggugccugaaacccgugauccugacggauggaccugagcgcgugauucucgccggccccaugccugucacagcugccucugcugcccagagacgggggcgcgugggaagaaacccgcagaaggaaaaugaccaauauaucuucaccggccagccccuuaacaaugaugaggaccaugcucacuggaccgaagccaagaugcugcuggacaacauuaauacaccugaggggaucauucccgcccucuucgaaccugagcgggagaaaagcgccgcuaucgauggcgaauacagacugaagggagagucccgcaaaaccuuuguugaacuuaugcggagaggcgaccugcccguguggcucgcccacaaggucgcuagcgaggggaucaaauauacagaucgcaaguggugcuucgacggacagcggaacaaucagauucuggaagagaacauggauguggagaucuggacgaaagaaggcgagaagaagaaacugagaccgcgcuggcucgacgcccggaccuacucugauccucuugcccugaaggaauuuaaagaguucgcugcggggagaaaguccauugcccuggaccucguuacagaaaucggacgcgugcccagccaucuggcucacagaacccggaaugcccuugauaaccuggucaugcuccauacaucugagcacggcggccgcgccuauagacacgcuguggaggaacugccugagaccauggaaacgcugcuccuucuggggcugaugauucuccugaccggaggcgccaugcuuuuucugaucuccgggaaaggaaucggcaagacaagcauugggcucaucugugucauugcguccucuggaaugcuguggauggccgagaucccccugcaauggauugcuagcgccaucgugcucgaguucuuuaugaugguucuucugauuccugaacccgagaagcagcggaccccgcaggacaaucaacuggcuuacguggugaucggcauccucacacuggccgcgauuaucgccgcuaacgaaaugggccuucuggagaccacgaaacgcgaucucgggauguccaaggaaccuggagucguuagccccacaucuuaucuggacguggaucugcaucccgccuccgcuuggacccucuacgccguggcuacaaccgucauuaccccuaugcuuagacacacaaucgagaauagcacggccaacgugucucuggcggccauugcuaaccaggccguugugcugaugggccucgacaaaggguggccgaucagcaagauggaccugggagucccccuucuggcucucggcugcuacucccaggugaauccucugacccugacagccgccguccuccuucugaucacccauuaugcgauuaucgggcccggacugcaggcuaaagccacacgggaggcucaaaagagaaccgccgccggcauuaugaagaacccuacgguggauggcaucaugacaauugaccucgaucccguuaucuacgacucuaaauucgaaaagcagcugggacaggugaugcuucugguccucugugcugugcagcugcugcucaugcgcaccagcugggcccuuugcgaggcgcugacccuggccacaggaccuaucaccacacucugggaaggcuccccggggaaauuuuggaauacgaccauugcuguuucuauggccaacaucuuccggggaagcuaucuggcuggcgccgggcuugcguuuuccauuaugaaaagcgugggaacaggcaaaagaggcaccgggucucaaggagagacacugggcgaaaaguggaagaaaaagcucaaucagcugucccgcaaagauuucgaccuguacaagaaaagcgggaucaccgaggucgaucggacggaggccaaggaaggacucaaaagaggcgagauuacccaccaugcugugucccgggggucugccaaacuucagugguuuguggaacgcaacaugguuauccccgagggaagagucauugaccugggcuguggcagagggggauggagcuauuacugcgcuggccugaagaaagugacagaagugcgcggguauaccaagggaggcccugggcacgaggagcccgucccuauguccacauacggauggaauaucguuaaacucaugucuggcaaggauguguucuaccugcccccggaaaaaugugacacccuucugugcgauaucggcgagagcuccccuagccccacaguggaagagucuagaaccauucggguccucaagaugguggagcccuggcugaagaacaaucaguucuguaucaaaguucugaacccuuauaugcccacggugauugaacaccucgagcgccuucaaagaaagcaugggggaaugcugguccggaauccucugucccgcaacagcacacacgaaauguacuggaucucuaauggcaccgggaacauuguggccuccguuaauauggugagcagacuccugcuuaaccgguuuaccaugacacauagacgcccgacgaucgagaaagacgucgaucugggagcuggcacccggcacgugaacgccgaacccgagacaccuaauauggacgugaucggggagagaauuaagcgcaucaaagaagaacacaacucuaccuggcauuaugacgaugaaaaucccuacaagacaugggcguaucacggaagcuacgaggucaaggccaccggcuccgcuucuagcaugauuaacggcguugugaaacuccugacaaagccuugggacgugguccccauggugacccagauggccaugacggauaccacaccguucgggcagcaacggguuuuuaaagaaaagguggacaccagaacaccucgcuccaugcccggaacccggagagucaugggcaucacggcugaguggcuguggcgcacacucgggcggaauaaaaagccuagacugugcacccgcgaggaguucacaaagaaagugcggaccaacgccgccaugggagcgguuuuuacggaggaaaaucagugggauagcgcuaaggccgccguggaggacgaagauuucuggaaacuugucgacagagagcgcgagcugcauaagcucggcaaauguggguccugcguguauaacaugaugggcaagagagagaaaaagcugggagaguuuggcaaggcuaaagggucucgggccauuugguacauguggcuuggagcucgcuaccuggaguucgaggcccucggcuuucugaaugaggaucacugguucagcagagaaaacuccuauucugggguugagggagaaggccugcauaagcucggguacauccugcgggacaucagcaaaauucccggcggagcgauguaugccgaugacaccgcuggcugggacacaagaaucaccgaggaugaccuucacaaugaagagaagauuacacagcagauggauccugagcaccggcaacuggccaacgcuaucuuuaaacucaccuaccagaauaagguggucaaggugcagcgccccacaccgaccgggacggucauggacauuaucuccagaaaagaucagcggggaucuggccaaguggggacauauggacugaacaccuucaccaauauggaagcccagcuuauccgccagauggagggcgaagggguucugagcaaggcggaccucgagaacccucaucugcccgagaaaaagauuacacaguggcuggagaccaaaggcguggagagacucaagcggauggccaucuccggagaugacugcgucgugaagcccauugaugaccgcuuugcuaacgcccugcuugcucugaaugauaugggcaaagugagaaaggacaucccucaauggcagccgagcaaaggguggcacgauuggcagcagguucccuucuguucucaucacuuccacgaacucauuaugaaggacggacggaaacugguggucccuugccgcccccaagacgagcuuaucggcagagcccggauuucccagggggcuggauggagccugaaggaaacagccugucucggcaaggcguacgcccagauguggucucugauguauuuucaucgcagagaucugcggcucgcuuccaacgccaucugcagcgccgugccuguucacugggugcccacgucucgcaccacaugguccauccaugcucaccaucaauggaugaccacagaggacaugcugaccgucuggaauagaguguggauugaagauaacccuuggauggaggacaaaacgcccgucaccacaugggagaaugugccguaccuugggaagcgggaagaucagugguguggcagccugaucggacucaccuccagagccacaugggcgcagaacauuccuaccgcuauccagcaaguucgcagccugauuggcaaugaggaguuccuugacuacaugcccucuaugaaacgguuuagaaaggaggaggaaagcgagggggccaucugguga

SEQ ID NO: 20607 - RNA, 9873 nt, Artificial Sequence
  derived and/or modified CDS sequence (opt5) from DENV-3__KF973481__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccaucaucauuacagugcauacgggggaccagcaccaggucggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguucauagacagugguuuuucgaucucccccugccguggaccagcggcgccacaaccgaaacgccuacauggaaucggaaagagcuucuggugaccuuuaagaacgcucacgcgaaaaagcaagaagucgugguccucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagagguuuccgaaacacagcacgggaccauccucauuaagguggaguacaagggagaagauguccccuguaaaaucccuuucagcacagaggacggccaagggaaggcccauaacggaagacugauuaccgcgaaucccgugguuacgaaaaaggaggaacccgugaacaucgaggcugaaccuccguucggcgaguccaauauugucaucgggaucggcgauaacgcccugaaaauuaauugguauaagaagggaucuagcaucggcaaaauguuugaagccacagcuagaggggccagacgcauggcuauucuuggagacaccgccugggauuucggcuccgucgggggagugcucaacagccugggcaagaugguucaccagaucuuugggucugcguacaccgcccuguucuccggcgucagcugggugaugaaaauuggaaucggcgugcuccugacauggauugggcuuaauucuaagaacaccagcauguccuuuucuugcaucgcuaucggaauuaucacacuguaucucggcgccgucgugcaggcugacaugggguguguuauuaauuggaaaggaaaggagcugaagugcggcagcgggaucuucgugacgaacgagguccauaccuggacagaacaguacaaauuucaagccgauucccccaagcggcuggcgaccgccauugcuggcgccugggagaauggaguguguggcaucagaagcacaacccgcauggaaaaccuucucuggaaacagaucgcuaaugagcugaacuauauucugugggaaaauaacaucaagcucacgguuguggucggggacauuaucggagugcuggagcagggcaaacggacccuuacaccucagcccauggagcugaaguacucuuggaaaaccugggggaaggccaagauuguuacagccgaaacccaaaacuccagcuucaucaucgauggaccuaauacacccgagugcccgucuguguccagagcuuggaacgucugggaaguggaggacuauggcuuuggcguguucaccacgaauauuuggcucaaacugcgcgaagucuacacacagcugugugaccaccggcuuaugagcgcggccguuaaggaugagagagcugugcacgccgacaugggguacuggaucgagucccagaaaaacggaucuuggaagcucgaaaaagccagccugauugaggugaagaccugcaccuggccuaagucccauacacuguggucuaauggcguccucgaaagcgauaugaucauucccaaaucccuggcugggccuaucagccagcacaaccaucgccccggauaucacacccaaacggccggcccuuggcaccuugggaagcuggagcucgacuuuaauuacugcgagggaacaaccgugguuaucacagaaaacuguggcacccggggccccucucugagaacaaccacgguguccgggaaacugauucaugaguggugcugucgcagcugcacccuuccgccucuccgguauaugggagaagauggcuguugguacgggauggagaucagacccauuucugaaaaggaggagaauauggucaaaucccuggugagcgcgggaucuggcaagguugacaacuucacaguggggguccugugccucgcuauccuguuugaagaggugaugcggggaaaguucggcaaaaagcacaugauugccggcguuuucuuuaccuucgugcuucugcucagcgggcagaucacauggcgcgauauggcccauacccugauuaugaucggauccaaugcuagcgacagaaugggcaugggggucacguaucuggcccuuaucgcgacauuuaaaauucagcccuuccuggcucucggauuuuuccugcggaagcucaccucuagagaaaaccugcuucugggcguggggcucgccauggccacaacccugcaacugccugaggauaucgaacagauggcuaauggaauugcccuuggccugauggcucucaaacugaucacccaguuugagacauaccagcucuggacggcccugauuucccuuaccuguagcaacacaaucuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuauuuucggacucaaggauacccugaaaagacgcucuuggccccuuaaugagggcgucauggccguggggcugguuagcauccuggcuuccucucuccugagaaacgacgugccuauggcgggaccccuugucgccggcgggcugcucauugcuuguuaugugaucaccggaacaagcgccgaucugaccguugaaaaggccgcugacauuacaugggaggaagaggccgaacagacgggcgugucccacaaccucaugaucaccgucgacgaugacggcacaaugcggaucaaagaugacgagaccgagaauauucugacagugcuucugaagaccgcgcugcucaucgucagcgggauuuuuccguacucuaucccugcuacgcugcuuguguggcauaccuggcagaaacagacacaacgcuccggaguucugugggaugugcccagcccucccgaaacccagaaggccgagcucgaagagggcgucuacagaauuaaacagcaggggaucuucggaaagacacaagugggcguuggggugcagaaggagggagucuuucacaccauguggcacgugacacggggcgccgugcugacguauaacggcaaacgccucgaaccgaauugggcuucuguuaagaaagaccugauuuccuacgggggaggcuggagacuuagcgcccaguggcaaaagggggaggaaguccaggugaucgcgguggagccuggcaagaaccccaagaauuuccagaccaugccuggcacauuccagaccaccacaggggaaaucggagcuauugcccuggauuuuaagcccggcacgucuggcucccccaucauuaaccgggaggggaaagucgugggacuguauggcaaugggguugugaccaagaacggaggcuacgucagcgggaucgcccaaacaaaugcugagccugacggcccgacccccgaacucgaggaagagauguucaaaaagcgcaaccugacaauuauggaucuucauccuggauccggcaaaaccagaaaguaucugcccgccaucgugcgggaagcuaucaagcgcagacuccggacgcugauucucgccccuacaagaguuguggcggccgagauggaggaagcucugaaagggcuucccauccgcuaccagaccaccgccacaaagagcgagcacaccggacgggaaauugucgaccugaugugccaugcuacauuuaccaugagacugcucucuccugugcgcguuccgaauuauaaccugaucauuauggaugaggcccacuucacggaccccgccagcaucgcugcgcggggcuacaucuccacaagaguggggaugggagaagccgcugccauuuuuaugaccgccacaccucccggcaccgcugaugccuucccucagucuaaugcgcccauccaggacgaggagcgcgacauuccggaacggagcuggaacuccgggaaugaguggaucacggauuuugcuggcaaaaccgucugguucgugccuucuauuaaggccggaaacgacaucgccaacugucuucgcaaaaauggcaagaaggugauucaacugagcagaaaaacauuugauaccgaauaccagaagacaaaacucaacgacugggauuucgucguuaccacagacaucuccgagaugggggcuaauuuuaaggccgaucgggugaucgaccccagacggugccugaaacccgugauucugaccgauggaccugagcgcgucauccucgcgggccccaugccugugacggccgcuucugccgcucagagacgggggcgcguuggaagaaacccgcagaaggaaaaugaccaauauauuuucacaggccagccccuuaacaaugaugaggaccaugcccacuggaccgaagcuaagaugcugcuggacaacaucaauaccccugaggggauuauccccgcccucuucgaaccugagcgggagaaaagcgcggccaucgauggcgaauacagacugaagggagagucccgcaaaacauuuguggaacuuaugcggagaggcgaccugcccgucuggcucgcucacaagguggccagcgaggggauuaaauauaccgaucgcaaguggugcuucgacggacagcggaacaaucagauccuggaagagaacauggauguugagauuuggacaaaagaaggcgagaagaagaaacugagaccgcgcuggcucgacgcucggacguacucugauccucuugcccugaaggaauuuaaagaguucgccgcugggagaaaguccaucgcgcuggaccucgugaccgaaauuggacgcguccccagccaucuggcccacagaacacggaaugcucuugauaaccuggugaugcuccauaccucugagcacggcggccgcgccuauagacacgccgucgaggaacugccugagacaauggaaacccugcuccuucuggggcugaugauccuccugacgggaggcgcuaugcuuuuucugaucuccgggaaaggaauuggcaagaccagcaucgggcucauuugugugaucgccuccucuggaaugcuguggauggcggagauuccccugcaauggaucgccagcgcuauuguucucgaguucuuuaugauggugcuucugaucccugaacccgagaagcagcggacaccgcaggacaaucaacuggccuacguggucaucggcauucucacccuggcugccaucauugcggccaacgaaaugggccuucuggagacaaccaaacgcgaucucgggauguccaaggaaccuggaguugugagccccacgucuuaucuggacguggaucugcaucccgcuuccgccuggacacucuacgcugucgccaccacagugaucaccccuaugcuuagacacaccauugagaauagcacagcuaacguuucucuggccgcgaucgccaaccaggcugugguccugaugggccucgacaaaggguggccgaucagcaagauggaccugggagugccccuucuggcccucggcugcuacucccaggucaauccucugacgcugaccgcugccgugcuccuucugauuacacauuaugccaucauugggcccggacugcaggcgaaagcuacccgggaggcccaaaagagaacagcugccggcaucaugaagaacccuaccguugauggcauuaugacgaucgaccucgaucccgugaucuacgacucuaaauucgaaaagcagcuggggcaggucaugcuucuggugcucugugccguucagcugcugcucaugcgcacaagcugggcucuuugcgaggcccugacccuggcgaccggaccuauuacaacccucugggaaggcuccccggggaaauuuuggaauacaacgaucgccgugucuauggcuaacauuuuccggggaagcuaucuggccggcgcugggcuugccuuuuccaucaugaaaagcgucggaaccggcaaaagaggcacagggucucaaggagagacccugggcgaaaaguggaagaaaaagcucaaucagcugucccgcaaagauuucgaccuguacaagaaaagcgggauuacagagguggaucggaccgaggcgaaggaaggacucaaaagaggcgagaucacgcaccaugccgugucccgggggucugcuaaacuucagugguuuguugaacgcaacauggucauucccgagggaagagugaucgaccugggcuguggcagagggggauggagcuauuacugcgccggccugaagaaagugaccgaaguccgcggguauacaaagggaggcccugggcacgaggagcccguuccuauguccaccuacggauggaauaucgugaaacucaugucuggcaaggauguguucuaccugcccccggaaaaaugugacacacuucugugcgauauuggcgagagcuccccuagccccaccgucgaagagucuagaacaauccgggugcucaagaugguugagcccuggcugaagaacaaucaguucuguauuaaagugcugaacccuuauaugcccaccgucaucgaacaccucgagcgccuucaaagaaagcaugggggaaugcuggugcggaauccucugucccgcaacagcacgcacgaaauguacuggauuucuaauggcacagggaacaucguugcuuccgugaauauggucagcagacuccugcuuaaccgguuuaccaugacccauagacgcccgacaaucgagaaagacguggaucugggagccggcacgcggcacgugaacgcugaacccgagaccccuaauauggacgucauuggggagagaaucaagcgcauuaaagaagaacacaacucuacauggcauuaugacgaugaaaaucccuacaagaccugggccuaucacggaagcuacgagguuaaggcgacaggcuccgccucuagcaugaucaacggcguggugaaacuccugaccaagccuugggacgucgugcccaugguuacacagauggcuaugaccgauacgaccccguucgggcagcaacggguguuuaaagaaaaggucgacacaagaaccccucgcuccaugcccggaacacggagagugaugggcauuaccgccgaguggcuguggcgcacgcucgggcggaauaaaaagccuagacugugcacacgcgaggaguucaccaagaaaguucggacaaacgcugccaugggagccguguuuaccgaggaaaaucagugggauagcgcgaaggcugccgucgaggacgaagauuucuggaaacuuguggacagagagcgcgagcugcauaagcucggcaaauguggguccugcguuuauaacaugaugggcaagagagagaagaagcugggagaguuuggcaaggccaaagggucucgggcuaucugguacauguggcuuggagcccgcuaccuggaguucgaggcucucggcuuucugaaugaggaucacugguucagcagagaaaacuccuauucugggguggagggagaaggccugcauaagcucggguacauccugcgggacauuagcaaaauccccggcggagccauguaugcggaugacacggccggcugggacaccagaauuacagaggaugaccuucacaaugaagagaagaucacccagcagauggauccugagcaccggcaacuggcuaacgccauuuuuaaacucacauaccagaauaaggucgugaagguccagcgccccaccccgacagggaccgugauggacaucaucuccagaaaagaucagcggggaucuggccaaguugggacguauggacugaacacauucaccaauauggaagcucagcuuauucgccagauggagggcgaaggggugcugagcaaggccgaccucgagaacccucaucugcccgagaaaaagaucacccaguggcuggagacaaaaggcgucgagagacucaagcggauggcgauuuccggagaugacugcguggugaagcccaucgaugaccgcuuugccaacgcucugcuugcccugaaugauaugggcaaaguuagaaaggacauuccucaauggcagccgagcaaaggguggcacgauuggcaacaggugcccuucuguucucaucacuuccacgaacucaucaugaaggacggacggaaacuggucgugccuugccgcccccaagacgagcuuauuggcagagcucggaucucccagggggccggauggagccugaaggaaaccgcuugucucggcaaggccuacgcgcagauguggucucugauguauuuucaucgcagagaucugcggcucgccuccaacgcuaucugcagcgccguuccugugcacuggguccccacaucucgcacgaccugguccauucaugcccaccaucaauggaugacaaccgaggacaugcugacaguguggaauagagucuggaucgaagauaacccuuggauggaggacaaaacccccgugacgaccugggagaauguuccguaccuugggaagcgggaagaucagugguguggcagccugauuggacucacauccagagcuaccugggcccagaacaucccuacagcgauucagcaagugcgcagccugaucggcaaugaggaguuccuugacuacaugcccucuaugaaacgguuuagaaaggaggaggaaagcgagggggcuaucugguga

SEQ ID NO: 20608 - RNA, 9873 nt, Artificial Sequence
  derived and/or modified CDS sequence (opt5) from DENV-3__KF973482__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccaucaucauuacagugcauacgggggaccagcaccaggucggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguucauagacagugguuuuucgaucucccccugccguggaccagcggcgccacaaccgaaacgccuacauggaaucggaaagagcuucuggugaccuuuaagaacgcucacgcgaaaaagcaagaagucgugguccucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagagguuuccgaaacacagcacgggaccauccucauuaagguggaguacaagggagaagauguccccuguaaaaucccuuucagcacagaggacggccaagggaaggcccauaacggaagacugauuaccgcgaaucccgugguuacgaaaaaggaggaacccgugaacaucgaggcugaaccuccguucggcgaguccaauauugucaucgggaucggcgauaacgcccugaaaauuaauugguauaagaagggaucuagcaucggcaaaauguuugaagccacagcuagaggggccagacgcauggcuauucuuggagacaccgccugggauuucggcuccgucgggggagugcucaacagccugggcaagaugguucaccagaucuuugggucugcguacaccgcccuguucuccggcgucagcugggugaugaaaauuggaaucggcgugcuccugacauggauugggcuuaauucuaagaacaccagcauguccuuuucuugcaucgcuaucggaauuaucacacuguaucucggcgccgucgugcaggcugacaugggguguguuauuaauuggaaaggaaaggagcugaagugcggcagcgggaucuucgugacgaacgagguccauaccuggacagaacaguacaaauuucaagccgauucccccaagcggcuggcgaccgccauugcuggcgccugggagaauggaguguguggcaucagaagcacaacccgcauggaaaaccuucucuggaaacagaucgcuaaugagcugaacuauauucugugggaaaauaacaucaagcucacgguuguggucggggacauuaucggagugcuggagcagggcaaacggacccuuacaccucagcccauggagcugaaguacucuuggaaaaccugggggaaggccaagauuguuacagccgaaacccaaaacuccagcuucaucaucgauggaccuaauacacccgagugcccgucuguguccagagcuuggaacgucugggaaguggaggacuauggcuuuggcguguucaccacgaauauuuggcucaaacugcgcgaagucuacacacagcugugugaccaccggcuuaugagcgcggccguuaaggaugagagagcugugcacgccgacaugggguacuggaucgagucccagaaaaacggaucuuggaagcucgaaaaagccagccugauugaggugaagaccugcaccuggccuaagucccauacacuguggucuaauggcguccucgaaagcgauaugaucauucccaaaucccuggcugggccuaucagccagcacaaccaucgccccggauaucacacccaaacggccggcccuuggcaccuugggaagcuggagcucgacuuuaauuacugcgagggaacaaccgugguuaucacagaaaacuguggcacccggggccccucucugagaacaaccacgguguccgggaaacugauucaugaguggugcugucgcagcugcacccuuccgccucuccgguauaugggagaagauggcuguugguacgggauggagaucagacccauuucugaaaaggaggagaauauggucaaaucccuggugagcgcgggaucuggcaagguugacaacuucacaguggggguccugugccucgcuauccuguuugaagaggugaugcggggaaaguucggcaaaaagcacaugauugccggcguuuucuuuaccuucgugcuucugcucagcgggcagaucacauggcgcgauauggcccauacccugauuaugaucggauccaaugcuagcgacagaaugggcaugggggucacguaucuggcccuuaucgcgacauuuaaaauucagcccuuccuggcucucggauuuuuccugcggaagcucaccucuagagaaaaccugcuucugggcguggggcucgccauggccacaacccugcaacugccugaggauaucgaacagauggcuaauggaauugcccuuggccugauggcucucaaacugaucacccaguuugagacauaccagcucuggacggcccugauuucccuuaccuguagcaacacaaucuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuauuuucggacucaaggauacccugaaaagacgcucuuggccccuuaaugagggcgucauggccguggggcugguuagcauccuggcuuccucucuccugagaaacgacgugccuauggcgggaccccuugucgccggcgggcugcucauugcuuguuaugugaucaccggaacaagcgccgaucugaccguugaaaaggccgcugacauuacaugggaggaagaggccgaacagacgggcgugucccacaaccucaugaucaccgucgacgaugacggcacaaugcggaucaaagaugacgagaccgagaauauucugacagugcuucugaagaccgcgcugcucaucgucagcgggauuuuuccguacucuaucccugcuacgcugcuuguguggcauaccuggcagaaacagacacaacgcuccggaguucugugggaugugcccagcccucccgaaacccagaaggccgagcucgaagagggcgucuacagaauuaaacagcaggggaucuucggaaagacacaagugggcguuggggugcagaaggagggagucuuucacaccauguggcacgugacacggggcgccgugcugacguauaacggcaaacgccucgaaccgaauugggcuucuguuaagaaagaccugauuuccuacgggggaggcuggagacuuagcgcccaguggcaaaagggggaggaaguccaggugaucgcgguggagccuggcaagaaccccaagaauuuccagaccaugccuggcacauuccagaccaccacaggggaaaucggagcuauugcccuggauuuuaagcccggcacgucuggcucccccaucauuaaccgggaggggaaagucgugggacuguauggcaaugggguugugaccaagaacggaggcuacgucagcgggaucgcccaaacaaaugcugagccugacggcccgacccccgaacucgaggaagagauguucaaaaagcgcaaccugacaauuauggaucuucauccuggauccggcaaaaccagaaaguaucugcccgccaucgugcgggaagcuaucaagcgcagacuccggacgcugauucucgccccuacaagaguuguggcggccgagauggaggaagcucugaaagggcuucccauccgcuaccagaccaccgccacaaagagcgagcacaccggacgggaaauugucgaccugaugugccaugcuacauuuaccaugagacugcucucuccugugcgcguuccgaauuauaaccugaucauuauggaugaggcccacuucacggaccccgccagcaucgcugcgcggggcuacaucuccacaagaguggggaugggagaagccgcugccauuuuuaugaccgccacaccucccggcaccgcugaugccuucccucagucuaaugcgcccauccaggacgaggagcgcgacauuccggaacggagcuggaacuccgggaaugaguggaucacggauuuugcuggcaaaaccgucugguucgugccuucuauuaaggccggaaacgacaucgccaacugucuucgcaaaaauggcaagaaggugauucaacugagcagaaaaacauuugauaccgaauaccagaagacaaaacucaacgacugggauuucgucguuaccacagacaucuccgagaugggggcuaauuuuaaggccgaucgggugaucgaccccagacggugccugaaacccgugauucugaccgauggaccugagcgcgucauccucgcgggccccaugccugugacggccgcuucugccgcucagagacgggggcgcguuggaagaaacccgcagaaggaaaaugaccaauauauuuucacaggccagccccuuaacaaugaugaggaccaugcccacuggaccgaagcuaagaugcugcuggacaacaucaauaccccugaggggauuauccccgcccucuucgaaccugagcgggagaaaagcgcggccaucgauggcgaauacagacugaagggagagucccgcaaaacauuuguggaacuuaugcggagaggcgaccugcccgucuggcucgcucacaagguggccagcgaggggauuaaauauaccgaucgcaaguggugcuucgacggacagcggaacaaucagauccuggaagagaacauggauguugagauuuggacaaaagaaggcgagaagaagaaacugagaccgcgcuggcucgacgcucggacguacucugauccucuugcccugaaggaauuuaaagaguucgccgcugggagaaaguccaucgcgcuggaccucgugaccgaaauuggacgcguccccagccaucuggcccacagaacacggaaugcucuugauaaccuggugaugcuccauaccucugagcacggcggccgcgccuauagacacgccgucgaggaacugccugagacaauggaaacccugcuccuucuggggcugaugauccuccugacgggaggcgcuaugcuuuuucugaucuccgggaaaggaauuggcaagaccagcaucgggcucauuugugugaucgccuccucuggaaugcuguggauggcggagauuccccugcaauggaucgccagcgcuauuguucucgaguucuuuaugauggugcuucugaucccugaacccgagaagcagcggacaccgcaggacaaucaacuggccuacguggucaucggcauucucacccuggcugccaucauugcggccaacgaaaugggccuucuggagacaaccaaacgcgaucucgggauguccaaggaaccuggaguugugagccccacgucuuaucuggacguggaucugcaucccgcuuccgccuggacacucuacgcugucgccaccacagugaucaccccuaugcuuagacacaccauugagaauagcacagcuaacguuucucuggccgcgaucgccaaccaggcugugguccugaugggccucgacaaaggguggccgaucagcaagauggaccugggagugccccuucuggcccucggcugcuacucccaggucaauccucugacgcugaccgcugccgugcuccuucugauuacacauuaugccaucauugggcccggacugcaggcgaaagcuacccgggaggcccaaaagagaacagcugccggcaucaugaagaacccuaccguugauggcauuaugacgaucgaccucgaucccgugaucuacgacucuaaauucgaaaagcagcuggggcaggucaugcuucuggugcucugugccguucagcugcugcucaugcgcacaagcugggcucuuugcgaggcccugacccuggcgaccggaccuauuacaacccucugggaaggcuccccggggaaauuuuggaauacaacgaucgccgugucuauggcuaacauuuuccggggaagcuaucuggccggcgcugggcuugccuuuuccaucaugaaaagcgucggaaccggcaaaagaggcacagggucucaaggagagacccugggcgaaaaguggaagaaaaagcucaaucagcugucccgcaaagauuucgaccuguacaagaaaagcgggauuacagagguggaucggaccgaggcgaaggaaggacucaaaagaggcgagaucacgcaccaugccgugucccgggggucugcuaaacuucagugguuuguugaacgcaacauggucauucccgagggaagagugaucgaccugggcuguggcagagggggauggagcuauuacugcgccggccugaagaaagugaccgaaguccgcggguauacaaagggaggcccugggcacgaggagcccguuccuauguccaccuacggauggaauaucgugaaacucaugucuggcaaggauguguucuaccugcccccggaaaaaugugacacacuucugugcgauauuggcgagagcuccccuagccccaccgucgaagagucuagaacaauccgggugcucaagaugguugagcccuggcugaagaacaaucaguucuguauuaaagugcugaacccuuauaugcccaccgucaucgaacaccucgagcgccuucaaagaaagcaugggggaaugcuggugcggaauccucugucccgcaacagcacgcacgaaauguacuggauuucuaauggcacagggaacaucguugcuuccgugaauauggucagcagacuccugcuuaaccgguuuaccaugacccauagacgcccgacaaucgagaaagacguggaucugggagccggcacgcggcacgugaacgcugaacccgagaccccuaauauggacgucauuggggagagaaucaagcgcauuaaagaagaacacaacucuacauggcauuaugacgaugaaaaucccuacaagaccugggccuaucacggaagcuacgagguuaaggcgacaggcuccgccucuagcaugaccaacggcguggugaaacuccugacaaagccuugggacgucgugcccaugguuacccagauggcuaugacggauaccacaccguucgggcagcaacggguguuuaaagaaaaggucgacaccagaacaccucgcuccaugcccggaacccggagagugaugggcaucacggccgaguggcuguggcgcacacucgggcggaauaaaaagccuagacugugcacccgcgaggaguucacaaagaaaguucggaccaacgcugccaugggagccguguuuacggaggaaaaucagugggauagcgcgaaggcugccgucgaggacgaagauuucuggaaacuuguggacagagagcgcgagcugcauaagcucggcaaauguggguccugcguuuauaacaugaugggcaagagagagaagaagcugggagaguuuggcaaggccaaagggucucgggcuauuugguacauguggcuuggagcccgcuaccuggaguucgaggcucucggcuuucugaaugaggaucacugguucagcagagaaaacuccuauucugggguggagggagaaggccugcauaagcucggguacauccugcgggacaucagcaaaauucccggcggagccauguaugcggaugacaccgccggcugggacacaagaaucaccgaggaugaccuucacaaugaagagaagauuacacagcagauggauccugagcaccggcaacuggcuaacgccaucuuuaaacucaccuaccagaauaaggucgugaagguccagcgccccacaccgaccgggacggugauggacauuaucuccagaaaagaucagcggggaucuggccaaguugggacauauggacugaacaccuucaccaauauggaagcucagcuuauccgccagauggagggcgaaggggugcugagcaaggccgaccucgagaacccucaucugcccgagaaaaagauuacacaguggcuggagaccaaaggcgucgagagacucaagcggauggcgaucuccggagaugacugcguggugaagcccauugaugaccgcuuugccaacgcucugcuugcccugaaugauaugggcaaaguuagaaaggacaucccucaauggcagccgagcaaaggguggcacgauuggcaacaggugcccuucuguucucaucacuuccacgaacucauuaugaaggacggacggaaacuggucgugccuugccgcccccaagacgagcuuaucggcagagcucggauuucccagggggccggauggagccugaaggaaacagcuugucucggcaaggccuacgcgcagauguggucucugauguauuuucaucgcagagaucugcggcucgccuccaacgcuaucugcagcgccguuccugugcacuggguccccacgucucgcaccacaugguccauccaugcccaccaucaauggaugaccacagaggacaugcugaccguguggaauagagucuggauugaagauaacccuuggauggaggacaaaacgcccgugaccacaugggagaauguuccguaccuugggaagcgggaagaucagugguguggcagccugaucggacucaccuccagagcuacaugggcccagaacauuccuaccgcgauccagcaagugcgcagccugauuggcaaugaggaguuccuugacuacaugcccucuaugaaacgguuuagaaaggaggaggaaagcgagggggcuaucugguga

SEQ ID NO: 20609 - RNA, 9873 nt, Artificial Sequence
  derived and/or modified CDS sequence (opt5) from DENV-3__KF973483__SS-prME
acaagccugugccucaugaugauucugcccgccgcucuugccuuccaccugacaucccgggacggagagccucggaugauuguggggaagaacgaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugcccccuguaaaauuccuuucagcacagaggacggccaagggaaggcgcauaacggaagacugaucaccgcuaaucccgugguuacgaaaaaggaggaacccgugaacauugaggccgaaccuccguucggcgaguccaauaucgucauugggaucggcgauaacgcccugaaaaucaauugguauaagaagggaucuagcauuggcaaaauguuugaagcuacagccagaggggcuagacgcauggccauccuuggagacaccgcgugggauuucggcuccgucgggggagugcucaacagccugggcaagaugguucaccagauuuuugggucugccuacaccgcucuguucuccggcgucagcugggugaugaaaaucggaauuggcgugcuccugacauggaucgggcuuaauucucggaacaccagcauguccuuuucuugcauugccaucggaaucauuacacuguaucucggcgcugucgugcaggccgacaugggguguguuaucaauuggaagggaaaagagcugaagugcggcagcgggauuuucgugacgaacgagguccauaccuggacagaacaguacaaguuucaagcggauucccccaaaagacuggccaccgcuaucgugggcgccugggagaauggaguuuguggcauucgcagcacaacccggauggaaaaccuucucuggaagcagaucgcuaaugagcugaacuauauccugugggaaaauaacauuaaacucacgguggucgugggggacaucauuggaguucuggagcagggcaagagaacccuuacaccucagcccauggagcugaaauacucuuggaagaccugggggaaagccaagaucgugacagccgaaacccaaaacuccagcuucauuaucgauggaccuaauacacccgagugcccgucugucucccgcgcuuggaacgugugggaaguggaggacuauggcuuuggcgucuucaccacgaauaucuggcucaagcugcgggaaacauacacccagcugugugaccacagacuuaugagcgcggccguuaaagaugagcgcgcugugcacgccgacaugggguacuggauugagucccagaagaacggaucuuggaaacucgaaaaggccagccugaucgaggugaaaaccugcacauggccuaagucccauaccauuuggucuaauggcguccuggaaagcgauaugaucauucccaagucccucgcugggccuaucagccagcacaaccaucggcccggauaucacacgcaaacagccggcccuuggcaccuggggaaacuugagcuggacuuuaauuacugcgagggaaccacagugguuaucaccgaaaacuguggcacaagaggccccucucuccgcaccacgaccguguccgggaagcugauucaugaguggugcugucggagcugcacacugccgccucuuagauauaugggagaagauggcuguugguacgggauggagauccggcccauuucugaaaaagaggagaauauggucaagucccucgugagcgcgggaucuggcaaaguugacaacuucaccaugggggugcugugccuggcuauccucuuugaagaggucaugcgcggaaaguucggcaagaaacacaugauugccggcguguuccugacauuuguucuucugcucagcgggcagaucaccuggagagauauggcccauacgcugauuaugaucggauccaaugcuagcgaccggaugggcaugggggugacauaucuggcccuuaucgcgaccuucaagauucagcccuuucuggcucucggauucuuucugagaaaacucacaucucgcgaaaaccugcuucugggcgucgggcucgccauggccaccacccugcaacugccugaggauaucgaacagauggcuaauggaauugcccuuggccugauggcucucaagcugaucacacaguucgagacguaccagcucuggaccgcccugauuucccuuacauguagcaacaccaucuuuacacugaccguggcguggcggacggccacacucauccuggcuggcgugucccugcuuccggucugccaaucuagcuccaugagaaaaaccgacuggcugcccauggccguugcugccaugggggugccuccccucccucuguucaucuuuucucucaaggauacccugaagcgcagaagcuggccccuuaaugagggagugauggccgucggccugguguccauccuggcuucuagccuccugcggaacgacguuccuauggcggggccccuuguggccggaggccugcucauugcuuguuaugucaucacagggaccuccgccgaucugacaguggaaaaagccgcugacauuacgugggaggaagaggccgaacagaccggaguuagccacaaccucaugaucacaguggacgaugacggcaccaugcgcaucaaggaugacgagacagagaauauucugaccguccuucugaaaacggcgcugcucaucgugucuggcauuuucccguacuccaucccugcuacccugcuugucuggcauacauggcagaagcagacccaaagaagcggggugcugugggauguucccucuccucccgaaacacagaaagccgagcucgaagagggaguguaccggauuaagcagcagggcaucuuugggaaaacccaagucggagugggcguucagaaggaggggguguuccacacaauguggcacgucacgcgcggagccgugcugaccuauaacggcaagagacucgaaccgaauugggcuuccgugaaaaaggaccugauuagcuacggcgggggauggcggcuuucugcccaguggcaaaaaggcgaggaaguucaggucaucgcgguggagccugggaagaaccccaaaaauuuucagacaaugccuggaaccuuccagaccacaacgggcgaaaucggggcuauugcccuggauuucaagcccggaaccuccggcagccccaucauuaaccgcgagggcaagguggucgggcuguauggaaauggcgugguuaccaagaacgggggauacguguccggcaucgcccaaaccaaugcugagccugacgggccgacacccgaacucgaggaagagauguuuaagaaaagaaaccugaccauuauggaucuucauccuggcagcggaaagacgcggaaauaucugcccgccaucguccgcgaagcuaucaagagacggcucagaacacugauucucgccccuacccgcgugguugcggccgagauggaggaagcucugaagggccuucccauccgguaccagaccacagccaccaaaucugagcacacagggagagaaauuguggaccugaugugccaugcuaccuucacgaugcgccugcucagcccuguccgggugccgaauuauaaccugaucauuauggaugaggcccacuuuacagaccccgccuccaucgcugcgagaggauacaucucuacccgcguuggcaugggggaagccgcugccauuuucaugacagccaccccucccggaacggcugaugccuuuccucagagcaaugcgcccauccaggacgaggagcgggacauuccggaaagauccuggaacucuggcaaugaguggaucaccgauuucgcugggaagacagugugguuugucccuagcauuaaagccggcaacgacaucgccaacugucuucgcaagaauggcaaaaaggugauucaacugucccggaagaccuucgauacagaauaccagaaaaccaagcucaacgacugggauuuuguggucacaaccgacaucucugagaugggagcuaauuucaaagccgauagaguuaucgacccccggcgcugccugaagcccgugauucugacggaugggccugagagagugauccucgcgggacccaugccugucacagccgcuagcgccgcucagcggcgcggcagaguggggcggaacccgcagaaagaaaaugaccaauauauuuuuaccggacagccccuuaacaaugaugaggaccaugcccacuggaccgaagcuaagaugcugcuggacaacaucaauacaccugagggcauuauccccgcccucuucgaaccugagagagagaaguccgcggccaucgauggggaauaccgccugaaaggcgagagccggaagaccuucguugaacuuaugagacgcggagaccugcccguguggcucgcucacaaagucgccucugagggcauuaaguauacagaucggaaauggugcuuugacgggcagagaaacaaucagauccuggaagagaacauggauguggagauuuggacgaaggaaggagagaaaaagaagcugcgcccgcgguggcucgacgcuagaaccuacuccgauccucuugcccugaaagaguucaaggaguuugccgcuggccgcaaaagcaucgcgcuggaccucguuacagaaauugggagagugcccucucaucuggcccaccggacccgcaaugcucuugauaaccuggucaugcuccauacauccgagcacggaggcagagccuaucggcacgccguggaggaacugccugagaccauggaaacgcugcuccuucugggccugaugauccuccugaccgggggagcuaugcuuuuccugaucagcggcaaggggauuggaaaaacauccaucggccucauuugugucaucgccucuagcgggaugcuguggauggcggagauuccccugcaauggaucgccuccgcuauugugcucgaguuuuucaugaugguucuucugaucccugaacccgagaagcagcgcaccccgcaggacaaucaacuggccuacguggugaucggcauucucacacuggcugccaucauugcggccaacgaaaugggccuucuggagaccacgaagagagaucucggcaugagcaaagaaccuggggucguuucucccacauccuaucuggacguggaucugcaucccgcuagcgccuggacccucuacgcuguggccacaaccgucaucaccccuaugcuucggcacacaauugaaaauucuacggcuaacgugagccuggccgcgaucgccaaccaggcuguugugcugaugggacucgacaagggcuggccgaucuccaaaauggaccugggggucccccuucuggcccucggaugcuacucucaggugaauccucugacccugacagcugccguccuccuucugauuacccauuaugccaucauuggccccgggcugcaggcgaaggcuacaagagaggcccaaaaacgcaccgcugccggaaucaugaagaacccuacgguggauggcauuaugacaaucgaccucgaucccguuaucuacgacagcaaguuugaaaaacagcugggccaggugaugcuucugguccucugugccgugcagcugcugcucaugcggaccuccugggcucuuugcgaggcccugacccuggcgacagggccuauuaccacacucugggaaggaucuccgggcaaguucuggaauacgaccaucgccguuagcauggcuaacauuuuuagaggguccuaucuggccggagcuggccuugccuucagcaucaugaaaucuguggggacaggaaagcgcggcaccggcucccaaggggagacacugggagaaaaauggaagaagaaacucaaucagcugagccggaaggauuuugaccuguacaaaaaguccggcauuaccgaggucgauagaacggaggcgaaagaagggcucaagcggggagagaucacccaccaugccgugucucgcggcagcgcuaaacuucagugguucguggaaagaaacaugguuauucccgaggggcgggucaucgaccugggauguggccgcggcgggugguccuauuacugcgccggacugaagaaggugacagaagugagaggcuauaccaaagggggaccuggccacgaggagcccgucccuaugucuacauacggguggaauaucguuaagcucaugagcggaaaagauguguuuuaccugcccccggaaaagugugacacccuucugugcgauauuggcgaguccagcccuucucccacaguggaagagucccggaccauccgcguccucaaaaugguggagcccuggcugaagaacaaucaguucuguauuaagguucugaacccuuauaugcccacggugaucgaacaccucgagagacuucaacggaaacauggcgggaugcugguccgcaauccucugagcagaaacucuacacacgaaauguacuggauuuccaauggaaccggcaacaucguggcuagcguuaauauggugucucggcuccugcuuaacagauucaccaugacacaucgccggccgacgaucgagaaggacgucgaucugggggccggaaccagacacgugaacgcugaacccgagacaccuaauauggacgugauuggcgagcgcaucaaacggauuaaggaggaacacaacagcaccuggcauuaugacgaugaaaaucccuacaaaacaugggccuaucacggguccuacgaggucaaggcgaccggaucugccagcuccaugaucaacggcguugugaagcuccugacaaaaccuugggacgugguccccauggugacccagauggcuaugacggauaccacaccguuuggccagcaaagaguuuucaaggaaaaaguggacacccgcacaccucggagcaugcccgggaccagacgcgucaugggaauuacggccgaguggcuguggcggacacucggcagaaauaagaaaccucgccugugcacccgggaggaauuuacaaagaaggugagaaccaacgcugccaugggggccguuuucacggaggaaaaucagugggauuccgcgaaagcugccguggaggacgaagauuuuuggaaacuugucgaccgcgagagagagcugcauaaacucggaaaguguggcucuugcguguauaacaugauggggaaacgggaaaagaaacugggcgaguucggaaaggccaagggcagccgcgcuaucugguacauguggcuuggggccagauaccuggaauuugaggcucucggauuccugaaugaggaucacugguuuucccgggaaaacucuuauagcggcguugagggggaaggacugcauaaacucggcuacauccugagagacauuuccaagauccccgggggcgccauguaugcggaugacaccgccggaugggacacacggauuaccgaggaugaccuucacaaugaagagaaaaucacacagcagauggauccugagcaccgccaacuggcuaacgccauuuucaagcucaccuaccagaauaaaguggucaaggugcagagacccacaccgaccggcacggucauggacaucaucucucggaaggaucagcgcgggagcggacaagugggcacauaugggcugaacaccuuuaccaauauggaagcucagcuuauuagacagauggagggagaaggcguucuguccaaagccgaccucgagaacccucaucugcccgaaaagaaaaucacacaguggcuggagaccaaggggguggagcggcucaaacgcauggcgauuagcggcgaugacugcgucgugaagcccaucgaugacagauucgccaacgcucugcuugcccugaaugauaugggaaaggugcggaaagacauuccucaauggcagccgucuaagggcuggcacgauuggcagcagguucccuuuuguucccaucacuuccacgaacucaucaugaaagacgggcgcaagcugguggucccuugcagaccccaagacgagcuuauuggacgggcucgcaucagccagggcgccggguggucucugaaagaaacagcuugucucggaaaggccuacgcgcagauguggucccugauguauuuccauagacgggaucugcgccucgccagcaacgcuaucugcucugccgugccuguucacugggugcccacguccagaaccacauggagcauucaugcccaccaucaauggaugaccacagaggacaugcugaccgucuggaaucggguguggaucgaagauaacccuuggauggaggacaagacgcccgucaccacaugggagaaugugccguaccuuggcaaaagagaagaucaguggugugggucccugauuggccucaccagccgcgcuacaugggcccagaacaucccuaccgcgauucagcaaguucggucucugaucggaaaugaggaauuucuugacuacaugcccagcaugaagagauuccgcaaagaggaggaauccgagggcgcuaucugguga

SEQ ID NO: 20610 - RNA, 9873 nt, Artificial Sequence
  derived and/or modified CDS sequence (opt5) from DENV-3__KF973485__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaauaaaaaggagcuucuggucaccuuuaaaaacgcucacgcgaagaagcaagaaguggucgugcucgggucucaggagggagccaugcacacagcucugaccggcgccaccgaaauccaaaauuccgggggcacaagcauuuucgccggacaucugaaaugucggcucaagauggacaaacuggagcuuaagggcaugucuuacgcuaugugcacgaacaccuuuguucugaaaaaggagguguccgaaacacagcacgggaccauccucaucaaggucgaguacaaaggagaagaugugcccuguaagauuccuuucagcacagaggacggccaagggaaagcccauaacggacgccugaucaccgcgaaucccguugugacgaagaaagaggaacccgucaacauugaggcugaaccuccguucggcgaguccaauaucgugauugggaucggcgauaacgcccugaagaucaauugguauaagaaaggaucuagcauuggcaagauguuugaagccacagcuagaggggcccggagaauggcuauccuuggagacaccgccugggauuucggcuccgucggcgggguucucaacagccuggggaaaaugguccaccagauuuuugggucugcguacaccgcccuguucuccggcgugagcugggugaugaagaucggaauuggcguccuccugacauggaucgggcuuaauucuaaaaacaccagcauguccuuuucuugcauugcuaucggaaucauuacacuguaucucggcgccgugguucaggcugacauggggugugugaucaauuggaagggaaaggagcugaaaugcggcagcgggauuuucgucacgaacgaggugcauaccuggacagaacaguacaaguuucaagccgauucccccaaacgccuggcgaccgccaucgcuggcgccugggagaauggaguuuguggcauucggagcacaaccagaauggaaaaccuucucuggaagcagaucgcuaaugagcugaacuauauccugugggaaaauaacauuaaacucacgguggucgugggggacaucauuggaguucuggagcagggcaagcgcacccuuacaccucagcccauggagcugaaauacucuuggaagaccugggggaaggccaaaaucgugacagccgaaacccaaaacuccagcuucauuaucgauggaccuaauacacccgagugcccgucugucucccgggcuuggaacgugugggaaguggaggacuauggcuuuggcgucuucaccacgaauaucuggcucaagcugagagaaguucacacacagcugugugaccaccgccuuaugagcgcggccgugaaagaugagcgggcugugcaugccgacaugggguacuggauugagucccagaagaacggaucuuggaaacucgaaaaggccagccugaucgaggucaagaccugcaccuggccuaaaucccacacacuguggucuaauggcgugcucgaaagcgauaugauuauccccaagucccuggcugggccuauuagccagcauaaccacagacccggauaccacacccaaacggccggcccuuggcaucuugggaaacuggagcucgacuuuaauuauugcgagggaacaaccguugugaucacagaaaacuguggcacccgcggccccucucugcggacaaccacggucuccgggaagcugauccacgaguggugcuguagaagcugcacccuuccgccucuccgcuacaugggagaagauggcuguugguaugggauggagauucggcccaucucugaaaaagaggagaauauggugaagucccugguuagcgcgggaucuggcaagguggacaacuucacaauggggguccugugccucgcuauucuguuugaagaggugaugagaggaaaauucggcaagaaacauaugaucgccggcguuuucuuuaccuucgugcuucugcucagcgggcagauuacauggcgggauauggcccacacccugaucaugauuggauccaaugcuagcgaccgcaugggcaugggggucacguaccuggcccuuaucgcgacauuuaagauccagcccuuccuggcucucggauuuuuccugagaaaacucaccucucgggaaaaccugcuucugggcguggggcucgccauggccacaacccugcaacugccugaggauauugaacagauggcuaauggaaucgcccuuggccugauggcucucaagcugauuacccaguuugagacauaucagcucuggacggcccugaucucccuuaccuguagcaacacaauuuucacccugacaguggcguggagaaccgccacgcucauccuggcuggcgucucccugcuuccgguuugccaaucuagcuccaugcgcaagacagacuggcugcccauggccguggcugccaugggggugccuccccucccucuguuuaucuucggacucaaagauacccugaagcggagaucuuggccccuuaaugagggcgucauggccguggggcugguuagcauucuggcuuccucucuccugcgcaacgacgugccuauggcgggaccccuugucgccggcgggcugcucaucgcuuguuacgugauuaccggaacaagcgccgaucugaccguugaaaaagccgcugacaucacaugggaggaagaggccgaacagacgggcgugucccauaaccucaugauuaccgucgacgaugacggcacaaugagaaucaaggaugacgagaccgagaauauccugacagugcuucugaaaaccgcgcugcucauugucagcgggaucuuuccguauucuauuccugcuacgcugcuuguguggcacaccuggcagaagcagacacaacgguccggaguucugugggaugugcccagcccucccgaaacccagaaagccgagcucgaagagggcgucuaccgcaucaagcagcaggggauuuucggaaagacacaagugggcguuggggugcagaaagagggagucuuucacaccauguggcaugugacaagaggcgccgugcugacguacaacggcaagcggcucgaaccgaauugggcuucuguuaaaaaggaccugaucuccuaugggggaggcuggcgccuuagcgcccaguggaaaaagggggaggaaguccaagugauugcgguggagccuggaaagaaccccaaaaauuuccagaccaugccuggcacauuccagaccaccacaggggaaaucggagcuaucgcccuggauuuuaagcccggcacgucuggcucccccauuaucaacagagaggggaaagucgugggacuguacggcaaugggguugugaccaagaacggaggcuaugucagcgggauugcccagacaaaugcugagccugacggcccgacccccgaacucgaggaagagauguucaaaaagcggaaccugacaaucauggaucuucacccuggauccggcaagacccgcaaauaccugcccgccauugugagagaagcuaucaagcggcgccucagaacgcugauccucgccccuacacggguuguggcggccgagauggaggaagcucugaaagggcuucccauuagauaucaaaccaccgccacaaagagcgagcauaccggacgcgaaaucgucgaccugaugugccacgcuacauuuaccaugcggcugcucucuccugugagaguuccgaauuacaaccugauuaucauggaugaggcccauuucacggaccccgccagcauugcugcgcgcggcuauaucuccacacggguggggaugggagaagccgcugccaucuuuaugaccgccacaccucccggcaccgcugaugccuucccucagucuaaugcgcccauucaggacgaggagagagacaucccggaacgcagcuggaacuccgggaaugaguggauuacggauuuugcuggcaaaaccgucugguucgugccuucuaucaaggccggaaacgacauugccaacugucuucggaagaauggcaaaaaggugauccagcugagcagaaaaacauuugauaccgaauaccaaaagacaaaacucaacgacugggauuucgucguuaccacagacauuuccgagaugggggcuaauuuuaaggccgaucgcgugaucgacccccggagaugccugaagcccgugauccugaccgauggaccugagcgggucauucucgcgggccccaugccugugacgguugccucugcugcccagcgcagagggcgggugggacgcaacccgcagaaagaaaaugaccaguacaucuucacaggccaaccccuuaacaaugaugaggaccacgcucacuggaccgaagccaagaugcugcuggacaacauuaauaccccugaggggaucauucccgcucucuucgaaccugagagagagaaaagcgccgcgaucgauggcgaauaucggcugaagggagaguccagaaaaacauuugucgaacuuaugcgccggggcgaccugcccguguggcucgcccauaagguugcuagcgaggggaucaaauacaccgauagaaaguggugcuucgacggacagcgcaacaaucagauucuggaagagaacauggauguggagaucuggacaaaggaaggcgagaaaaagaaacugcggccgagauggcucgacgcccgcacguauucugauccucuugcucugaaggaauuuaaagaguucgccgccgggcggaaguccauugcucuggaccucgucaccgaaaucggaagagugcccagccaccuggcgcaucgcacaagaaaugcccuugauaaccuggucaugcuccacaccucugagcacggcggccgggcuuaccgccaugccguggaggaacugccugagacaauggaaacccugcuccuucuggggcugaugauucuccugacgggaggcgccaugcuuuuucugaucuccgggaagggaaucggcaaaaccagcauugggcucaucuguguuauugcuuccucuggaaugcuguggauggccgagaucccccugcaguggauugcgagcgccaucgugcucgaguucuuuaugauggugcuucugauuccugaacccgagaagcaaagaacaccgcaggacaaucagcuggcuuaugucguuaucggcauccucacccuggccgcuauuaucgccgcgaacgaaaugggccuucuggagacaaccaaacgggaucucgggauguccaaggaaccuggaguggugagccccacgucuuaccuggacgucgaucugcaccccgccuccgcuuggacacucuaugccguggcuaccacaguuauuaccccuaugcuucgccauaccaucgagaauagcacagccaacgugucucuggcugccauugcgaaccaagccgucgugcugaugggccucgacaaaggguggccgaucagcaagauggaccugggagucccccuucuggcucucggcugcuacucccaggugaauccucugacgcugaccgccgcuguucuccuucugaucacacacuacgccauuaucgggcccggacugcaggccaaggcgaccagagaggcucagaaacggacagccgcuggcauuaugaagaacccuaccguggauggcaucaugacgauugaccucgaucccgucaucuaugacucuaaauucgaaaagcaacugggacaggugaugcuucugguucucugugugguccagcugcugcucaugagaacaagcugggcccuuugcgaggcccugacccuggcuaccggaccuaucacaacccucugggaaggcuccccggggaaauuuuggaauacaacgauugccgugucuauggcgaacaucuuccgcggaagcuaccuggccggcgcugggcuugccuuuuccauuaugaaaagcgugggaaccggcaagcggggcacagggucucagggagagacccugggcgaaaaauggaagaaaaagcucaaucaacuguccagaaaagauuucgaccuguauaagaaaagcgggaucacagagguugaucgcaccgaggcuaaggaaggacucaagcggggcgagauuacgcaucacgccgucuccagagggucugcgaaacuucagugguuuguggaacggaacauggugauccccgagggacgcgucauugaccugggcuguggcagagggggauggagcuacuauugcgccggccugaagaaaguuaccgaagugcggggguacacaaagggaggcccugggcacgaggagcccgugccuauguccaccuauggauggaauaucgucaaacucaugucuggcaaggauguguucuaccugcccccggaaaagugugacacacuucugugcgauaucggcgagagcuccccuagccccaccguugaagagucucgcacaauuagagugcucaaaauggucgagcccuggcugaagaacaaucaguucuguaucaaagugcugaacccuuacaugcccaccguuauugaacaucucgagcggcuucagcgcaagcacgggggaaugcuggugagaaauccucugucccggaacagcacgcaugaaauguauuggaucucuaauggcacagggaacauugucgcuuccgugaauauggugagccgccuccugcuuaacagauuuaccaugacccaccggagaccgacaaucgagaaagacgucgaucugggagccggcacgcgccacguuaacgcugaacccgagaccccuaauauggaggugaucggggaacggauuaagagaaucaaggaggaacauaacucuacauggcacuacgacgacgagaaucccuauaaaaccugggccuaccauggaagcuaugaagugaaggcuacaggcuccgccucuagcaugauuaacggcgucgugaaacuccugaccaagccuugggauaugguucccauggugacacaaauggcgaugaccgacacgaccccguucgggcagcagcgcgucuuuaaagagaagguggauacacggaccccuagauccaugcccggaacacgccggguuaugggcaucaccgccgaguggcuguggagaacgcucgggcgcaauaagaaaccucggcugugcacaagagaagaguucaccaagaaagugcgcacaaacgcugccaugggagcugucuuuaccgaagagaaucaaugggacagcgccaaggccgcgguggaagaugaggacuucuggaaacuuguugaucgggagagagaacugcacaagcucggcaaauguggguccugcguguacaacaugaugggcaagcgcgagaagaaacugggagaauuuggcaaggcuaaagggucuagagccauuugguauauguggcuuggagcccgguaccuggaguucgaggcucucggcuuucugaaugaagaccauugguucagccgcgagaacuccuacucuggggucgaaggagagggccugcacaagcucggguauauccugagagauaucagcaaaauucccggcggagccauguacgcugacgauacggccggcugggacacccggaucacagaagacgaucuucacaaugaggagaagauuacccagcagauggacccugaacauagacagcuggcggaugccaucuuuaagcucacauaucaaaacaaaguggucaaggugcagcggcccaccccgacagggaccguuauggacauuaucucccgcaaagaucagagaggaucuggccagguggggacguacggacugaauacauucaccaacauggaggcucaacuuauccggcagauggaaggcgaggggguccugagcaaggccgaccucgaaaauccucaucugcccgagaaaaagauuacccaguggcuggagacaaagggcguggaacgccucaaaagaauggcuaucuccggagaugacugcgugguuaagcccauugaugaccgguuugccaacgcgcugcuugcccugaacgauaugggcaaagugcgcaaggacaucccucaguggcaaccgagcaaaggguggcaugauuggcagcagguccccuucuguucucaccacuuccaugagcucauuaugaaggacggaagaaagcuggugguuccuugccggccccaggacgaacuuaucggccgcgcuagaauuucccaaggggccggauggagccugaaagagaccgcuugucucggcaaggccuaugcucagauguggucucugauguacuuucaccggcgcgaucugagacucgccuccaaugcgaucugcagcgccgugccuguccauugggugcccacaucucggacgaccugguccauccacgcucaucaccaguggaugacaaccgaagacaugcugacagucuggaaccgcguguggauugaggauaauccuuggauggaggacaaaacccccguuacgaccugggaaaacgugccguaucuugggaagagagaggaucaaugguguggcagccugaucggacucacaucccgggccaccugggcccagaauauuccuacagcuauccagcaggucagaagccugauuggcaacgaagaguuccuugacuacaugcccucuaugaaacgcuuucggaaggaggaagagagcgaaggggccaucugguga

SEQ ID NO: 20611 - RNA, 9873 nt, Artificial Sequence
  derived and/or modified CDS sequence (opt5) from DENV-3__KF973486__SS-prME
accagccugugccucaugaugauccugcccgccgcucuugccuuccaccugacaucccgggacggagaaccucggaugauuguggggaagaacgaacgcggaaaaucucuccuguuuaagacggccagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaagggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggccagacgcauggcuauccuuggagacaccgccugggauuucggcuccgucggcgggguucucaacagccuggggaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcgggaucuggcaagguggacaacuucacaauggggguccugugccucgcuauucuguuugaagaggugaugcggggaaaguucggcaaaaagcacaugaucgccggcguuuucuuuaccuucgugcuucugcucagcgggcagauuacauggcgcgauauggcccauacccugaucaugauuggauccaaugcuagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccauggccguggcugccaugggggugccuccccucccucuguuuaucuucggacucaaggauacccugaaaagacgcucuuggccccuuaaugagggcgucauggccguggggcugguuagcauucuggcuuccucucuccugagaaacgacgugccuauggcgggaccccuugucgccggcgggcugcucaucgcuuguuaugugauuaccggaacaagcgccgaucugaccguugaaaaggccgcugacaucacaugggaggaagaggccgaacagacgggcgugucccacaaccucaugauuaccgucgacgaugacggcacaaugcggaucaaagaugacgagaccgagaauauccugacagugcuucugaagaccgcgcugcucauugucagcgggaucuuuccguacucuauuccugcuacgcugcuuguguggcauaccuggcagaaacagacacaacgcuccggaguucugugggaugugcccagcccucccgaaacccagaaggccgagcucgaagagggcgucuacagaaucaaacagcaggggauuuucggaaagacacaagugggcguuggggugcagaaggagggagucuuucacaccauguggcacgugacacggggcgccgugcugacguauaacggcaaacgccucgaaccgaauugggcuucuguuaagaaagaccugaucuccuacgggggaggcuggagacuuagcgcccaguggcaaaagggggaggaaguccaggugauugcgguggagccuggcaagaaccccaagaauuuccagaccaugccuggcacauuccagaccaccacaggggaaaucggagcuaucgcccuggauuuuaagcccggcacgucuggcucccccauuaucaaccgggaggggaaagucgugggacuguauggcaaugggguugugaccaagaacggaggcuacgucagcgggauugcccaaacaaaugcugagccugacggcccgacccccgaacucgaggaagagauguucaaaaagcgcaaccugacaaucauggaucuucauccuggauccggcaaaaccagaaaguaucugcccgccauugugcgggaagcuaucaagcgcagacuccggacgcugauccucgccccuacaagaguuguggcggccgagauggaggaagcucugaaagggcuucccauucgcuaccagaccaccgccacaaagagcgagcacaccggacgggaaaucgucgaccugaugugccaugcuacauuuaccaugagacugcucucuccugugcgcguuccgaauuauaaccugauuaucauggaugaggcccacuucacggaccccgccagcauugcugcgcggggcuacaucuccacaagaguggggaugggagaagccgcugccaucuuuaugaccgccacaccucccggcaccgcugaugccuucccucagucuaaugcgcccauucaggacgaggagcgcgacaucccggaacggagcuggaacuccgggaaugaguggauuacggauuuugcuggcaaaaccgucugguucgugccuucuaucaaggccggaaacgacauugccaacugucuucgcaaaaauggcaagaaggugauccaacugagcagaaaaacauuugauaccgaauaccagaagacaaaacucaacgacugggauuucgucguuaccacagacauuuccgagaugggggcuaauuuuaaggccgaucgggugaucgaccccagacggugccugaaacccgugauccugaccgauggaccugagcgcgucauucucgcgggccccaugccugugacggccgcuucugccgcucagagacgggggcgcguuggaagaaacccgcagaaggaaaaugaccaauauaucuucacaggccagccccuuaacaaugaugaggaccaugcccacuggaccgaagcuaagaugcugcuggacaacauuaauaccccugaggggaucauucccgcccucuucgaaccugagcgggagaaaagcgcggccaucgauggcgaauacagacugaagggagagucccgcaaaacauuuguggaacuuaugcggagaggcgaccugcccgucuggcucgcucacaagguggccagcgaggggaucaaauauaccgaucgcaaguggugcuucgacggacagcggaacaaucagauucuggaagagaacauggauguugagaucuggacaaaagaaggcgagaagaagaaacugagaccgcgcuggcucgacgcucggacguacucugauccucuugcccugaaggaauuuaaagaguucgccgcugggagaaaguccauugcgcuggaccucgugaccgaaaucggacgcguccccagccaucuggcccacagaacacggaaugcucuugauaaccuggugaugcuccauaccucugagcacggcggccgcgccuauagacacgccgucgaggaacugccugagacaauggaaacccugcuccuucuggggcugaugauucuccugacgggaggcgcuaugcuuuuucugaucuccgggaaaggaaucggcaagaccagcauugggcucaucugugugauugccuccucuggaaugcuguggauggcggagaucccccugcaauggauugccagcgcuaucguucucgaguucuuuaugauggugcuucugauuccugaacccgagaagcagcggacaccgcaggacaaucaacuggccuacguggucaucggcauccucacccuggcugccauuaucgcggccaacgaaaugggccuucuggagacaaccaaacgcgaucucgggauguccaaggaaccuggaguugugagccccacgucuuaucuggacguggaucugcaucccgcuuccgccuggacacucuacgcugucgccaccacagugauuaccccuaugcuuagacacaccaucgagaauagcacagcuaacguuucucuggccgcgauugccaaccaggcugugguccugaugggccucgacaaaggguggccgaucagcaagauggaccugggagcgccccuucuggcucucggcugcuacucccaggugaauccucugacgcugaccgccgccguccuccuucugaucacacauuaugcgauuaucgggcccggacugcaggcuaaagccacccgggaggcucaaaagagaacagccgccggcauuaugaagaacccuaccguggauggcaucaugacgauugaccucgaucccguuaucuacgacucuaaauucgaaaagcagcugggacaggugaugcuucugguccucugugcugugcagcugcugcucaugcgcacaagcugggcccuuugcgaggcgcugacccuggccaccggaccuaucacaacccucugggaaggcuccccggggaaauuuuggaauacaacgauugcuguuucuauggccaacaucuuccggggaagcuaucuggcuggcgccgggcuugcguuuuccauuaugaaaagcgugggaaccggcaaaagaggcacagggucucaaggagagacccugggcgaaaaguggaagaaaaagcucaaucagcugucccgcaaagauuucgaccuguacaagaaaagcgggaucacagaggucgaucggaccgaggccaaggaaggacucaaaagaggcgagauuacgcaccaugcugugucccgggggucugccaaacuucagugguuuguggaacgcaacaugguuauccccgagggaagagucauugaccugggcuguggcagagggggauggagcuauuacugcgcuggccugaagaaagugaccgaagugcgcggguauacaaagggaggcccugggcacgaggagcccgucccuauguccaccuacggauggaauaucguuaaacucaugucuggcaaggauguguucuaccugcccccggaaaaaugugacacacuucugugcgauaucggcgagagcuccccuagccccaccguggaagagucuagaacaauucggguccucaagaugguggagcccuggcugaagaacaaucaguucuguaucaaaguucugaacccuuauaugcccaccgugauugaacaccucgagcgccuucaaagaaagcaugggggaaugcugguccggaauccucugucccgcaacagcacgcacgaaauguacuggaucucuaauggcacagggaacauuguggccuccguuaauauggugagcagacuccugcuuaaccgguuuaccaugacccauagacgcccgacaaucgagaaagacgucgaucugggagcuggcacgcggcacgugaacgccgaacccgagaccccuaauauggacgugaucggggagagaauuaagcgcaucaaagaagaacacaacucuacauggcauuaugacgaugaaaaucccuacaagaccugggcguaucacggaagcuacgaggucaaggccacaggcuccgcuucuagcaugauuaacggcguugugaaacuccugaccaagccuugggacgugguccccauggugacacagauggccaugaccgauacgaccccguucgggcagcaacggguuuuuaaagaaaagguggacacaagaaccccucgcuccaugcccggaacacggagagucaugggcaucaccgcugaguggcuguggcgcacgcucgggcggaauaaaaagccuagacugugcacacgcgaggaguucaccaagaaagugcggacaaacgccgccaugggagcgguuuuuaccgaggaaaaucagugggauagcgcuaaggccgccguggaggacgaagauuucuggaaacuugucgacagagagcgcgagcugcauaagcucggcaaauguggguccugcguguauaacaugaugggcaagagagagaagaagcugggagaguuuggcaaggcuaaagggucucgggccauuugguacauguggcuuggagcucgcuaccuggaguucgaggcccucggcuuucugaaugaggaucacugguucagcagagaaaacuccuauucugggguugagggagaaggccugcauaagcucggguacauccugcgggacaucagcaaaauucccggcggagcgauguaugccgaugacacggcuggcugggacaccagaaucacagaggaugaccuucacaaugaagagaagauuacccagcagauggauccugagcaccggcaacuggccaacgcuaucuuuaaacucacauaccagaauaagguggucaaggugcagcgccccaccccgacagggaccgucauggacauuaucuccagaaaagaucagcggggaucuggccaaguggggacguauggacugaacacauucaccaauauggaagcccagcuuauccgccagauggagggcgaagggguucugagcaaggcggaccucgagaacccucaucugcccgagaaaaagauuacccaguggcuggagacaaaaggcguggagagacucaagcggauggccaucuccggagaugacugcgucgugaagcccauugaugaccgcuuugcuaacgcccugcuugcucugaaugauaugggcaaagugagaaaggacaucccucaauggcagccgagcaaaggguggcacgauuggcagcagguucccuucuguucucaucacuuccacgaacucauuaugaaggacggacggaaacugguggucccuugccgcccccaagacgagcuuaucggcagagcccggauuucccagggggcuggauggagccugaaggaaaccgccugucucggcaaggcguacgcccagauguggucucugauguauuuucaucgcagagaucugcggcucgcuuccaacgccaucugcagcgccgugccuguucacugggugcccacaucucgcacgaccugguccauccaugcucaccaucaauggaugacaaccgaggacaugcugacagucuggaauagaguguggauugaagauaacccuuggauggaggacaaaacccccgucacgaccugggagaaugugccguaccuugggaagcgggaagaucagugguguggcagccugaucggacucacauccagagccaccugggcgcagaacauuccuacagcuauccagcaaguucgcagccugauuggcaaugaggaguuccuugacuacaugcccucuaugaaacgguuuagaaaggaggaggaaagcgagggggccaucugguga

SEQ ID NO: 20612 - RNA, 9873 nt, Artificial Sequence
  derived and/or modified CDS sequence (opt5) from DENV-3__FJ898458__SS-prME
acaagccugugccucaugaugauccugcccgccgcucuugccuuccaccugacaucccgggacggcgaaccucggaugauuguggggaagaacgaacgcggaaaaacgcuccuguuuaagacagcgucuggcaucaauauguguacacuuauugcuauggaucugggggaaaugugcgacgauaccgucacauacaaauguccgcauaucaccgaaguugagcccgaagacauugauugcugguguaaccucacaagcaccugggugacguauggaaccugcaaucaggccggcgagcacagacgggacaagcgcuccguggcccuggcuccucaugucgggaugggacuggauacaagaacccagacauggaugucugccgagggcgcuuggagacagguggaaaaaguugagaccugggcccuccgccaccccggcuucacgauccuggcgcuuuuucuggcccauuacaucgggacaagccucacccagaagguggucauuuucauccugcuuaugcuggugacaccuuccaugaccaugagauguguuggagugggcaaccgggacuuugucgaagggcucucuggagcuaccuggguggaugugguccuggagcacggcgggugcguuacaacgauggccaagaauaaacccacccuggacauugagcuccagaagacagaagcuacccagcuggccacacuucgcaaacuguguaucgagggaaagauuaccaacaucacgacagauagcagaugcccuacccagggcgaagcggugcucccggaggaacaggaccagaauuauguguguaaacacaccuacgucgaucggggcugggggaacggaugcggccuguucgggaagggaucccuugugacaugcgccaaguuucaaugucuggagcccauugagggcaaaguugugcaguaugaaaaucucaaguacaccgucaucaucacagugcauacgggggaccagcaccagguuggaaacgagacccaaggcgugacagcugaaauuaccccucaggccagcacaaccgaggcuauccugcccgaauauggcacgcuggggcucgagugcucuccucgcaccggacuggacuucaaugagaugauucuucugacaaugaaaaacaaggccuggaugguccauagacagugguuuuucgaucucccccugccguggaccuccggcgccacaaccgaaacgccuacauggaaucggaaagagcuucuggugaccuuuaagaacgcucacgcgaaaaagcaagaagucgugguucucgggagccaggagggagccaugcacacagcucugaccggcgccaccgaaauccaaaauucugggggcacauccauuuucgccggacaucugaagugucgccucaaaauggacaagcuggagcuuaaaggcaugagcuacgcuaugugcacgaacaccuuugugcugaagaaagaggucucugaaacacagcacgggaccauccucaucaagguggaguacaagggagaagauguucccuguaaaauuccuuucuccacagaggacggccaugggaaggcccacaacggaagacugaucaccgcgaaucccguggucacgaaaaaggaggaacccgugaacauugaggcugaaccuccguucggcgagagcaauaucgugauugggaucggcgauaacgcccugaaaaucaauugguauaagaagggauccucuauuggcaaaauguuugaagccacagcuagaggggccagacgcauggcuauccuuggagacaccgccugggauuucggcagcguugggggaguccucaacucccugggcaagauggugcaucaaauuuuugggagcgcguacaccgcccuguucucuggcguguccugggucaugaaaaucggaauuggcgugcuccugacauggaucgggcuuaauagcaagaacaccucuaugagcuuuuccugcauugcuaucggaaucauuacacuguaucucggcgccguugugcaggcugacauggggugugucaucaauuggaaaggaaaggagcugaagugcggcucugggauuuucgugacgaacgagguucacaccuggacagaacaguacaaauuucaggccgauagccccaagcggcuggcgaccgccaucgcuggcgccugggagaauggaguguguggcauuagauccacaacccgcauggaaaaccuucucuggaaacaaaucgcuaaugagcugaacuauauccugugggaaaauaacauuaagcucacggucgugguuggggacaucauuggagugcuggagcagggcaaacggacccuuacaccucagcccauggagcugaaguacagcuggaaaaccugggggaaggccaagaucgucacagccgaaacccagaacucuuccuucauuaucgauggaccuaauacacccgagugcccgagcgcuucuagagcguggaacgugugggaaguggaggacuauggcuuuggcgucuucaccacgaauaucuggcucaaacugcgcgaaguuuacacacaacugugugaccaccggcuuauguccgccgcugugaaggaugagagagccgugcaugccgacaugggguacuggauugagagccagaaaaacggauccuggaagcucgaaaaggcuucucugaucgaggucaagaccugcaccuggccuaagagccacacacugugguccaauggcgugcucgaaucugauaugauuauccccaaaagccuggccgggccuauuucccagcauaaccaccgccccggauaucacacccagacggcgggcccuuggcaucuugggaagcuggagcucgacuuuaauuacugcgagggaacaaccguugugaucacagaaaacuguggcacccggggccccagccugagaacaaccacggucucugggaaacugauccacgaguggugcugucgcuccugcacccuuccgccucuccgguauaugggagaagauggcuguugguacgggauggagauuagacccaucagcgaaaaggaggagaauauggugaaaucucugguuuccgcuggaagcggcaagguggacaacuucacaauggggguccugugccucgccauucuguuugaagaggugaugcggggaaaguucggcaaaaagcauaugaucgccggcguuuucuuuaccuucgugcuucugcucucugggcaaauuacauggcgcgauauggcucacacccugaucaugauuggaagcaaugccuccgacagaaugggcaugggggucacguaucuggcgcuuaucgcuacauuuaaaauccagcccuuccuggcccucggauuuuuccugcggaagcucaccagcagagaaaaccugcuucugggcguggggcucgccauggcuacaacccugcagcugccugaggauauugaacaaauggccaauggaaucgcucuuggccugauggcccucaaacugauuacccaguuugagacauaccagcucuggacggcgcugaucucucuuaccuguuccaacacaauuuucacccugacaguggccuggcgcaccgcuacgcucauccuggccggcgucagccugcuuccgguuugccaguccucuagcaugcggaagacagacuggcugcccaugaccguggcugccaugggggugccuccccucccucuguuuaucuucucccucaaggauacccugaaaagacgcucuuggccccuuaaugagggagucauggccgugggccugguuagcauucuggcuuccucucuccugagaaacgacgugccuauggcggggccccuugucgccggaggccugcucaucgcuuguuaugugauuacagggaccagcgccgaucugacaguugaaaaggccgcugacaucacgugggaggaagaggccgaacaaaccggagugucccauaaccucaugauuacagucgacgaugacggcaccaugcggaucaaagaugacgagacagagaauauccugaccgugcuucugaagacggcgcugcucauugucagcggcaucuuuccguacucuauuccugcuacccugcuuguguggcacacauggcagaaacagacccagcgcuccgggguucugugggaugugcccagcccucccgaaacacaaaaggccgagcucgaagagggagucuacagaaucaaacagcagggcauuuucgggaagacccaggugggaguuggcgugcaaaaggagggggucuuucacacaauguggcaugugacgcggggagccgugcugaccuauaacggcaaacgccucgaaccgaauugggcuucuguuaagaaagaccugaucuccuacggcgggggauggagacuuagcgcccaguggaagaaaggcgaggaaguccaggugauugcgguggagccugggaagaaccccaagaauuuccaaacaaugccuggaaccuuccagaccacaacgggcgaaaucggggcuaucgcccuggauuuuaaacccggaaccucuggcucccccauuaucaaccgggagggcaaggucguggggcuguauggaaauggcguugugaccaagaacgggggauacgucagcggcauugcccagaccaaugcugagccugacgggccgacacccgaacucgaggaagagauguucaagaaacgcaaccugaccaucauggaucuucacccuggcuccggaaagacgagaaaguaucugcccgccauugugcgggaagcuaucaaacgcagacuccggacacugauccucgccccuaccagaguuguggcggccgagauggaggaagcucugaagggccuucccauucgcuaccagaccacagccaccaaaagcgagcauacagggcgggaaaucgucgaccugaugugccacgcuaccuuuacgaugagacugcucucuccugugcgcguuccgaauuauaaccugauuaucauggaugaggcccauuucacagaccccgccagcauugcugcgcggggauacaucuccaccagagugggcaugggggaagccgcugccaucuuuaugacagccaccccucccggaacggcugaugccuucccucaaucuaaugcgcccauucaggacgaggagcgcgacaucccggaacggagcuggaacuccggcaaugaguggauuaccgauuuugcugggaagacagucugguucgugccuucuaucaaagccggcaacgacauugccaacugucuuagaaagaauggaaagaaagugauccagcugagccgcaagaccuuugauacagaauaccagaaaaccaagcucaacgacugggauuucgucguuacaaccgacauuuccgagaugggcgcuaauuuuaaagccgaucgggugaucgaccccagacggugccugaagcccgugauccugacggaugggccugagcgcgucauucucgcgggacccaugccugugacagccgcuucugccgcucaaagacggggccgcguugggagaaacccgcagaaggaaaaugaccaguauaucuucaccggacagccccuuaacaaugaugaggaccacgcccacuggaccgaagcuaaaaugcugcuggacaacauuaauacaccugagggcaucauucccgcccucuucgaaccugagcgggagaaaagcgcggccaucgauggggaauacagacugaaaggcgaaucccgcaagaccuuuguggaacuuaugcggagaggagaccugcccgucuggcucgcucauaaaguggccagcgagggcaucaaguauacagaucgcaaauggugcuucgacgggcaacggaacaaucagauucuggaagagaacauggauguugagaucuggacgaaggaaggagagaagaaaaagcugagaccgcgcuggcucgacgcucggaccuacucugauccucuugcccugaaagaauuuaaggacuucgccgcuggcagaaaauccauugcgcuggaucucgugacagagaucgggcgcguccccagccaccuggcccauagaacccggaaugcucuugacaaccuggugaugcuccacacaucugaacacggaggccgcgccuauagacaugccgucgaggagcugccugaaaccauggagacgcugcuccuucugggccugaugauucuccugaccgggggagcuaugcuuuuucugaucuccggcaaggggaucggaaagacaagcauuggccucaucugugugauugccuccucugggaugcuguggauggcggaaaucccccugcaguggauugccagcgcuaucguucucgaguucuuuaugauggugcuucugauuccugagcccgaaaaacagcggaccccgcaagauaaucagcuggccuacguggucaucggaauccucacacuggcugccauuaucgcggccaacgagaugggccuucuggaaaccacgaagcgcgaccucggcauguccaaagagccugggguugugagccccacaucuuaucuggauguggaccugcaccccgcuuccgccuggacccucuacgcugucgccacaaccgugauuaccccuaugcuuagacauacaaucgaaaauagcacggcuaacguuucucuggccgcgauugccaaccaggcugugguccugaugggacucgacaagggcuggccgaucagcaaaauggaucugggggugccccuucuggcccucggaugcuacucccaagucaauccucugacccugacagcugccgugcuccuucugaucacccacuaugccauuaucggccccgggcugcaggcgaaggcuacacgggaggcccagaagagaaccgcugccggaauuaugaaaaacccuacgguugacggcaucaugacaauugaucucgaccccgugaucuacgauucuaaguucgagaaacagcugggccaagucaugcuucuggugcucugugccguucagcugcugcucaugcgcaccagcugggcucuuugcgaagcccugacccuggcgacagggccuaucaccacacucugggagggauccccgggcaaguuuuggaauacgaccauugccgugucuauggcuaacaucuuccgggggagcuaucuggccggagcuggccuugccuuuuccauuaugaaaagcgucgggacaggaaagagaggcaccggcucucagggggaaacacugggagagaaguggaaaaagaaacucaaucagcugucccgcaaggaguucgaccuguacaaaaagagcggcaucaccgagguggaucggacggaggcgaaagaagggcucaagagaggagagauuacccaucacgccgugucccggggcucugcuaaacuucaaugguuuguugaacgcaacauggucauccccgaggggagagugauugaccugggauguggccggggcggguggagcuauuacugcgccggacugaaaaaggugacagaaguccgcggcuauaccaaagggggaccuggccacgaggagcccguuccuauguccacauacggguggaauaucgugaagcucaugucuggaaaagauguguucuaccugcccccggaaaagugugacacccuucugugcgauaucggcgagagcuccccuagccccacagucgaagagucuagaaccauucgggugcucaagaugguugagcccuggcugaaaaacaaucaguucuguaucaaggugcugaacccuuauaugcccacggucauugaacaucucgagcgccuucagagaaaacacggcgggaugcuggugcggaauccucugucccgcaacagcacacaugaaauguacuggaucucuaauggaaccggcaacauuguugcuuccgugaauauggucagcagacuccugcuuaaccgguuuaccaugacacacagacgcccgacgaucgagaaggacguggaucugggggccggaacccggcacgugaacgcugaacccgagacaccuaauauggacgucaucggcgagagaauuaaacgcaucaaggaagaacacaacucuaccuggcacuaugacgaugaaaaucccuacaagacaugggccuaucaugggagcuacgagguuaaagcgaccggauccgccucuagcaugauuaacggcguggugaagcuccugacaaaaccuugggacgucgugcccaugguuacccagauggcuaugacggauaccacaccguucggccaacagcggguguuuaaggaaaaagucgacaccagaacaccucgcuccaugcccgggacccggagagugaugggaaucacggccgaguggcuguggcgcacacucggccggaauaagaagccuagacugugcacccgcgaggaguucaccaagaagguucggaccaacgcugccaugggggccguguuuacggaggaaaaucagugggauagcgcgaaagcugccgucgaggacgaagauuucuggaaacuuguggacagagagcgcgagcugcacaaacucggaaaguguggcuccugcguuuauaacaugauggggaaaagagaaaagaagcugggcgaguuuggaaaagccaagggcucucgggcuauuugguacauguggcuuggggcccgcuaccuggaguucgaggcucucggauuucugaaugaggaucauugguucagcagagaaaacuccuauucuggcguggagggggaaggacugcacaaacucggcuacauccugcgggacaucagcaagauucccgggggcgccauguaugcggaugacaccgccggaugggacacaagaaucaccgaggaugaccuucacaaugaagagaaaauuacacaacagauggauccugagcaucggcagcuggcuaacgccaucuuuaagcucaccuaccagaauaaggucgugaaaguccaacgccccacaccgaccggcacggugauggacauuaucuccagaaaggaucagcgggggucuggacagguuggcacauaugggcugaacaccuucaccaauauggaagcucagcuuauccgccaaauggagggagaaggcgugcugagcaaagccgaccucgagaacccucaucugcccgaaaagaaaauuacacaguggcuggagaccaagggggucgagagacucaagcggauggcgaucuccggcgaugacugcguggugaaacccauugaugaccgcuuugccaacgcucugcuugcccugaaugauaugggaaagguuagaaaagacaucccucaguggcagccgagcaagggcuggcaugauuggcaacaggugcccuucuguucucaccacuuccaugaacucauuaugaaagacgggcggaagcuggucgugccuugccgcccccaggacgagcuuaucggacgggcucggauuucccagggcgccggguggagccugcgcgaaacagcuugucucggaaaggccuacgcgcaaauguggucucugauguauuuucacagacgggaucugcgccucgccuccaacgcuaucugcagcgccguuccugugcauuggguccccacgucuagaaccacaugguccauccacgcccaucaccaguggaugaccacagaggacaugcugaccguguggaaucgggucuggauugaagauaacccuuggauggaggacaaaacgcccgugaccacaugggagaauguuccguaccuuggcaagagagaagaucaguggugugggagccugaucggccucaccucccgcgcuacaugggcccaaaacauuccuaccgcgauccaacaggugcggagccugauuggaaaugaggaguuccuugacuacaugcccucuaugaaaagauuucgcaaggaggaggaaagcgagggcgcuaucugguga

SEQ ID NO: 20613 - RNA, 9873 nt, Artificial Sequence
  derived and/or modified CDS sequence (opt5) from DENV-3__KJ189256__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucagugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaugggaaggcccacaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcgagacgcauggcuauccuuggagacacagccugggauuucggcuccguugggggaguccucaacagccugggcaagauggugcaucaaauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucacacguggaccgaacaguacaaauuucaggccgauucccccaagcggcuggcgacagccaucgcuggcgccugggagaauggaguguguggcauuagaagcaccacacgcauggaaaaccuucucuggaaacaaaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacagaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcaacugugugaccaccggcuuaugagcgccgcugugaaggaugagagagccgugcaugccgacaugggguacuggauugagucccagaaaaacggaucuuggaagcucgaaaaagcuagccugaucgaggucaagacaugcaccuggccuaagucccacacccuguggucuaauggcgugcucgaaagcgauaugauuauccccaaaucccuggccgggccuauuagccagcauaaccaccgccccggauaucacacacagaccgcgggcccuuggcaucuugggaagcuggagcucgacuuuaauuacugcgagggaacgacaguugugaucaccgaaaacuguggcacacggggccccucucugagaaccacaaccgucuccgggaaacugauccacgaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcauaugaucgccggcguuuucuuuacauucgugcuucugcucagcgggcaaauuaccuggcgcgauauggcucacacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcagcugccugaggauauugaacaaauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccagucuagcuccaugcggaagacggacuggcugcccauggcuguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuugucgcuggaggccugcucaucgccuguuaugugauuaccgggaccuccgccgaucugacaguugaaaaggcugccgacaucaccugggaggaagaggcggaacaaacaggagugagccauaaccucaugauuacggucgacgaugacggcaccaugcggaucaaagaugacgagacagagaauauccugaccgugcuucugaagacagcucugcucauugucucuggcaucuuuccguacuccauuccugccacccugcuuguguggcacacguggcagaaacagacccagcgcagcgggguucugugggaugugcccucuccucccgaaacacaaaaggccgagcucgaagagggagucuacagaaucaaacagcagggcauuuucgggaagacccaggugggaguuggcgugcaaaaggagggggucuuucacacaauguggcaugugacccggggagcugugcugacauauaacggcaaacgccucgaaccgaauugggccuccguuaagaaagaccugaucagcuacggcgggggauggagacuuucugcgcaguggcagaagggcgaggaaguccaagugauugcuguggagccugggaaaaaccccaagaauuuccagacgaugccuggaaccuuccagacaaccaccggcgaaaucggggccaucgcccuggauuuuaagcccggaacauccggcagccccauuaucaaccgggagggcaaagucguggggcuguauggaaauggcguugugacgaagaacgggggauacgucuccggcauugcucagaccaaugccgagccugacgggccgacacccgaacucgaggaagagauguucaaaaagcgcaaccugaccaucauggaucuucacccuggcagcggaaaaacaagaaaguaucugcccgcuauugugcgggaagccaucaagcgcagacuccggacccugauccucgcgccuacgagaguuguggccgcugagauggaggaagcccugaaaggccuucccauucgcuaccaaacaaccgcuaccaagucugagcauacagggcgggaaaucgucgaccugaugugccacgccaccuuuacaaugagacugcucagcccugugcgcguuccgaauuauaaccugauuaucauggaugaggcccauuucaccgaccccgcuuccauugcggcccggggauacaucucuacgagagugggcaugggggaagcugccgccaucuuuaugacagcuaccccucccggaacagccgaugcguucccucagagcaaugcucccauucaggacgaggagcgcgacaucccggaacgguccuggaacucuggcaaugaguggauuaccgauuuugccgggaaaacggucugguucgugccuagcaucaaggccggcaacgacauugcuaacugucuucgcaaaaauggaaagaaggugauccagcuguccagaaaaaccuuugauacagaauaccaaaagaccaaacucaacgacugggauuucgucguuacaaccgacauuucugagaugggcgccaauuuuaaggcggaucgggugaucgaccccagacggugccugaaacccgugauccugacagaugggccugagcgcgucauucucgccggacccaugccugugaccgcugccagcgcugcccagagacggggccgcguugggagaaacccgcagaaggaaaaugaccaguauaucuucacgggacaaccccuuaacaaugaugaggaccacgcucacuggacagaagccaagaugcugcuggacaacauuaauaccccugagggcaucauucccgcccucuucgaaccugagcgggagaaauccgccgcuaucgauggggaauacagacugaagggcgagagccgcaaaaccuuuguggaacuuaugcggagaggagaccugcccgucuggcucgcccauaagguggcuucugagggcaucaaauauacagaucgcaaguggugcuucgacgggcagcggaacaaucagauucuggaagagaacauggauguugagaucuggaccaaagaaggagagaagaagaaacugagaccgcgcuggcucgacgcccggacauacuccgauccucuugcccugaaggaauuuaaagacuucgcugcgggcagaaagagcauugcccuggaucucgugacggagaucgggcgcguccccucucaccuggcucauagaacccggaaugcccuugacaaccuggugaugcuccacacauccgaacacggaggccgcgccuauagacaugcugucgaggagcugccugaaaccauggagacacugcuccuucugggccugaugauucuccugaccgggggagccaugcuuuuucugaucagcggcaaagggaucggaaagacguccauuggccucaucugugugauugcgucuagcgggaugcuguggauggccgaaaucccccugcaguggauugcuuccgccaucguucucgaguucuuuaugauggugcuucugauuccugagcccgaaaagcaacggaccccgcaggauaaucagcuggcuuacguggucaucggaauccucacacuggccgcgauuaucgccgcuaacgagaugggccuucuggaaaccacaaaacgcgaccucggcaugagcaaggagccugggguugugucucccaccuccuaucuggauguggaccugcaccccgccagcgcuuggacgcucuacgccgucgcuacaaccgugauuacaccuaugcuuagacauaccaucgaaaauucuaccgccaacguuagccuggcggccauugcuaaccaagccgugguccugaugggacucgacaaaggcuggccgaucuccaagauggaucugggggugccccuucuggcucucggaugcuacucucaggucaauccucugacacugacggccgccgugcuccuucugaucacccacuaugcgauuaucggccccgggcugcaggcuaaagccacacgggaggcucagaagagaaccgccgccggaauuaugaagaacccuacaguugacggcaucaugaccauugaucucgaccccgugaucuacgauagcaaauucgagaagcaacugggccaggucaugcuucuggugcucugugcuguucagcugcugcucaugcgcacguccugggcccuuugcgaagcgcugacacuggccaccgggccuaucaccacacucugggagggaucuccgggcaaauuuuggaauaccacaauugcugugagcauggccaacaucuuccggggguccuaucuggcuggagccggccuugcguuuagcauuaugaagucugucgggacgggaaaaagaggcaccggcucccagggggaaacacugggagagaaguggaagaaaaagcucaaucaacugagccgcaaagaguucgaccuguacaagaaauccggcaucaccgagguggaucggacagaggccaaggaagggcucaaaagaggagagauuacccaucacgcugugucucggggcagcgccaaacuucagugguuuguugaacgcaacauggucauccccgaggggagagugauugaccugggauguggccggggcgggugguccuauuacugcgcuggacugaagaaagugacggaaguccgcggcuauaccaaagggggaccuggccacgaggagcccguuccuaugucuacauacggguggaauaucgugaaacucaugagcggaaaggauguguucuaccugcccccggaaaaaugugacacccuucugugcgauaucggcgaguccagcccuucucccacagucgaagaguccagaaccauucgggugcucaagaugguugagcccuggcugaagaacaaucaguucuguaucaaagugcugaacccuuauaugcccacagucauugaacaucucgagcgccuucagagaaagcacggcgggaugcuggugcggaauccucugagccgcaacucuacccaugaaauguacuggaucuccaauggaacgggcaacauuguugccagcgugaauauggucucuagacuccugcuuaaccgguuuacaaugacccacagacgcccgaccaucgagaaagacguggaucugggggcuggaacacggcacgugaacgccgaacccgagacgccuaauauggacgucaucggcgagagaauuaagcgcaucaaagaagaacacaacagcaccuggcacuaugacgaugaaaaucccuacaagacaugggcguaucauggguccuacgagguuaaggccaccggaucugcuagcuccaugauuaacggcguggugaaacuccugacaaagccuugggacgucgugcccaugguuacccaaauggccaugacagauaccacgccguucggccagcagcggguguuuaaagaaaaggucgacaccagaacaccucgcagcaugcccgggacccggagagugaugggaaucacagcugaguggcuguggcgcacccucggccggaauaaaaagccuagacugugcacgcgcgaggaguucacaaagaaaguucggaccaacgccgccaugggggcgguguuuacagaggaaaaucaaugggauuccgcuaaggccgccgucgaggacgaagauuucuggaaacuuguggacagagagcgcgagcugcacaagcucggaaaauguggcucuugcguuuauaacaugauggggaagagagagaagaagcugggcgaguuuggaaaggcuaaaggcagccgggccauuugguacauguggcuuggggcucgcuaccuggaguucgaggcccucggauuucugaaugaggaucauugguucuccagagaaaacucuuauagcggcguggagggggaaggacugcacaagcucggcuacauccugcgggacaucuccaaaauucccgggggcgcgauguaugccgaugacaccgcuggaugggacacgagaaucaccgaggaugaccuucacaaugaagagaagauuacacagcagauggauccugagcaucggcagcuggccaacgcuaucuuuaaacucaccuaccaaaauaaggucgugaagguccagcgccccacaccgaccggcacagugauggacauuaucucuagaaaagaucagcgggggagcggacagguuggcaccuaugggcugaacacguucacaaauauggaagcccaacuuauccgccagauggagggagaaggcgugcuguccaaggcggaccucgagaacccucaucugcccgagaagaagauuacccaguggcuggagaccaaaggggucgagagacucaagcggauggccaucagcggcgaugacugcguggugaagcccauugaugaccgcuuugcuaacgcccugcuugcucugaaugauaugggaaaaguuagaaaggacaucccucaguggcaaccgucuaaaggcuggcaugauuggcaacaggugcccuucuguucccaccacuuccaugaacucauuaugaaggacgggcggaaacuggucgugccuugccgcccccaggacgagcuuaucggacgggcccggauuagccaaggcgcuggguggucucugcgcgaaacagccugucucggaaaggcguacgcccagauguggucccugauguauuuucacagacgggaucugcgccucgcuagcaacgccaucugcucugccguuccugugcauuggguccccaccuccagaacaacguggagcauccacgcucaucaccaguggaugaccacagaggacaugcugaccguguggaaucgggucuggauugaagauaacccuuggauggaggacaagacacccgugaccacgugggagaauguuccguaccuuggcaaaagagaagaucaauggugugggucccugaucggccucaccagccgcgccacaugggcgcagaacauuccuaccgcuauccaacaggugcggucucugauuggaaaugaggaguuccuugacuacaugcccagcaugaagagauuucgcaaagaggaggaauccgagggcgccaucugguga

SEQ ID NO: 20614 - RNA, 9873 nt, Artificial Sequence
  derived and/or modified CDS sequence (opt5) from DENV-3__KJ189257__SS-prME
accagccucugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucagugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaugggaaggcccacaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaucaaauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucacacguggaccgaacaguacaaauuucaggccgauucccccaagcggcuggcgacagccaucgcuggcgccugggagaauggaguguguggcauuagaagcaccacacgcauggaaaaccuucucuggaaacaaaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacagaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcaacugugugaccaccggcuuaugagcgccgcugugaaggaugagagagccgugcaugccgacaugggguacuggauugagucccagaaaaacggaucuuggaagcucgaaaaagcuagccugaucgaggucaagacaugcaccuggccuaagucccacacccuguggucuaauggcgugcucgaaagcgauaugauuauccccaaaucccuggccgggccuauuagccagcauaaccaccgccccggauaucacacacagaccgcgggcccuuggcaucuugggaagcuggagcucgacuuuaauuacugcgagggaacgacaguugugaucaccgaaaacuguggcacacggggccccucucugagaaccacaaccgucuccgggaaacugauccacgaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcauaugaucgccggcguuuucuuuacauucgugcuucugcucagcgggcaaauuaccuggcgcgauauggcucacacacugaucaugauuggauccaauaccagcgacagaaugggcaugggggucacguaucuggcccuuaucgcgacauuuaaaauccagcccuuccuggcucucggauuuuuccugcggaagcucaccucuagagaaaaccugcuucugggcguggggcucgccauggccacaacccugcagcugccugaggauauugaacaaauggcuaauggaaucgcccuuggccugauggcucucaaacugauuacccaguuugagacauaccagcucuggacggcccugaucucccuuaccuguagcaacacaauuuucacccugacaguggcguggcgcaccgccacgcucauccuggcuggcgucucccugcuuccgguuugccagucuagcuccaugcggaagacagacuggcugcccauggccguggcugccaugggggugccuccccucccucuguuuaucuucucucucaaggauacccugaaaagacgcagcuggccccuuaaugagggagucauggccgugggccugguuuccauucuggcuucuagccuccugagaaacgacgugccuauggcggggccccuugucgccggaggccugcucaucgcuuguuaugugauuaccgggacauccgccgaucugaccguugaaaaggccgcugacaucacaugggaggaagaggccgaacaaacgggagugagccauaaccucaugauuaccgucgacgaugacggcacaaugcggaucaaagaugacgagaccgagaauauccugacagugcuucugaagaccgcgcugcucauugucucuggcaucuuuccguacuccauuccugcuacgcugcuuguguggcacaccuggcagaaacagacacagcgcagcgggguucugugggaugugcccucuccucccgaaacccaaaaggccgagcucgaagagggagucuacagaaucaaacagcagggcauuuucgggaagacacaggugggaguuggcgugcaaaaggagggggucuuucacaccauguggcaugugacacggggagccgugcugacguauaacggcaaacgccucgaaccgaauugggcuuccguuaagaaagaccugaucagcuacggcgggggauggagacuuucugcccaguggcagaagggcgaggaaguccaagugauugcgguggagccugggaaaaaccccaagaauuuccagaccaugccuggaacauuccagaccaccacaggcgaaaucggggcuaucgcccuggauuuuaagcccggaacguccggcagccccauuaucaaccgggagggcaaagucguggggcuguauggaaauggcguugugaccaagaacgggggauacgucuccggcauugcccagacaaaugcugagccugacgggccgacccccgaacucgaggaagagauguucaaaaagcgcaaccugacaaucauggaucuucacccuggcagcggaaaaaccagaaaguaucugcccgccauugugcgggaagcuaucaagcgcagacuccggacgcugauccucgccccuacaagaguuguggcggccgagauggaggaagcucugaaaggccuucccauucgcuaccaaaccaccgccacaaagucugagcauaccgggcgggaaaucgucgaccugaugugccacgcuacauuuaccaugagacugcucagcccugugcgcguuccgaauuauaaccugauuaucauggaugaggcccauuucacggaccccgccuccauugcugcgcggggauacaucucuacaagagugggcaugggggaagccgcugccaucuuuaugaccgccacaccucccggaaccgcugaugccuucccucagagcaaugcgcccauucaggacgaggagcgcgacaucccggaacgguccuggaacucuggcaaugaguggauuacggauuuugcugggaaaaccgucugguucgugccuagcaucaaggccggcaacgacauugccaacugucuucgcaaaaauggaaagaaggugauccagcuguccagaaaaacauuugauaccgaauaccaaaagacaaaacucaacgacugggauuucgucguuaccacagacauuucugagaugggcgcuaauuuuaaggccgaucgggugaucgaccccagacggugccugaaacccgugauccugaccgaugggccugagcgcgucauucucgcgggacccaugccugugacggccgcuagcgccgcucagagacggggccgcguugggagaaacccgcagaaggaaaaugaccaguauaucuucacaggacaaccccuuaacaaugaugaggaccacgcccacuggaccgaagcuaagaugcugcuggacaacauuaauaccccugagggcaucauucccgcccucuucgaaccugagcgggagaaauccgcggccaucgauggggaauacagacugaagggcgagagccgcaaaacauuuguggaacuuaugcggagaggagaccugcccgucuggcucgcucauaagguggccucugagggcaucaaauauaccgaucgcaaguggugcuucgacgggcagcggaacaaucagauucuggaagagaacauggauguugagaucuggacaaaagaaggagagaagaagaaacugagaccgcgcuggcucgacgcucggacguacuccgauccucuugcccugaaggaauuuaaagacuucgccgcuggcagaaagagcauugcgcuggaucucgugaccgagaucgggcgcguccccucucaccuggcccauagaacacggaaugcucuugacaaccuggugaugcuccacaccuccgaacacggaggccgcgccuauagacaugccgucgaggagcugccugaaacaauggagacccugcuccuucugggccugaugauucuccugacagggggagcuaugcuuuuucugaucagcggcaaagggaucggaaagaccuccauuggccucaucugugugauugccucuagcgggaugcuguggauggcggaaaucccccugcaguggauugccuccgcuaucguucucgaguucuuuaugauggugcuucugauuccugagcccgaaaagcaacggacaccgcaggauaaucagcuggccuacguggucaucggaauccucacccuggcugccauuaucgcggccaacgagaugggccuucuggaaacaaccaaacgcgaccucggcaugagcaaggagccugggguugugucucccacguccuaucuggauguggaccugcaccccgcuagcgccuggacacucuacgcugucgccaccacagugauuaccccuaugcuuagacauaccaucgaaaauucuacagcuaacguuagccuggccgcgauugccaaccaagcugugguccugaugggacucgacaaaggcuggccgaucuccaagauggaucugggggugccccuucuggcccucggaugcuacucucaggucaauccucugacgcugaccgcugccguguuccuccuuaucacacacuaugccauuaucggccccgggcugcaggcgaaagcuacccgggaggcccagaagagaacagcugccggaauuaugaagaacccuaccguugacggcaucaugacgauugaucuggaccccgugaucuacgauagcaaauuugagaagcaacucggccaggucaugcugcuugugcugugugccguucagcuccugcugaugcgcacauccugggcucucugcgaagcccuuacccuggcgaccgggccuaucacaacccugugggagggaucuccgggcaaauucuggaauacaacgauugccgugagcauggcuaacaucuuucggggguccuaucucgccggagcuggccuggccuucagcauuaugaagucugucgggaccggaaaaagaggcacaggcucccagggggaaacccuuggagagaaguggaagaaaaagcugaaucaacucagccgcaaagaauuugaccuguacaagaaauccggcaucacagagguggaucggaccgaggcgaaggaagggcugaaaagaggagagauuacgcaucacgccgugucucggggcagcgcuaagcuccagugguucguugaacgcaacauggucauccccgaggggagagugauugaccuuggauguggccggggcgggugguccuauuacugcgccggacugaagaaagugaccgaaguccgcggcuauacaaaagggggaccuggccacgaggagcccguuccuaugucuaccuacggguggaauaucgugaaacugaugagcggaaaggauguguucuaccugcccccggaaaaaugugacacacugcuuugcgauaucggcgaguccagcccuucucccaccgucgaagaguccagaacaauucgggugcugaagaugguugagcccuggcucaagaacaaucaguuuuguaucaaagugcugaacccuuauaugcccaccgucauugaacaucuggagcgccuccagagaaagcacggcgggaugcuugugcggaauccucugagccgcaacucuacgcaugaaauguacuggaucuccaauggaacaggcaacauuguugcuagcgugaauauggucucuagacugcuccugaaccgguucaccaugacccacagacgcccgacaaucgagaaagacguggaucuuggggccggaacgcggcacgugaacgcugaacccgagaccccuaauauggacgucaucggcgagagaauuaagcgcaucaaagaggaacauaacagcacauggcacuaugacgaugaaaaucccuacaagaccugggccuaucauggguccuacgagguuaaggcgacaggaucugccagcuccaugauuaacggcguggugaaacugcucaccaagccuugggacgucgugcccaugguuacacaaauggcuaugaccgauacgaccccguuuggccagcagcggguguucaaagaaaaggucgacacaagaaccccucgcagcaugcccgggacacggagagugaugggaaucaccgccgaguggcuguggcgcacgcugggccggaauaaaaagccuagacucugcacacgcgaggaauuuaccaagaaaguucggacaaacgcugccaugggggccguguucaccgaggaaaaucaaugggauuccgcgaaggcugccgucgaggacgaagauuuuuggaaacugguggacagagagcgcgagcuucacaagcugggaaaauguggcucuugcguuuauaacaugauggggaagagagagaagaagcucggcgaguucggaaaggccaaaggcagccgggcuauuugguacauguggcugggggcccgcuaccuugaauuugaggcucugggauuccucaaugaggaucauugguuuuccagagaaaacucuuauagcggcguggagggggaaggacugcacaagcugggcuacauccuccgggacaucuccaaaauucccgggggcgccauguaugcggaugacacggccggaugggacaccagaaucacagaggaugaccugcacaaugaagagaagauuacccagcagauggauccugagcaucggcagcuugcuaacgccaucuucaaacugacauaccaaaauaaggucgugaagguccagcgccccaccccgacaggcaccgugauggacauuaucucuagaaaagaucagcgggggagcggacagguuggcacguaugggcucaacacauuuaccaauauggaagcucaacugauccgccagauggagggagaaggcgugcuuuccaaggccgaccuggagaacccucaccuccccgagaaaaagauuacccaguggcuggagacaaaaggggucgagagacugaagcggauggcgaucagcggcgaugacugcguggugaagcccauugaugaccgcuucgccaacgcucuccuggcccuuaaugauaugggaaaaguuagaaaggacaucccucaguggcaaccgucuaaaggcuggcaugauuggcaacaggugcccuucuguucccaccacuuucaugaacugauuaugaaggacgggcggaaacucgucgugccuugccgcccccaggacgagcugaucggacgggcucggauuagccaaggcgccggguggucucuucgcgaaaccgcuugucugggaaaggccuacgcgcagauguggucccucauguauuuccacagacgggaucugcgccuggccagcaacgcuaucugcucugccguuccugugcauuggguccccacauccagaacgaccuggagcauccacgcccaucaccaguggaugacaaccgaggacaugcucacaguguggaaucgggucuggauugaagauaacccuuggauggaggacaagacccccgugacgaccugggagaauguuccguaccugggcaaaagagaagaucaauggugugggucccuuaucggccugacaagccgcgcuaccugggcccagaacauuccuacagcgauccaacaggugcggucucucauuggaaaugaggaauuucuggacuacaugcccagcaugaagagauuccgcaaagaggaggaauccgagggcgcuaucugguga

SEQ ID NO: 20615 - RNA, 9873 nt, Artificial Sequence
  derived and/or modified CDS sequence (opt5) from DENV-3__KJ189262__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaugggaaggcccacaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcgagacgcauggcuauccuuggagacacagccugggauuucggcuccguugggggaguccucaacagccugggcaagauggugcaucaaauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucacacguggaccgaacaguacaaauuucaggccgauucccccaagcggcuggcgacagccaucgcuggcgccugggagaauggaguguguggcauuagaagcaccacacgcauggaaaaccuucucuggaaacaaaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacagaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcaacugugugaccaccggcuuaugagcgccgcugugaaggaugagagagccgugcaugccgacaugggguacuggauugagucccagaaaaacggaucuuggaagcucgaaaaagcuagccugaucgaggucaagacaugcaccuggccuaagucccacacccuguggucuaauggcgugcucgaaagcgauaugauuauccccaaaucccuggccgggccuauuagccagcauaaccaccgccccggauaucacacacagaccgcgggcccuuggcaucuugggaagcuggagcucgacuuuaauuacugcgagggaacgacaguugugaucaccgaaaacuguggcacacggggccccucucugagaaccacaaccgucuccgggaaacugauccacgaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcauaugaucgccggcguuuucuuuacauucgugcuucugcucagcgggcaaauuaccuggcgcgauauggcucacacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcagcugccugaggauauugaacaaauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccagucuagcuccaugcggaagacggacuggcugcccauggcuguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuugucgcuggaggccugcucaucgccuguuaugugauuaccgggaccuccgccgaucugacaguugaaaaggcugccgacaucaccugggaggaagaggcggaacaaacaggagugagccauaaccucaugauuacggucgacgaugacggcaccaugcggaucaaagaugacgagacagagaauauccugaccgugcuucugaagacagcucugcucauugucucuggcaucuuuccguacuccauuccugccacccugcuuguguggcacacguggcagaaacagacccagcgcagcgggguucugugggaugugcccucuccucccgaaacacaaaaggccgagcucgaagagggagucuacagaaucaaacagcagggcauuuucgggaagacccaggugggaguuggcgugcaaaaggagggggucuuucacacaauguggcaugugacccggggagcugugcugacauauaacggcaaacgccucgaaccgaauugggccuccguuaagaaagaccugaucagcuacggcgggggauggagacuuucugcgcaguggcagaagggcgaggaaguccaagugauugcuaucgagccugggaaaaaccccaagaauuuccagacgaugccuggaaccuuccagacaaccaccggcgaaaucggggccauugcccuggauuuuaagcccggaacauccggcagccccaucauuaaccgggagggcaaaguggucgggcuguauggaaauggcgugguuacgaagaacgggggauacguguccggcaucgcucagaccaaugccgagccugacgggccgacacccgaacucgaggaagagauguucaaaaagcgcaaccugaccauuauggaucuucacccuggcagcggaaaaacaagaaaguaucugcccgcuaucguccgggaagccaucaagcgcagacuccggacccugauucucgcgccuacgagagugguugccgcugagauggaggaagcccugaaaggccuucccauccgcuaccaaacaaccgcuaccaagucugagcauacagggcgggaaauuguggaccugaugugccacgccaccuuuacaaugagacugcucagcccuguccgcgugccgaauuauaaccugaucauuauggaugaggcccauuucaccgaccccgcuuccaucgcggcccggggauacaucucuacgagaguuggcaugggggaagcugccgccauuuuuaugacagcuaccccucccggaacagccgaugcguucccucagagcaaugcucccauccaggacgaggagcgcgacauuccggaacgguccuggaacucuggcaaugaguggaucaccgauuuugccgggaaaacggugugguucgucccuagcauuaaggccggcaacgacaucgcuaacugucuucgcaaaaauggaaagaaggugauucagcuguccagaaaaaccuuugauacagaauaccaaaagaccaaacucaacgacugggauuucguggucacaaccgacaucucugagaugggcgccaauuuuaaggcggaucggguuaucgaccccagacggugccugaaacccgugauucugacagaugggccugagcgcgugauccucgccggacccaugccugucaccgcugccagcgcugcccagagacggggccgcguggggagaaacccgcagaaggaaaaugaccaguauauuuucacgggacaaccccuuaacaaugaugaggaccacgcucacuggacagaagccaagaugcugcuggacaacaucaauaccccugagggcauuauccccgcccucuucgaaccugagcgggagaaauccgccgcuaucgauggggaauacagacugaagggcgagagccgcaaaaccuuuguugaacuuaugcggagaggagaccugcccguguggcucgcccauaaggucgcuucugagggcauuaaauauacagaucgcaaguggugcuucgacgggcagcggaacaaucagauccuggaagagaacauggauguggagauuuggaccaaagaaggagagaagaagaaacugagaccgcgcuggcucgacgcccggacauacuccgauccucuugcccugaaggaauuuaaagacuucgcugcgggcagaaagagcaucgcccuggaucucguuacggagauugggcgcgugcccucucaccuggcucauagaacccggaaugcccuugacaaccuggucaugcuccacacauccgaacacggaggccgcgccuauagacaugcuguggaggagcugccugaaaccauggagacacugcuccuucugggccugaugauccuccugaccgggggagccaugcuuuuucugaucagcggcaaagggauuggaaagacguccaucggccucauuugugucaucgcgucuagcgggaugcuguggauggccgaaauuccccugcaguggaucgcuuccgccauugugcucgaguucuuuaugaugguucuucugaucccugagcccgaaaagcaacggaccccgcaggauaaucagcuggcuuacguggugaucggcauucucacacuggccgcgaucauugccgcuaacgagaugggccuucuggaaaccacaaaacgcgaccucggcaugagcaaggagccuggggucguuucucccaccuccuaucuggauguggaccugcaccccgccagcgcuuggacgcucuacgccguggcuacaaccgucaucacaccuaugcuuagacauaccauugaaaauucuaccgccaacgugagccuggcggccaucgcuaaccaagccguugugcugaugggacucgacaaaggcuggccgaucuccaagauggaucugggggucccccuucuggcucucggaugcuacucucaggugaauccucugacacugacggccgccguccuccuucugauuacccacuaugcgaucauuggccccgggcugcaggcuaaagccacacgggaggcucagaagagaaccgccgccggaaucaugaagaacccuacaguggacggcauuaugaccaucgaucucgaccccguuaucuacgauagcaaauucgagaagcaacugggccaggugaugcuucugguccucugugcugugcagcugcugcucaugcgcacguccugggcccuuugcgaagcgcugacacuggccaccgggccuauuaccacacucugggagggaucuccgggcaaauuuuggaauaccacaaucgcuguuagcauggccaacauuuuccggggguccuaucuggcuggagccggccuugcguuuagcaucaugaagucuguggggacgggaaaaagaggcaccggcucccagggggaaacacugggagagaaguggaagaaaaagcucaaucaacugagccgcaaagaguucgaccuguacaagaaauccggcauuaccgaggucgaucggacagaggccaaggaagggcucaaaagaggagagaucacccaucacgcugugucucggggcagcgccaaacuucagugguuuguggaacgcaacaugguuauucccgaggggagagucaucgaccugggauguggccggggcgggugguccuauuacugcgcuggacugaagaaagugacggaagugcgcggcuauaccaaagggggaccuggccacgaggagcccgucccuaugucuacauacggguggaauaucguuaaacucaugagcggaaaggauguguucuaccugcccccggaaaaaugugacacccuucugugcgauauuggcgaguccagcccuucucccacaguggaagaguccagaaccauccggguccucaagaugguggagcccuggcugaagaacaaucaguucuguauuaaaguucugaacccuuauaugcccacagugaucgaacaucucgagcgccuucagagaaagcacggcgggaugcugguccggaauccucugagccgcaacucuacccaugaaauguacuggauuuccaauggaacgggcaacaucguggccagcguuaauauggugucuagacuccugcuuaaccgguuuacaaugacccacagacgcccgaccaucgagaaagacgucgaucugggggcuggaacacggcacgugaacgccgaacccgagacgccuaauauggacgugauuggcgagagaaucaagcgcauuaaagaagaacacaacagcaccuggcacuaugacgaugaaaaucccuacaagacaugggcguaucauggguccuacgaggucaaggccaccggaucugcuagcuccaugaucaacggcguugugaaacuccugacaaagccuugggacgugguccccauggugacccaaauggccaugacagauaccacgccguucggccagcagcggguuuuuaaagaaaagguggacaccagaacaccucgcagcaugcccgggacccggagagucaugggaauuacagcugaguggcuguggcgcacccucggccggaauaaaaagccuagacugugcacgcgcgaggaguucacaaagaaagugcggaccaacgccgccaugggggcgguuuuuacagaggaaaaucaaugggauuccgcuaaggccgccguggaggacgaagauuucuggaaacuugucgacagagagcgcgagcugcacaagcucggaaaauguggcucuugcguguauaacaugauggggaagagagagaagaagcugggcgaguuuggaaaggcuaaaggcagccgggccaucugguacauguggcuuggggcucgcuaccuggaguucgaggcccucggauuucugaaugaggaucauugguucuccagagaaaacucuuauagcggcguugagggggaaggacugcacaagcucggcuacauccugcgggacauuuccaaaauccccgggggcgcgauguaugccgaugacaccgcuggaugggacacgagaauuaccgaggaugaccuucacaaugaagagaagaucacacagcagauggauccugagcaucggcagcuggccaacgcuauuuuuaaacucaccuaccaaaauaagguggucaaggugcagcgccccacaccgaccggcacagucauggacaucaucucuagaaaagaucagcgggggagcggacaggugggcaccuaugggcugaacacguucacaaauauggaagcccaacuuauucgccagauggagggagaaggcguucuguccaaggcggaccucgagaacccucaucugcccgagaagaagaucacccaguggcuggagaccaaagggguggagagacucaagcggauggccauuagcggcgaugacugcgucgugaagcccaucgaugaccgcuuugcuaacgcccugcuugcucugaaugauaugggaaaagugagaaaggacauuccucaguggcaaccgucuaaaggcuggcaugauuggcagcagguucccuucuguucccaccacuuccaugaacucaucaugaaggacgggcggaaacugguggucccuugccgcccccaggacgagcuuauuggacgggcccggaucagccaaggcgcuggguggucucugcgcgaaacagccugucucggaaaggcguacgcccagauguggucccugauguauuuucacagacgggaucugcgccucgcuagcaacgccaucugcucugccgugccuguucauugggugcccaccuccagaacaacguggagcauucacgcucaucaccaguggaugaccacagaggacaugcugaccgucuggaaucggguguggaucgaagauaacccuuggauggaggacaagacacccgucaccacgugggagaaugugccguaccuuggcaaaagagaagaucaauggugugggucccugauuggccucaccagccgcgccacaugggcgcagaacaucccuaccgcuauucagcagguucggucucugaucggaaaugaggaguuccuugacuacaugcccagcaugaagagauuucgcaaagaggaggaauccgagggcgccaucugguga

SEQ ID NO: 20616 - RNA, 9873 nt, Artificial Sequence
  derived and/or modified CDS sequence (opt5) from DENV-3__KJ189263__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggcggcaaguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccgugcucauuaagguugaguacaagggagaagaugugcccuguaaaaucccuuucagcacagaggacggccaugggaaggcccacaacggaagacugaucaccgcgaaucccgucgugacgaaaaaggaggaacccgugaacauugaggcugaaccuccguucggcgaguccaauaucguuauugggaucggcgauaacgcccugaaaauuaauugguauaagaagggaucuagcaucggcaaaauguuugaagccacagcuagaggggccagacgcauggcuauccuuggagacaccgccugggauuucggcuccgucgggggagugcucaacagccugggcaagauggugcaucaaauuuuugggucugcguacaccgcccuguucuccggcgucagcugggugaugaaaaucggaauuggcguucuccugacauggaucgggcuuaauucuaagaacaccagcauguccuuuucuugcauugcuaucggaauuaucacacuguaucucggcgccgugguccaggcugacauggggugugugaucaauuggaaaggaaaggagcugaagugcggcagcgggauuuucguuacgaacgaggugcacaccuggacagaacaguacaaauuucaggccgauucccccaagcggcuggcgaccgccaucgcuggcgccugggagaauggagucuguggcauuagaagcacaacccgcauggaaaaccuucucuggaaacaaaucgcuaaugagcugaacuauauucugugggaaaauaacaucaagcucacggugguugugggggacaucauuggaguccuggagcagggcaaacggacccuuacaccucagcccauggagcugaaguacucuuggaaaaccugggggaaggccaagaucgugacagccgaaacccagaacuccagcuucauuaucgauggaccuaauacacccgagugcccgucugcuuccagagcguggaacgugugggaagucgaggacuauggcuuuggcguuuucaccacgaauauuuggcuccgccugcgggaaguguacacacaacugugugaccacagacuuaugagcgccgcugugaaagaugagcgcgccguccaugccgacaugggguacuggaucgagucccagaagaacggaucuuggaaacucgaaaaggcuagccugaucgaggugaaaaccugcaccuggccuaagucccacacacuguggucuaauggcguucucgaaagcgauaugauuauccccaagucccuggccgggccuauuagccagcauaaccaccggcccggauaucacacccagacggcgggcccuuggcaucuugggaaacuggagcucgacuuuaauuacugcgagggaacaaccguggucaucacagaaaacuguggcaccagaggccccucucugcgcacaaccacgguguccgggaagcugauucacgaguggugcugucggagcugcacccuuccgccucucagauauaugggagaagauggcuguugguacgggauggagauccggcccaucucugaaaaagaggagaauaugguuaagucccuggugagcgcuggaucuggcaaagucgacaacuucacaaugggggugcugugccucgccauucuguuugaagagguuaugcgcggaaaguucggcaagaaacauaugaucgccggcguguucuuuaccuucguccuucugcucagcgggcaaauuacauggagagauauggcucacacccugaucaugauuggauccaaugccagcgaccggaugggcaugggggugacguaucuggcgcuuaucgcuacauuuaagauucagcccuuccuggcccucggauuuuuccugagaaaacucaccucucgcgaaaaccugcuucugggcguggggcucgccauggcuacaacccugcagcugccugaggauaucgaacaaauggccaauggaaucgcucuuggccugauggcccucaagcugauuacccaguuugagaucuaccagcucuggacagcgcugauuucccuuacguguagcaacaccaucuucacacugaccgucgccuggcggacagcuacccucauucuggccggcguuucccugcuuccggugugccagucuagcuccaugagaaaaacggacuggcugcccauggcuguggccgccaugggggucccuccccucccucuguuuaucuucucucucaaggauacacugaagcgcagaagcuggccccuuaaugagggagugauggcuguuggccugguguccauccuggcgucuagccuccugcggaacgacgucccuauggccgggccccuuguggcuggaggccugcucauugccuguuauguuaucaccgggaccuccgccgaucugacaguggaaaaagcugccgacauuaccugggaggaagaggcggaacaaacaggagucagccauaaccucaugaucacgguggacgaugacggcaccaugcgcauuaaggaugacgagacagagaauauccugaccguccuucugaaaacagcucugcucaucgugucuggcauuuuuccguacuccaucccugccacccugcuuguuuggcacacguggcagaagcagacccagagaagcggggugcugugggauguccccucuccucccgaaacacaaaaagccgagcucgaagagggaguguaccggauuaagcagcagggcaucuucgggaaaacccagguuggagugggcguccaaaaggaggggguguuucacacaauguggcaugugacccgcggagcuguucugacauauaacggcaagagacucgaaccgaauugggccuccgucaaaaaggaccugauuagcuacggcgggggauggcggcuuucuacgcaguggcagaaaggcgaggaagugcaagugaucgcggucgagccugggaagaaccccaaaaauuuccagaccaugccuggaacauuccagaccaccacaggcgaaauuggggcuaucgcccuggauuuuaagcccggaacguccggcagccccaucauuaaccgcgagggcaaggugguugggcuguauggaaauggcguggucaccaaaaacgggggauacguguccggcaucgcccagacaaaugcugagccugacgggccgacccccgaacucgaggaagagauguucaagaaaagaaaccugacaauuauggaucuucacccuggcagcggaaagacccggaaauaucugcccgccaucguucgcgaagcuauuaagagacggcucagaacgcugauccucgccccuacacgcguggucgcggccgagauggaggaagcucugaagggccuucccauccgguaccaaaccaccgccacaaaaucugagcauaccgggagagaaauuguggaccugaugugccacgcuacauuuaccaugcgccugcucagcccuguucgggugccgaauuauaaccugaucauuauggaugaggcccauuucacggaccccgccuccaucgcugcgagaggauacauuucuacacgcgucggcaugggggaagccgcugccaucuuuaugaccgccacaccucccggaaccgcugaugccuucccucagagcaaugcgcccauccaggacgaggagcgggacauuccggaaagauccuggaacucuggcaaugaguggaucacggauuuugcugggaagaccgugugguucgugccuagcauuaaagccggcaacgacaucgccaacugucuucgcaagaauggcaaaaaggucauucagcugucccggaagacauuugauaccgaauaccagaagacgaagcucaacgacugggauuucguugugaccacagacaucucugagaugggagcuaauuuuaaagccgauagagugauugacccccggcgcugccugaagcccgucauccugaccgaugggccugagagagugauccucgcgggacccaugccuguuacggccgcuagcgccgcucagcggcgcggcagaguggggcggaacccgcagaaagaaaaugaccaguauauuuucacaggacaaccccuuaacaaugaugaggaccacgcccacuggaccgaagcuaagaugcugcuggacaacaucaauaccccugagggcauuauccccgcccucuucgaaccugagagagagaaguccgcggccauugauggggaauaccgccugaaaggcgagagccggaagacauuugucgaacuuaugagacgcggagaccugcccguguggcucgcucauaaaguugccucugagggcaucaaguauaccgaucggaaauggugcuucgacgggcagagaaacaaucagauccuggaagagaacauggauguggagauuuggacaaaggaaggagagaaaaagaagcugcgcccgcgguggcucgacgcuagaacguacuccgauccucuugcccugaaagaauuuaaggacuucgccgcuggccgcaaaagcaucgcgcuggaucucgucaccgagauugggagagugcccucucaccuggcccaucggacacgcaaugcucuugacaaccuggucaugcuccacaccuccgaacacggaggcagagccuaucggcaugccguggaggagcugccugaaacaauggagacccugcuccuucugggccugaugauccuccugacagggggagcuaugcuuuuucugauuagcggcaaggggaucggaaaaaccuccaucggccucauuuguguuaucgccucuagcgggaugcuguggauggcggaaauuccccugcaguggaucgccuccgcuauugugcucgaguucuuuaugauggugcuucugaucccugagcccgaaaagcaacgcacaccgcaggauaaucagcuggccuacgucguuauuggaauccucacccuggcugccaucauugcggccaacgagaugggccuucuggaaacaaccaagagagaccucggcaugagcaaagagccugggguggugucucccacguccuaucuggaugucgaccugcaccccgcuagcgccuggacacucuacgcuguggccaccacaguuaucaccccuaugcuucggcauaccauugaaaauucuacagcuaacgugagccuggccgcgaucgccaaccaagcugucgugcugaugggacucgacaagggcuggccgauuuccaaaauggaucugggggucccccuucuggcccucggaugcuacucucaggugaauccucugacgcugaccgcugccguucuccuucugaucacacacuaugccaucauuggccccgggcugcaggcgaaggcuaccagagaggcccagaaacgcacagcugccggaaucaugaagaacccuaccguggacggcauuaugacgaucgaucucgaccccgucauuuacgauagcaaguucgagaaacaacugggccaggugaugcuucugguucucugugccgugcagcugcugcucaugcggacauccugggcucuuugcgaagcccugacccuggcgaccgggccuaucacaacccucugggagggaucuccgggcaaguuuuggaauacaacgaucgccgucagcauggcuaacauuuucagaggguccuaucuggccggagcuggccuugccuuuagcaucaugaaaucuguggggaccggaaagcgcggcacaggcucccagggggaaacccugggagagaaauggaagaagaaacucaaucaacugagccggaaggaguucgaccuguacaaaaaguccggcauuacagagguggauagaaccgaggcgaaagaagggcucaagcggggagagaucacgcaucacgccguuucucgcggcagcgcuaaacuucagugguuugucgaaagaaacauggugauucccgaggggcgggugaucgaccugggauguggccgcggcgggugguccuauuacugcgccggacugaagaaggucaccgaaguuagaggcuauacaaaagggggaccuggccacgaggagcccgugccuaugucuaccuacggguggaauauugugaagcucaugagcggaaaagaugucuucuaccugcccccggaaaagugugacacacuucugugcgauaucggcgaguccagcccuucucccaccguggaagagucccggacaauccgcguucucaaaaugguggagcccuggcugaagaacaaucaguucuguauuaagguccugaacccuuauaugcccaccgugaucgaacaucucgagagacuucagcggaaacacggcgggaugcugguucgcaauccucugagcagaaacucuacgcaugaaauguacuggauuuccaauggaacaggcaacaucguggcuagcgucaauauggugucucggcuccugcuuaacagauuuaccaugacccaccgccggccgacaauugagaaggacguggaucugggggccggaacgagacacgucaacgcugaacccgagaccccuaauauggacguuaucggcgagcgcaucaaacggauuaaggaagaacacaacagcacauggcacuaugacgaugaaaaucccuacaaaaccugggccuaucauggguccuacgaggugaaggcgacaggaucugccagcuccaugaucaacggcguggucaagcuccugaccaaaccuugggacgugguucccauggugacacaaauggcuaugaccgauacgaccccguucggccagcagagagucuuuaaggaaaaaguggacacacgcaccccucggagcaugcccgggacaagacgcguuaugggaauuaccgccgaguggcuguggcggacgcucggcagaaauaagaaaccucgccugugcacacgggaggaguucaccaagaaggugagaacaaacgcugccaugggggccgucuuuaccgaggaaaaucaaugggauuccgcgaaagcugccguggaggacgaagauuucuggaaacuuguugaccgcgagagagagcugcacaaacucggaaaguguggcucuugcguguauaacaugauggggaaacgggaaaagaaacugggcgaguuuggaaaggccaagggcagccgcgcuaucugguacauguggcuuggggccagauaccuggaguucgaggcucucggauuucugaaugaggaucauugguucucccgggaaaacucuuauagcggcgucgagggggaaggacugcacaaacucggcuacauucugagagacaucuccaagauccccgggggcgccauguaugcggaugacacggccggaugggacacccggauuacagaggaugaccuucacaaugaagagaaaaucacccagcagauggauccugagcaucgccagcuggcuaacgccauuuuuaagcucacauaccaaaauaaaguggucaaggugcagagacccaccccgacaggcaccguuauggacaucauuucucggaaggaucagcgcgggagcggacaggugggcacguaugggcugaacacauucaccaauauggaagcucaacuuaucagacagauggagggagaaggcguccuguccaaagccgaccucgagaacccucaucugcccgaaaagaaaaucacccaguggcuggagacaaaggggguggagcggcucaaacgcauggcgauuagcggcgaugacugcgugguuaagcccaucgaugacagauuugccaacgcucugcuugcccugaaugauaugggaaaggugcggaaagacauuccucaguggcaaccgucuaagggcuggcaugauuggcagcagguccccuucuguucccaccacuuccaugaacucaucaugaaagacgggcgcaagcuggugguuccuugcagaccccaggacgagcuuauuggacgggcucgcaucagccaaggcgccggguggucucugagagaaaccgcuugucucggaaaagccuacgcgcagauguggucccugauguauuuucaccggcgcgaucugagacucgccagcaacgcuauuugcucugccgugccuguccauugggugcccacaucccggacgaccuggagcauccacgcccaucaccaguggaugacaaccgaggacaugcugacagucuggaauagaguguggaucgaagauaacccuuggauggaggacaagacccccguuacgaccugggagaaugugccguaccuuggcaagcgcgaagaucaauggugugggucccugauuggccucacaagccgggcuaccugggcccagaacaucccuacagcgauucagcaggucagaucucugaucggaaaugaggaguuccuugacuacaugcccagcaugaaacgcuuucggaaggaggaggaauccgagggcgcuauuugguga

SEQ ID NO: 20617 - RNA, 9873 nt, Artificial Sequence
  derived and/or modified CDS sequence (opt5) from DENV-3__KJ189265__SS-prME
accagccugugccucaugaugauccugcccgccgcucuugccuuccaccugacguccagagacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaugggaaggcccacaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaucaaauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucacacguggaccgaacaguacaaauuucaggccgauucccccaagcggcuggcgacagccaucgcuggcgccugggagaauggaguguguggcauuagaagcaccacacgcauggaaaaccuucucuggaaacaaaucgcuaaugagcugaacuauauccugugggaaaauaacauuaagcucaccgucgugguuggggacaucauuggagugcuggagcacggcaaacggacgcuuaccccucagcccauggagcugaaguacucuuggaaaacaugggggaaggccaagaucgucaccgccgaaacacagaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaucggcuuaugagcgccgcugugaaggaugagagagccgugcacgccgacaugggguacuggauugagucccagaagaauggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaccgccccggauaucauacacagaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaauaccagcgacagaaugggcaugggggucacguaucuggcccuuaucgcgacauuuaaaauccaacccuuccuggcucucggauuuuuccugcggaagcucaccucuagagaaaaccugcuucugggcguggggcucgccauggccacaacccugcagcugccugaggauauugaacagauggcuaauggaaucgcccuuggccugauggcucucaaacugauuacccaauuugagacauaccagcucuggacggcccugaucucccuuaccuguagcaacacaauuuucacccugacaguggcguggcgcaccgccacgcucauccuggcuggcgucucccugcuuccgguuugccagucuagcuccaugcggaagacagacuggcugcccauggccguggcugccaugggggugccuccccucccucuguuuaucuucucucucaaggauacccugaaaagacgcagcuggccccuuaaugagggagucauggccgugggccugguuuccauucuggcuucuagccuccugagaaacgacgugccuauggcggggccccuugucgccggaggccugcucaucgcuuguuaugugauuaccgggacauccgccgaucugaccguugaaaaggccgcuaacaucacaugggaggaagaggccgaacagacgggagugagccacaaucucaugauuaccgucgacgacgauggcacaaugcggaucaaagacgaugagaccgagaacauccugacagugcuucugaagaccgcgcugcucauugucucuggcaucuuuccguacuccauuccugcuacgcugcuuguguggcacaccuggcaaaaacagacacagcgcagcgggguucugugggacgugcccucuccucccgaaacccagaaggccgagcucgaagagggagucuacagaaucaaacaacagggcauuuucgggaagacacaggugggaguuggcgugcagaaggagggggucuuucauaccauguggcacgugacacggggagccgugcugacguauaauggcaaacgccucgaaccgaacugggcuuccguuaagaaagaucugaucagcuacggcgggggauggagacuuucugcccaauggcagaagggcgaggaaguccaggugauugcgguggagccugggaaaaaucccaagaacuuccaaaccaugccuggaacauuccagaccaccacaggcgaaaucggggcuaucgcccuggacuuuaagcccggaacguccggcagccccauuaucaaucgggagggcaaagucguggggcuguauggaaacggcguugugaccaagaaugggggauacgucuccggcauugcccagacaaacgcugagccugaugggccgacccccgaacucgaggaagagauguucaaaaagcgcaaucugacaaucauggaccuucauccuggcagcggaaaaaccagaaaguaucugcccgccauugugcgggaagcuaucaagcgcagacuccggacgcugauccucgccccuacaagaguuguggcggccgagauggaggaagcucugaaaggccuucccauucgcuaccagaccaccgccacaaagucugagcacaccgggcgggaaaucgucgaucugaugugccaugcuacauuuaccaugagacugcucagcccugugcgcguuccgaacuauaaucugauuaucauggacgaggcccacuucacggaucccgccuccauugcugcgcggggauacaucucuacaagagugggcaugggggaagccgcugccaucuuuaugaccgccacaccucccggaaccgcugacgccuucccucaaagcaacgcgcccauucaggaugaggagcgcgacaucccggaacgguccuggaacucuggcaacgaguggauuacggacuuugcugggaaaaccgucugguucgugccuagcaucaaggccggcaacgauauugccaauugucuucggaaaaacggaaagaaggugauccagcugucccgcaaaacauuugacaccgaauaccagaagacaaaacucaaugauugggacuucgucguuaccacagauauuucugagaugggcgcuaacuuuaaggccgaccgggugaucgaucccagacggugccugaaacccgugauccugaccgacgggccugagcgcgucauucucgcgggacccaugccugugacggccgcuagcgccgcucaaagacggggccgcguugggagaaauccgcagaaggaaaacgaucaguauaucuucacaggacagccccuuaauaacgacgaggaucacgcccauuggaccgaagcuaagaugcugcuggacaauauuaacaccccugagggcaucauucccgcccucuucgaaccugagcgggagaaauccgcggccaucgacggggaauacagacugaagggcgagagccgcaaaacauuuguggaacuuaugcggagaggagaucugcccgucuggcucgcucacaagguggccucugagggcaucaaauauaccgaccgcaaguggugcuucgaugggcaacggaauaaccagauucuggaagagaauauggacguugagaucuggacaaaagaaggagagaagaagaaacugagaccgcgcuggcucgaugcucggacguacuccgacccucuugcccugaaggaauuuaaagauuucgccgcuggcagaaagagcauugcgcuggaccucgugaccgagaucgggcgcguccccucucaucuggcccacagaacacggaacgcucuugauaaucuggugaugcuccacaccuccgaacauggaggccgcgccuauagacacgccgucgaggagcugccugaaacaauggagacccugcuccuucugggccugaugauucuccugacagggggagcuaugcuuuuucugaucagcggcaaagggaucggaaagaccuccauuggccucaucugugugauugccucuagcgggaugcuguggauggcggaaaucccccugcaguggauugccuccgcuaucguucucgaguucuuuaugauggugcuucugauuccugagcccgaaaagcagcggacaccgcaagacaaccagcuggccuacguggucaucggaauccucacccuggcugccauuaucgcggccaaugagaugggccuucuggaaacaaccaaacgcgaucucggcaugagcaaggagccugggguugugucucccacguccuaucuggacguggaucugcaucccgcuagcgccuggacacucuacgcugucgccaccacagugauuaccccuaugcuuagacacaccaucgaaaacucuacagcuaacguuagccuggccgcgauugccaaucaggcugugguccugaugggacucgacaaaggcuggccgaucuccaagauggaccugggggugccccuucuggcccucggaugcuacucucaagucaacccucugacgcugaccgcugccgugcuccuucugaucacacauuaugccauuaucggccccgggcugcaggcgaaagcuacccgggaggcccagaagagaacagcugccggaauuaugaagaauccuaccguugauggcaucaugacgauugaccucgaucccgugaucuacgacagcaaauucgagaagcagcugggccaagucaugcuucuggugcucugugccguucagcugcugcucaugcgcacauccugggcucuuugcgaagcccugacccuggcgaccgggccuaucacaacccucugggagggaucuccgggcaaauuuuggaacacaacgauugccgugagcauggcuaauaucuuccggggguccuaucuggccggagcuggccuugccuuuagcauuaugaagucugucgggaccggaaaaagaggcacaggcucccagggggaaacccugggagagaaguggaagaaaaagcucaaccagcugagccgcaaagaguucgaucuguacaagaaauccggcaucacagagguggaccggaccgaggcgaaggaagggcucaaaagaggagagauuacgcaccacgccgugucucggggcagcgcuaaacuucaaugguuuguugaacgcaauauggucauccccgaggggagagugauugaucugggauguggccggggcgggugguccuauuacugcgccggacugaagaaagugaccgaaguccgcggcuauacaaaagggggaccuggccaugaggagcccguuccuaugucuaccuacggguggaacaucgugaaacucaugagcggaaaggacguguucuaccugcccccggaaaaaugugauacacuucugugcgacaucggcgaguccagcccuucucccaccgucgaagaguccagaacaauucgggugcucaagaugguugagcccuggcugaagaauaaccaguucuguaucaaagugcugaauccuuauaugcccaccgucauugaacaccucgagcgccuucagagaaagcauggcgggaugcuggugcggaacccucugagccgcaauucuacgcacgaaauguacuggaucuccaacggaacaggcaauauuguugcuagcgugaacauggucucuagacuccugcuuaaccgguuuaccaugacccacagacgcccgacaaucgagaaagauguggaccugggggccggaacgcggcaugugaaugcugaacccgagaccccuaacauggaugucaucggcgagagaauuaagcgcaucaaagaagaacacaauagcacauggcauuaugacgacgaaaaccccuacaagaccugggccuaucacggguccuacgagguuaaggcgacaggaucugccagcuccaugauuaauggcguggugaaacuccugaccaagccuugggaugucgugcccaugguuacacagauggcuaugaccgacacgaccccguucggccaacagcggguguuuaaagaaaaggucgauacaagaaccccucgcagcaugcccgggacacggagagugaugggaaucaccgccgaguggcuguggcgcacgcucggccggaacaaaaagccuagacugugcacacgcgaggaguucaccaagaaaguucggacaaaugcugccaugggggccguguuuaccgaggaaaaccagugggacuccgcgaaggcugccgucgaggaugaagacuucuggaaacuuguggauagagagcgcgagcugcauaagcucggaaaauguggcucuugcguuuauaauaugauggggaagagagagaagaagcugggcgaguuuggaaaggccaaaggcagccgggcuauuugguacauguggcuuggggcccgcuaccuggaguucgaggcucucggauuucugaacgaggaccacugguucuccagagaaaauucuuauagcggcguggagggggaaggacugcacaagcucggcuacauccugcgggauaucuccaaaauucccgggggcgccauguaugcggacgauacggccggaugggacaccagaaucacagaggacgaucuucauaacgaagagaagauuacccaacagauggacccugagcaccggcagcuggcuaaugccaucuuuaaacucacauaccagaacaaggucgugaagguccaacgccccaccccgacaggcaccgugauggauauuaucucuagaaaagaccagcgggggagcggacagguuggcacguaugggcugaauacauucaccaacauggaagcucagcuuauccgccaaauggagggagaaggcgugcuguccaaggccgaucucgagaacccucaucugcccgagaaaaagauuacccaguggcuggagacaaaaggggucgagagacucaagcggauggcgaucagcggcgacgauugcguggugaagcccauugacgaucgcuuugccaaugcucugcuugcccugaacgacaugggaaaaguuagaaaggauaucccucaguggcagccgucuaaaggcuggcacgacuggcaacaggugcccuucuguucccaccauuuccacgaacucauuaugaaggaugggcggaaacuggucgugccuugccgcccccaggacgagcuuaucggacgggcucggauuagccagggcgccggguggucucugcgcgaaaccgcuugucucggaaaggccuacgcgcaaauguggucccugauguauuuucauagacgggaccugcgccucgccagcaaugcuaucugcucugccguuccugugcacuggguccccacauccagaacgaccuggagcauccaugcccaccaccaguggaugacaaccgaggauaugcugacaguguggaaccgggucuggauugaagacaauccuuggauggaggauaagacccccgugacgaccugggagaacguuccguaccuuggcaaaagagaagaccaguggugugggucccugaucggccucacaagccgcgcuaccugggcccaaaauauuccuacagcgauccaacaggugcggucucugauuggaaacgaggaguuccuugauuacaugcccagcaugaagagauuucgcaaagaggaggaauccgagggcgcuaucugguga

SEQ ID NO: 20618 - RNA, 9873 nt, Artificial Sequence
  derived and/or modified CDS sequence (opt5) from DENV-3__KJ189266__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaugggaaggcccacaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaucaaauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucacacguggaccgaacaguacaaauuucaggccgauucccccaagcggcuggcgacagccaucgcuggcgccugggagaauggaguguguggcauuagaagcaccacacgcauggaaaaccuucucuggaaacaaaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacagaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcaacugugugaccaccggcuuaugagcgccgcugugaaggaugagagagccgugcaugccgacaugggguacuggauugagucccagaaaaacggaucuuggaagcucgaaaaagcuagccugaucgaggucaagacaugcaccuggccuaagucccacacccuguggucuaauggcgugcucgaaagcgauaugauuauccccaaaucccuggccgggccuauuagccagcauaaccaccgccccggauaucacacacagaccgcgggcccuuggcaucuugggaagcuggagcucgacuuuaauuacugcgagggaacgacaguugugaucaccgaaaacuguggcacacggggccccucucugagaaccacaaccgucuccgggaaacugauccacgaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcauaugaucgccggcguuuucuuuacauucgugcuucugcucagcgggcaaauuaccuggcgcgauauggcucacacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcagcugccugaggauauugaacaaauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccagucuagcuccaugcggaagacggacuggcugcccauggcuguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuugucgcuggaggccugcucaucgccuguuaugugauuaccgggaccuccgccgaucugacaguugaaaaggcugccgacaucaccugggaggaagaggcggaacaaacaggagugagccauaaccucaugauuacggucgacgaugacggcaccaugcggaucaaagaugacgagacagagaauauccugaccgugcuucugaagacagcucugcucauugucucuggcaucuuuccguacuccauuccugccacccugcuuguguggcacacguggcagaaacagacccagcgcagcgggguucugugggaugugcccucuccucccgaaacacaaaaggccgagcucgaagagggagucuacagaaucaaacagcagggcauuuucgggaagacccaggugggaguuggcgugcaaaaggagggggucuuucacacaauguggcaugugacccggggagcugugcugacauauaacggcaaacgccucgaaccgaauugggccuccguuaagaaagaccugaucagcuacggcgggggauggagacuuucugcgcaguggcagaagggcgaggaaguccaagugauugcuaucgagccugggaaaaaccccaagaauuuccaggccaugccuggaacguuccagaccacaaccggcgaaaucggggccauugcucuggauuuuaagcccggaaccuccggcagccccaucauuaaccgggagggcaaaguggucgggcuguauggaaauggcgugguuacaaagaacgggggauacguguccggcaucgcccagacgaaugcugagccugacgggccgacccccgaacucgaggaagagauguucaaaaagcgcaaccugacaauuauggaucuucacccuggcagcggaaaaaccagaaaguaucugcccgccaucguccgggaagcgaucaagcgcagacuccggacacugauucucgccccuaccagagugguugcugccgagauggaggaagcucugaaaggccuucccauccgcuaccaaacgacagccaccaagucugagcauaccgggcgggaaauuguggaccugaugugccacgccacauuuaccaugagacugcucagcccuguccgcgugccgaauuauaaccugaucauuauggaugaggcucauuucacagaccccgcguccaucgccgcucggggauacaucucuaccagaguuggcaugggggaagccgccgcuauuuuuaugacggccacaccucccggaaccgcggaugcuuucccucagagcaaugcccccauccaggacgaggagcgcgacauuccggaacgguccuggaacucuggcaaugaguggaucacagauuuugccgggaaaaccgugugguucgucccuagcauuaaggcuggcaacgacaucgccaacugucuucgcaaaaauggaaagaaggugauucagcuguccagaaaaacguuugauaccgaauaccaaaagacaaaacucaacgacugggauuucguggucaccacagacaucucugagaugggcgcgaauuuuaaggccgaucggguuaucgaccccagacggugccugaaacccgugauucugaccgaugggccugagcgcgugauccucgcuggacccaugccugucacagccgcuagcgccgcucagagacggggccgcguggggagaaacccgcagaaggaaaaugaccaguauauuuucaccggacaaccccuuaacaaugaugaggaccacgcccacuggacggaagcgaagaugcugcuggacaacaucaauacaccugagggcauuauccccgcccucuucgaaccugagcgggagaaauccgcugccaucgauggggaauacagacugaagggcgagagccgcaaaaccuuuguugaacuuaugcggagaggagaccugcccguguggcucgcucauaaggucgccucugagggcauuaaauauaccgaucgcaaguggugcuucgacgggcagcggaacaaucagauccuggaagagaacauggauguggagauuuggacaaaagaaggagagaagaagaaacugagaccgcgcuggcucgacgcccggaccuacuccgauccucuugcucugaaggaauuuaaagacuucgcggccggcagaaagagcaucgcucuggaucucguuacagagauugggcgcgugcccucucaccuggcccauagaacgcggaaugcccuugacaaccuggucaugcuccacaccuccgaacacggaggccgcgcuuauagacaugccguggaggagcugccugaaacaauggagacccugcuccuucugggccugaugauccuccugacagggggagcgaugcuuuuucugaucagcggcaaagggauuggaaagaccuccaucggccucauuugugucaucgccucuagcgggaugcuguggauggcugaaauuccccugcaguggaucgccuccgcuauugugcucgaguucuuuaugaugguucuucugaucccugagcccgaaaagcaacggacgccgcaggauaaucagcuggccuacguggugaucggcauucucacccuggcggccaucauugcugccaacgagaugggccuucuggaaacaaccaaacgcgaccucggcaugagcaaggagccuggggucguuucucccacauccuaucuggauguggaccugcaccccgcuagcgccuggacccucuacgcuguggccacgacagucaucaccccuaugcuuagacauacaauugaaaauucuaccgcgaacgugagccuggccgcuaucgccaaccaagcuguugugcugaugggacucgacaaaggcuggccgaucuccaagauggaucugggggucccccuucuggcccucggaugcuacucucaggugaauccucugacccugacagccgcgguccuccuucugauuacgcacuaugcuaucauuggccccgggcugcaggccaaagcuacccgggaggcccagaagagaacagccgcuggaaucaugaagaacccuaccguggacggcauuaugacaaucgaucucgaccccguuaucuacgauagcaaauucgagaagcaacugggccaggugaugcuucugguccucugugccgugcagcugcugcucaugcgcaccuccugggcgcuuugcgaagcccugacgcuggcuacagggccuauuaccacccucugggagggaucuccgggcaaauuuuggaauacaaccaucgccguuagcauggcuaacauuuuccggggguccuaucuggccggagcgggccuugccuuuagcaucaugaagucuguggggacaggaaaaagaggcacgggcucccagggggaaacccugggagagaaguggaagaaaaagcucaaucaacugagccgcaaagaguucgaccuguacaagaaauccggcauuacagaggucgaucggaccgaggcuaaggaagggcucaaaagaggagagaucacacaucacgccgugucucggggcagcgcuaaacuucagugguuuguggaacgcaacaugguuauucccgaggggagagucaucgaccugggauguggccggggcgggugguccuauuacugcgccggacugaagaaagugaccgaagugcgcggcuauacgaaagggggaccuggccacgaggagcccgucccuaugucuaccuacggguggaauaucguuaaacucaugagcggaaaggauguguucuaccugcccccggaaaaaugugacacacuucugugcgauauuggcgaguccagcccuucucccaccguggaagaguccagaacaauccggguccucaagaugguggagcccuggcugaagaacaaucaguucuguauuaaaguucugaacccuuauaugcccaccgugaucgaacaucucgagcgccuucagagaaagcacggcgggaugcugguccggaauccucugagccgcaacucuacacaugaaauguacuggauuuccaauggaaccggcaacaucguggcuagcguuaauauggugucuagacuccugcuuaaccgguuuacgaugacacacagacgcccgaccaucgagaaagacgucgaucugggggccggaacccggcacgugaacgcggaacccgagacaccuaauauggacgugauuggcgagagaaucaagcgcauuaaagaagaacacaacagcacguggcacuaugacgaugaaaaucccuacaagaccugggccuaucauggguccuacgaggucaaggcuacaggaucugccagcuccaugaucaacggcguugugaaacuccugaccaagccuugggacgugguccccauggugacacaaauggcuaugaccgauacaaccccguucggccagcagcggguuuuuaaagaaaagguggacacgagaaccccucgcagcaugcccgggacacggagagucaugggaauuaccgccgaguggcuguggcgcacacucggccggaauaaaaagccuagacugugcacccgcgaggaguucacgaagaaagugcggacaaacgccgcgaugggggcuguuuuuaccgaggaaaaucaaugggauuccgccaaggccgcuguggaggacgaagauuucuggaaacuugucgacagagagcgcgagcugcacaagcucggaaaauguggcucuugcguguauaacaugauggggaagagagagaagaagcugggcgaguuuggaaaggccaaaggcagccgggcuaucugguacauguggcuuggggcccgcuaccuggaguucgaggcgcucggauuucugaaugaggaucauugguucuccagagaaaacucuuauagcggcguugagggggaaggacugcacaagcucggcuacauccugcgggacauuuccaaaauccccgggggcgccauguaugcugaugacacagccggaugggacaccagaauuacggaggaugaccuucacaaugaagagaagaucacccagcagauggauccugagcaucggcagcuggcuaacgccauuuuuaaacucacauaccaaaauaagguggucaaggugcagcgccccaccccgacaggcaccgucauggacaucaucucuagaaaagaucagcgggggagcggacaggugggcacauaugggcugaacaccuucacgaauauggaagcgcaacuuauucgccagauggagggagaaggcguucuguccaaggccgaccucgagaacccucaucugcccgagaagaagaucacacaguggcuggagaccaaagggguggagagacucaagcggauggcuauuagcggcgaugacugcgucgugaagcccaucgaugaccgcuuugccaacgcucugcuugcccugaaugauaugggaaaagugagaaaggacauuccucaguggcaaccgucuaaaggcuggcaugauuggcagcagguucccuucuguucccaccacuuccaugaacucaucaugaaggacgggcggaaacugguggucccuugccgcccccaggacgagcuuauuggacgggcucggaucagccaaggcgccggguggucucugcgcgaaaccgcgugucucggaaaggccuacgcucagauguggucccugauguauuuucacagacgggaucugcgccucgccagcaacgccaucugcucugcugugccuguucauugggugcccacauccagaaccacauggagcauucacgcccaucaccaguggaugacgaccgaggacaugcugacagucuggaaucggguguggaucgaagauaacccuuggauggaggacaagacccccgucacaaccugggagaaugugccguaccuuggcaaaagagaagaucaauggugugggucccugauuggccucacgagccgcgcgaccugggcucagaacaucccuacagccauucagcagguucggucucugaucggaaaugaggaguuccuugacuacaugcccagcaugaagagauuucgcaaagaggaggaauccgagggcgccaucugguga

SEQ ID NO: 20619 - RNA, 9873 nt, Artificial Sequence
  derived and/or modified CDS sequence (opt5) from DENV-3__KJ189268__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacaaaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccagaacuccagcuucaucauugauggaccuaauacacccgagugcccgucugcguccagagccuggaacgucugggaaguggaggacuauggcuuuggcguguucaccacgaauaucuggcuccgccugcgggaagucuacacacaacugugugaccacagacuuaugagcgcugccguuaaagaugagcgcgccgugcaugcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccaccggcccggauaucacacccagacggcuggcccuuggcaucuugggaaacuggagcucgacuuuaauuacugcgagggaacaaccgugguuauuacagaaaacuguggcaccagaggccccucucugcgcacaaccacgguguccgggaagcugauccacgaguggugcugucggagcugcacccuuccgccucucagauauaugggagaagauggcuguugguacgggauggagauccggcccauuucugaaaaagaggagaauauggucaagucccuggugagcgccggaucuggcaaaguugacaacuucacaaugggggugcugugccucgccauccuguuugaagaggucaugcgcggaaaguucggcaagaaacauaugauugcuggcguguucuuuaccuucguucuucugcucagcgggcaaaucacauggagagauauggcccacacccugauuaugaucggauccaaugcgagcgaccggaugggcaugggggugacguaucuggcucuuauugccacauuuaagauccagcccuuccuggcccucggauuuuuccugagaaaacucaccucucgcgaaaaccugcuucugggcgucgggcucgcuauggccacaacccugcagcugccugaggauaucgaacaaauggcuaauggaauugcccuuggccugauggcgcucaagcugaucacccaguuugagacauaccagcucuggacggcccugauuucccuuaccuguagcaacacaaucuucacccugacaguggcuuggcggaccgccacgcucauucuggcuggcgugucccugcuuccggucugccagucuagcuccaugagaaaaacagacuggcugcccauggccguugccgcuaugggggugccuccccucccucuguuuaucuucucucucaaggauacccugaagcgcagaagcuggccccuuaaugagggagugauggcggucggccugguguccauccuggccucuagccuccugcggaacgacguuccuauggcugggccccuuguggccggaggccugcucauugccuguuaugucaucaccgggacauccgcugaucugaccguggaaaaagccgcggacauuacaugggaggaagaggcugaacaaacgggaguuagccauaaccucaugaucaccguggacgaugacggcacaaugcgcauuaaggaugacgagaccgagaauauccugacaguccuucugaaaaccgcccugcucaucgugucuggcauuuuuccguacuccaucccugccacgcugcuugucuggcacaccuggcagaagcagacacagagaagcggggugcugugggauguucccucuccucccgaaacccaaaaagcugagcucgaagagggaguguaccggauuaagcagcagggcaucuucgggaaaacacaggucggagugggcguucaaaaggaggggguguuucacaccauguggcaugucacacgcggagccgugcugacguauaacggcaagagacucgaaccgaauugggcguccgugaaaaaggaccugauuagcuacggcgggggauggcggcuuucuacccaguggcagaaaggcgaggaaguucaagucaucgcuguggagccugggaagaaccccaaaaauuuccagacaaugccuggaaccuuccagaccacaacgggcgaaauuggggccaucgcccuggauuuuaagcccggaaccuccggcagccccaucauuaaccgcgagggcaagguggucgggcuguauggaaauggcgugguuaccaagaacgggggauacguguccggcaucgcucagaccaaugccgagccugacgggccgacacccgaacucgaggaagagauguucaagaaaagaaaccugaccauuauggaucuucacccuggcagcggaaagacgcggaaauaucugcccgcuaucguccgcgaagccauuaagagacggcucagaacacugauccucgcgccuacccgcgugguugccgcugagauggaggaagcccugaagggccuucccauccgguaccaaaccacagcuaccaaaucugagcauacagggagagaaauuguggaccugaugugccacgccaccuuuacgaugcgccugcucagcccuguccgggugccgaauuauaaccugaucauuauggaugaggcccauuucacagaccccgcuuccaucgcggccagaggauacauuucuacccgcguuggcaugggggaagcugccgccaucuuuaugacagcuaccccucccggaacggccgaugcguucccucagagcaaugcucccauccaggacgaggagcgggacauuccggaaagauccuggaacucuggcaaugaguggaucaccgauuuugccgggaagacagugugguucgucccuagcauuaaagccggcaacgacaucgcuaacugucuucgcaagaauggcaaaaaggugauucagcugucccggaagaccuuugauacagaauaccagaagacaaagcucaacgacugggauuucguggucacaaccgacaucucugagaugggagccaauuuuaaagcggauagaguuauugacccccggcgcugccugaagcccgugauccugacggaugggccugagagagugauccucgccggacccaugccugucacagcugccagcgcugcccagcggcgcggcagaguggggcggaacccgcagaaagaaaaugaccaguauauuuucaccggacaaccccuuaacaaugaugaggaccacgcucacuggaccgaagccaagaugcugcuggacaacaucaauacaccugagggcauuauccccgcccucuucgaaccugagagagagaaguccgccgcuauugauggggaauaccgccugaaaggcgagagccggaagaccuuuguugaacuuaugagacgcggagaccugcccguguggcucgcccauaaagucgcuucugagggcaucaaguauacagaucggaaauggugcuucgacgggcagagaaacaaucagauccuggaagagaacauggauguggagauuuggacgaaggaaggagagaaaaagaagcugcgcccgcgguggcucgacgccagaaccuacuccgauccucuugcccugaaagaauuuaaggacuucgcugcgggccgcaaaagcaucgcccuggaucucguuacagagauugggagagugcccucucaccuggcucaucggaccaagaaugcccuugacaaccuggucaugcuccacacauccgaacacggaggccgcgccuauagacaugcuguggaggagcugccugaaaccauggagacgcugcuccuucugggccugaugauccuccugaccgggggagccaugcuuuuucugauuagcggcaaagggaucggaaagacauccaucggccucauuugugucaucgcgucuagcgggaugcuguggauggccgaaauuccccugcaguggaucgcuuccgccauugugcucgaguucuuuaugaugguucuucugaucccugagcccgaaaagcaacggaccccgcaggauaaucagcuggcuuacguggugauuggaauccucacacuggccgcgaccaucgccgcuaacgagaugggccuucuggaaacgacaaaacgcgaccucggcaugagcaaggagccuggggucguuucucccaccuccuaucuggauguggaccugcaccccgccagcgcuuggacacucuacgccguggcuaccaccgucauuacaccuaugcuuagacauacgaucgaaaauucuaccgccaacgugagccuggcggccauugcuaaccaagccguugugcugaugggacucgacaaaggcuggccgaucuccaagauggaucugggggucccccuucuggcucucggaugcuacucucaggugaauccucugacacugaccgccgccguccuccuucugauuacacacuaugcgaucaucggccccgggcugcaggcuaaagccacccgggaggcucagaagagaacggccgccggaauuaugaagaacccuacaguggacggcaucaugaccauugaucucgaccccguuaucuacgauagcaaauucgagaagcaacugggccaggugaugcuucugguccucugugcugugcagcugcugcucaugcgcaccuccugggcccuuugcgaagcgcugacacuggccaccgggccuauuacaacgcucugggagggaucuccgggcaaauuuuggaauaccacaaucgcuguuagcauggccaacaucuuccggggguccuaucuggcuggagccggccuugcguuuagcauuaugaagucuguggggaccggaaaaagaggcacaggcucccagggggaaacccugggagagaaguggaagaaaaagcucaaucaacugagccgcaaagaguucgaccuguacaagaaauccggcaucacggaggucgaucggaccgaggccaaggaagggcucaaaagaggagagauuacacaucacgcugugucucggggcagcgccaaacuucagugguuuguggaacgcaacaugguuauccccgaggggagagucauugaccugggauguggccggggcgggugguccuauuacugcgcuggacugaagaaagugaccgaagugcgcggcuauacaaaagggggaccuggccacgaggagcccgucccuaugucuaccuacggguggaauaucguuaaacucaugagcggaaaggauguguucuaccugcccccggaaaaaugugacacacuucugugcgauauuggcgaguccagcccuucucccaccguggaagaguccagaacgauccggguccucaagaugguggagcccuggcugaagaacaaucaguucuguaucaaaguucugaacccuuauaugcccacagugauugaacaucucgagcgccuucagagaaagcacggcgggaugcugguccggaauccucugagccgcaacucuacccaugaaauguacuggaucuccaauggaaccggcaacauuguggccagcguuaauauggugucuagacuccugcuuaaccgguuuacaaugacgcacagacgcccgaccaucgagaaagacgucgaucugggggcuggaacacggcacgugaacgccgaacccgagaccccuaauauggacgugauuggcgagagaaucaagcgcaucaaagaagaacacaacagcacauggcacuaugacgaugaaaaucccuacaagaccugggcguaucauggguccuacgaggucaaggccacaggaucugcuagcuccaugauuaacggcguugugaaacuccugaccaagccuugggacgugguccccauggugacgcaaauggccaugaccgauacaaccccguucggccagcagcggguuuuuaaagaaaagguggacacaagaaccccucgcagcaugcccgggacgcggagagucaugggaaucacagcugaguggcuguggcgcacccucggccggaauaaaaagccuagacugugcacacgcgaggaguucaccaagaaagugcggacgaacgccgccaugggggcgguuuuuaccgaggaaaaucaaugggauuccgcuaaggccgccguggaggacgaagauuucuggaaacuugucgacagagagcgcgagcugcacaagcucggaaaauguggcucuugcguguauaacaugauggggaagagagagaaaaagcugggcgaguuuggaaaggcuaaaggcagccgggccauuugguacauguggcuuggggcucgcuaccuggaguucgaggcccucggauuucugaaugaggaucauugguucuccagagaaaacucuuauagcggcguugagggggaaggacugcacaagcucggcuacauccugcgggacauuuccaaaauccccgggggcgcgauguaugccgaugacacagcuggaugggacaccagaaucacagaggaugaccuucacaaugaagagaagauuacccagcagauggauccugagcaucggcagcuggccaacgcuaucuuuaaacucacauaccaaaauaagguggucaaggugcagcgccccaccccgacgggcacagucauggacauuaucucuagaaaagaucagcgggggagcggacaggugggcaccuaugggcugaacaccuucacaaauauggaagcccaacuuauucgccagauggagggagaaggcguucuguccaaggcggaccucgagaacccucaucugcccgagaaaaagaucacccaguggcuggagacaaaagggguggagagacucaagcggauggccaucagcggcgaugacugcgucgugaagcccauugaugaccgcuuugcuaacgcccugcuugcucugaaugauaugggaaaagugagaaaggacaucccucaguggcaaccgucuaaaggcuggcaugauuggcagcagguucccuucuguucccaccacuuccaugaacucauuaugaaggacgggcggaaacugguggucccuugccgcccccaggacgagcuuaucggacgggcgcggauuagccaaggcgcuggguggucucugcgcgaaacggccugucucggaaaggcguacgcccagauguggucccugauguauuuucacagacgggaucugcgccucgcuagcaacgccaucugcucugccgugccuguucauugggugcccaccuccagaacaaccuggagcauucacgcucaucaccaguggaugacaaccgaggacaugcugacggucuggaaucggguguggaucgaagauaacccuuggauggaggacaagacccccgucacaaccugggaggaugugccguaccuuggcaaaagagaagaccaauggugugggucccugaucggccucacaagccgcgccaccugggcgcagaauauuccuacggcuauccagcagguucggucucugauuggaaacgaggaguuccuugauuacaugcccagcaugaagagauuucgcaaagaggaggaauccgagggcgccaucugguga

SEQ ID NO: 20620 - RNA, 9873 nt, Artificial Sequence
  derived and/or modified CDS sequence (opt5) from DENV-3__KJ189271__SS-prME
accagccugugccucaugaugauccugcccgccgcucuugccuuccaccugacaucccgggacggcgagccucggaugauuguggggaagaacgaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccagaacuccagcuucaucauugauggaccuaauacacccgagugcccgucugcguccagagccuggaacgucugggaaguggaggacuauggcuuuggcguguucaccacgaauaucuggcuccgccugcgggaagucuacacacaacugugugaccacagacuuaugagcgcugccguuaaagaugagcgcgccgugcaugcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccaccggcccggauaucacacccagacggcuggcccuuggcaucuugggaaacuggagcucgacuuuaauuacugcgagggaacaaccgugguuauuacagaaaacuguggcaccagaggccccucucugcgcacaaccacgguguccgggaagcugauccacgaguggugcugucggagcugcacccuuccgccucucagauauaugggagaagauggcuguugguacgggauggagauccggcccauuucugaaaaagaggagaauauggucaagucccuggugagcgccggaucuggcaaaguugacaacuucacaaugggggugcugugccucgccauccuguuugaagaggucaugcgcggaaaacuuggcaagaaacauaugauugcuggcguguucuucaccuuuguucugcuccugagcgggcaaaucacauggagagauauggcccacacccugauuaugaucggauccaaugcgagcgaccggaugggcaugggggugacguaucuugcucugauugccacauucaagauccagcccuuucucgcccugggauucuuucucagaaaacugaccucucgcgaaaaccuucugcucggcgucgggcuggcuauggccacaacccugcagcuuccugaggauaucgaacaaauggcuaauggaauugcccugggccucauggcgcugaagcucaucacccaguucgagacauaccagcuguggacggcccuuauuucccugaccuguagcaacacaaucuuuacccucacaguggcuuggcggaccgccacgcugauucuggcuggcgugucccuucugccggucugccagucuagcuccaugagaaaaacagacuggcuccccauggccguugccgcuaugggggugccuccccugccucucuucaucuuuucucugaaggauacccuuaagcgcagaagcuggccccugaaugagggagugauggcggucggccugguguccauccucgccucuagccugcuucggaacgacguuccuauggcugggccccugguggccggaggccuccugauugccuguuaugucaucaccgggacauccgcugaucucaccguggaaaaagccgcggacauuacaugggaggaagaggcugaacaaacgggaguuagccauaaccugaugaucaccguggacgaugacggcacaaugcgcauuaaggaugacgagaccgagaauauccuuacaguccugcugaaaaccgcccuccugaucgugucuggcauuuucccguacuccaucccugccacgcuucuggucuggcacaccuggcagaagcagacacagagaagcggggugcucugggauguucccucuccucccgaaacccaaaaagcugagcuggaagagggaguguaccggauuaagcagcagggcaucuuugggaaaacacaggucggagugggcguucaaaaggaggggguguuccacaccauguggcaugucacacgcggagccgugcucacguauaacggcaagagacuggaaccgaauugggcguccgugaaaaaggaccuuauuagcuacggcgggggauggcggcugucuacccaguggcagaaaggcgaggaaguucaagucaucgcuguggagccugggaagaaccccaaaaauuuucagacaaugccuggaaccuuccagaccacaacgggcgaaauuggggccaucgcccuggauuucaagcccggaaccuccggcagccccaucauuaaccgcgagggcaagguggucgggcucuauggaaauggcgugguuaccaagaacgggggauacguguccggcaucgcucagaccaaugccgagccugacgggccgacacccgaacuggaggaagagauguuuaagaaaagaaaccuuaccauuauggaucugcacccuggcagcggaaagacgcggaaauaucuccccgcuaucguccgcgaagccauuaagagacggcugagaacacucauccuggcgccuacccgcgugguugccgcugagauggaggaagcccuuaagggccugcccauccgguaccaaaccacagcuaccaaaucugagcauacagggagagaaauuguggaccugaugugccacgccaccuucacgaugcgccuccugagcccuguccgggugccgaauuauaaccuuaucauuauggaugaggcccauuuuacagaccccgcuuccaucgcggccagaggauacauuucuacccgcguuggcaugggggaagcugccgccaucuucaugacagcuaccccucccggaacggccgaugcguuuccucagagcaaugcucccauccaggacgaggagcgggacauuccggaaagauccuggaacucuggcaaugaguggaucaccgauuucgccgggaagacagugugguuugucccuagcauuaaagccggcaacgacaucgcuaacugucugcgcaagaauggcaaaaaggugauucagcucucccggaagaccuucgauacagaauaccagaagacaaagcugaacgacugggauuuuguggucacaaccgacaucucugagaugggagccaauuucaaagcggauagaguuauugacccccggcgcugccugaagcccgugauccucacggaugggccugagagagugauccuugccggacccaugccugucacagcugccagcgcugcccagcggcgcggcagaguggggcggaacccgcagaaagaaaaugaccaguauauuuuuaccggacaaccccugaacaaugaugaggaccacgcucacuggaccgaagccaagaugcugcucgacaacaucaauacaccugagggcauuauccccgcgcuguucgaaccugagagagagaaguccgccgcuauugauggggaauaccgccuuaaaggcgagagccggaagaccuucguugaacugaugagacgcggagaccuccccguguggcuggcccauaaagucgcuucugagggcaucaaguauacagaucggaaauggugcuuugacgggcagagaaacaaucagauccuggaagagaacauggauguggagauuuggacgaaggaaggagagaaaaagaagcuccgcccgcgguggcuugacgccagaaccuacuccgauccucuggcccugaaagaguucaaggacuuugcugcgggccgcaaaagcaucgcccucgaucugguuacagagauugggagagugcccucucaccuugcucaucggacccgcaaugcccuggacaaccucgucaugcugcacacauccgaacacggaggcagagccuaucggcaugcuguggaggagcugccugaaaccauggagacgcuccuucugcugggccucaugauccugcuuaccgggggagccaugcuguuccucauuagcggcaaggggaucggaaaaacauccaucggccugauuugugucaucgcgucuagcgggaugcuguggauggccgaaauuccccuccaguggaucgcuuccgccauugugcuugaguuuuucaugaugguucugcugaucccugagcccgaaaagcaacgcaccccgcaggauaaucagcucgcuuacguggugauuggaauccugacacuugccgcgaucauugccgcuaacgagaugggccugcucgaaaccacgaagagagaccugggcaugagcaaagagccuggggucguuucucccacauccuaucuggauguggaccuccaccccgccagcgcuuggacccuuuacgccguggcuacaaccgucaucaccccuaugcugcggcauacaauugaaaauucuacggccaacgugagccuggcggccaucgcuaaccaagccguugugcucaugggacuggacaagggcuggccgauuuccaaaauggaucuuggggucccccugcucgcucugggaugcuacucucaggugaauccucugacccucacagccgccguccuucugcugaucacccacuaugcgaucauuggccccgggcuccaggcuaaggccacaagagaggcucagaaacgcaccgccgccggaaucaugaagaacccuacgguggacggcauuaugacaaucgaucuggaccccguuauuuacgauagcaaguuugagaaacaacuuggccaggugaugcugcucguccugugugcugugcagcugcuccuuaugcggaccuccugggcccugugcgaagcgcugacccucgccacagggccuaucaccacacugugggagggaucuccgggcaaguucuggaauacgaccaucgcuguuagcauggccaacauuuuuagaggguccuaucuugcuggagccggccuggcguucagcaucaugaaaucuguggggacaggaaagcgcggcaccggcucccagggggaaacacucggagagaaauggaagaagaaacugaaucaacugagccggaaggaauuugaccucuacaaaaaguccggcauuaccgaggucgauagaacggaggccaaagaagggcuuaagcggggagagaucacccaucacgcugugucucgcggcagcgccaaacugcagugguucguggaaagaaacaugguuauucccgaggggcgggucaucgaccugggauguggccgcggcgggugguccuauuacugcgcuggacucaagaaggugacagaagugagaggcuauaccaaagggggaccuggccacgaggagcccgucccuaugucuacauacggguggaauauuguuaagcugaugagcggaaaagauguguuuuaccuucccccggaaaagugugacacccugcucugcgauaucggcgaguccagcccuucucccacaguggaagagucccggaccauccgcguccugaaaaugguggagcccuggcugaagaacaaucaguucuguauuaagguucucaacccuuauaugcccacggugaucgaacaucuugagagacugcagcggaaacacggcgggaugcugguccgcaauccucucagcagaaacucuacacaugaaauguacuggauuuccaauggaaccggcaacaucguggccagcguuaauauggugucucggcugcuucugaacagauucaccaugacacaccgccggccgacgauugagaaggacgucgaucucggggcuggaaccagacacgugaacgccgaacccgagacaccuaauauggacgugaucggcgagcgcaucaaacggauuaaggaagaacacaacagcaccuggcacuaugacgaugaaaaucccuacaaaacaugggcguaucauggguccuacgaggucaaggccaccggaucugcuagcuccaugaucaacggcguugugaagcugcugacaaaaccuugggacgugguccccauggugacccaaauggccaugacggauaccacaccguuuggccagcagagaguuuucaaggaaaaaguggacacccgcacaccucggagcaugcccgggaccagacgcgucaugggaauuacggcugaguggcucuggcggacacugggcagaaauaagaaaccucgccuuugcacccgggaggaauuuacaaagaaggugagaaccaacgccgccaugggggcgguuuucacggaggaaaaucaaugggauuccgcuaaagccgccguggaggacgaagauuuuuggaagcuggucgaccgcgagagagagcuccacaaacugggaaaguguggcucuugcguguauaacaugauggggaaacgggaaaagaaacuuggcgaguucggaaaggcuaagggcagccgcgccaucugguacauguggcugggggcuagauaccucgaauuugaggcccugggauuccugaaugaggaucauugguuuucccgggaaaacucuuauagcggcguugagggggaaggacuccacaaacugggcuacauucuuagagacaucuccaagauccccgggggcgcgauguaugccgaugacaccgcuggaugggacacacggauuaccgaggaugaccugcacaaugaagagaaaaucacacagcagauggauccugagcaucgccagcucgccaacgcuauuuucaagcugaccuaccaaaauaaaguggucaaggugcagagacccacaccgaccggcacggucauggacaucauuucucggaaggaucagcgcgggagcggacaggugggcacauaugggcuuaacaccuuuaccaauauggaagcccaacugaucagacagauggagggagaaggcguucucuccaaagcggaccuggagaacccucaucugcccgaaaagaaaaucacacaguggcucgagaccaaggggguggagcggcugaaacgcauggccauuagcggcgaugacugcgucgugaagcccaucgaugacagauucgcuaacgcccuucuggcucucaaugauaugggaaaggugcggaaagacauuccucaguggcaaccgucuaagggcuggcaugauuggcagcagguucccuuuuguucccaccacuuccaugaacugaucaugaaagacgggcgcaaacuuguggucccuugcagaccccaggacgagcugauuggacgggcccgcaucagccaaggcgcuggguggucucucagagaaacagccugucugggaaaagcguacgcccagauguggucccugauguauuuccaccggcgcgaucucagacuggcuagcaacgccauuugcucugccgugccuguucauugggugcccacgucccggaccacauggagcauccacgcucaucaccaguggaugaccacagaggacaugcuuaccgucuggaauagaguguggaucgaagauaacccuuggauggaggacaagacgcccgucaccacaugggaggaugugccguaccugggcaagcgcgaagaccaauggugugggucccucauuggccugaccagccgggccacaugggcgcagaauaucccuaccgcuauucagcagguuagaucucuuaucggaaacgaggaauuucuggauuacaugcccagcaugaaacgcuuccggaaggaggaggaauccgagggcgccauuugguga

SEQ ID NO: 20621 - RNA, 9873 nt, Artificial Sequence
  derived and/or modified CDS sequence (opt5) from DENV-3__KJ189272__SS-prME
accagccugugccucaugaugauccugcccgcggcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccguauaucacagaaguugagcccgaagacauugauugcugguguaaccucaccuccacaugggugaccuacggaacgugcaaucaggccggcgagcaucggcgggacaagcgcucuguggcccuggcuccucacgucgggaugggacuggauaccagaacacaaaccuggaugagcgccgagggcgcuuggagacagguggaaaaaguugagacaugggcccuccgccaucccggcuucaccauccuggcgcuuuuucuggcccacuauaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcauggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuacguguguaaacacaccuaugucgaucggggcugggggaacggaugcggccuguucgggaagggaagccuugugaccugcgccaaguuucaaugucuggagcccauugagggcaaaguugugcaguacgaaaaucucaaguauacagucaucaucaccgugcacacaggggaccagcaucagguuggaaacgagacgcaaggcgugaccgcugaaauuacaccucaggccucuaccacagaggcuacccugcccgaauacggcacgcuggggcucgagugcuccccucgcaccggacuggacuucaaugagaugauccuucugacaaugaaaaacaaggccuggaugguccacagacagugguuuuucgaucucccccugccguggaccagcggcgccacaaccgaaacgccuacauggaaucggaaagagcuucuggugaccuuuaagaacgcucaugcgaaaaagcaagaagucgugguucucgggucucaggagggagccaugcacacagcucugaccggcgccaccgaaauucaaaauuccgggggcacaagcaucuucgccggacaccugaagugucgccucaaaauggacaagcuggagcuuaaaggcaugucuuacgcuaugugcacgaacaccuuugugcugaagaaagaggucuccgaaacacagcaugggaccauucucaucaagguggaguauaagggagaagaugcccccuguaaaaucccuuucagcacagaggacggccacgggaaggcgcauaacggaagacugauuaccgcuaaucccguugugacgaaaaaggaggaacccgucuccaucgaggccgaaccuccguucggcgagucuaacauugugaucgggauuggcgauaaugcccugaaaaucaacugguacaagaagggaagcuccaucggcaaaauguuugaagcuacagccagaggggcuagacgcauggccauucuuggagacaccgcgugggauuucggcagcgucgggggaguucucaauucucugggcaagaugguccaccaaaucuuuggguccgccuauaccgcucuguucagcggcgugucuugggugaugaaaauuggaaucggcguccuccugacauggauugggcuuaacagcaagaauaccuccaugucuuuuagcugcaucgccauuggaaucaucacacuguaccucggcgcugugguucaggccgacauggggugugugauuaacuggaaaggaaaggagcugaagugcggcuccgggaucuucgucacgaaugaggugcauaccuggacagaacaguauaaauuucaggcggauagccccaagcggcuggccaccgcuauugccggcgcuugggagaacggaguuuguggcaucagaucuacaacccgcauggaaaaucuucucuggaaacaaauugccaacgagcugaauuacauccugugggaaaacaauaucaagcucacgguggucgugggggacauuaucggaguucuggagcagggcaaacggacccuuacaccucagcccauggagcugaaguauuccuggaaaaccugggggaaggccaagauugugacagcugaaacccagaacagcucuuucaucauugauggaccuaacacacccgagugcccguccgcgagcagagccuggaaugucugggaaguggaggacuacggcuuuggcguguucaccacgaacaucuggcuccgccugcgggaagucuacacacaacugugugaccacagacuuauguccgcugccguuaaagaugagcgcgccgugcacgcugacaugggguauuggaucgagucucagaagaauggaagcuggaaacucgaaaaggccucccugauugaggugaaaaccugcaccuggccuaagucucauacacuguggagcaacggcguccucgaauccgauaugaucauucccaagagccuggcggggccuaucucucagcacaaucaucggcccggauaccacacccagacggcuggcccuuggcaccuugggaaacuggagcucgacuuuaacuauugcgagggaacaaccgugguuauuacagaaaauuguggcaccagaggccccucccugcgcacaaccacggugagcgggaagcugauccaugaguggugcugucggucuugcacccuuccgccucucagauacaugggagaagauggcuguugguaugggauggagauccggcccauuuccgaaaaagaggagaacauggucaagagccuggugucugccggaagcggcaaaguugacaauuucacaaugggggugcugugccucgccauccuguuugaagaggucaugcgcggaaaguucggcaagaaacacaugauugcuggcguguucuuuaccuucguucuucugcucuccgggcaaaucacauggagagauauggcccauacccugauuaugaucggaagcaacgcgucugaccggaugggcaugggggugacguaccuggcucuuauugccacauuuaagauccagcccuuccuggcccucggauuuuuccugagaaaacucaccucccgcgaaaaucugcuucugggcgucgggcucgcuauggccacaacccugcagcugccugaggauaucgaacaaauggcuaacggaauugcccuuggccugauggcgcucaagcugaucacccaguuugagacauaucagcucuggacggcccugauuagccuuaccuguuccaauacaaucuucacccugacaguggcuuggcggaccgccacgcucauucuggcuggcgugucucugcuuccggucugccagagcuccucuaugagaaaaacagacuggcugcccauggccguugccgcuaugggggugccuccccucccucuguuuaucuucagccucaaggauacccugaagcgcagauccuggccccuuaacgagggagugauggcggucggccuggugucuauccuggccagcucccuccugcggaaugacguuccuauggcugggccccuuguggccggaggccugcucauugccuguuacgucaucaccgggacaagcgcugaucugaccguggaaaaagccgcggacauuacaugggaggaagaggcugaacaaacgggaguuucucacaaccucaugaucaccguggacgaugacggcacaaugcgcauuaaggaugacgagaccgagaacauccugacaguccuucugaaaaccgcccugcucaucguguccggcauuuuuccguacagcaucccugccacgcugcuugucuggcauaccuggcagaagcagacacagagaucuggggugcugugggauguucccuccccucccgaaacccaaaaagcugagcucgaagagggaguguaucggauuaagcagcagggcaucuucgggaaaacacaggucggagugggcguucaaaaggaggggguguuucacaccauguggcacgucacacgcggagccgugcugacguacaauggcaagagacucgaaccgaacugggcgagcgugaaaaaggaccugauuucuuauggcgggggauggcggcuuuccacccaguggcagaaaggcgaggaaguucaagucaucgcuguggagccugggaagaaucccaaaaacuuccagacaaugccuggaaccuuccagaccacaacgggcgaaauuggggccaucgcccuggauuuuaagcccggaaccagcggcucccccaucauuaaucgcgagggcaagguggucgggcuguacggaaacggcgugguuaccaagaaugggggauaugugagcggcaucgcucagaccaacgccgagccugacgggccgacacccgaacucgaggaagagauguucaagaaaagaaaucugaccauuauggaucuucauccuggcucuggaaagacgcggaaauaccugcccgcuaucguccgcgaagccauuaagagacggcucagaacacugauccucgcgccuacccgcgugguugccgcugagauggaggaagcccugaagggccuucccauccgguaucaaaccacagcuaccaaaagcgagcacacagggagagaaauuguggaccugaugugccaugccaccuuuacgaugcgccugcucuccccuguccgggugccgaacuacaaucugaucauuauggaugaggcccacuucacagaccccgcuucuaucgcggccagaggauacauuagcacccgcguuggcaugggggaagcugccgccaucuuuaugacagcuaccccucccggaacggccgaugcguucccucaguccaacgcucccauccaggacgaggagcgggacauuccggaaagaucuuggaauagcggcaacgaguggaucaccgauuuugccgggaagacagugugguucgucccuuccauuaaagccggcaaugacaucgcuaacugucuucgcaagaacggcaaaaaggugauucagcugucucggaagaccuuugauacagaauaucagaaaacaaagcucaaugacugggauuucguggucacaaccgacaucagcgagaugggagccaacuuuaaagcggauagaguuauugacccccggcgcugccugaagcccgugauccugacggaugggccugagagagugauccucgccggacccaugccugucacagcugccuccgcugcccagcggcgcggcagaguggggcggaauccgcagaaagaaaacgaccaguacauuuucaccggacaaccccuuaauaacgaugaggaccaugcucacuggaccgaagccaagaugcugcuggacaauaucaacacaccugagggcauuauccccgcccucuucgaaccugagagagaaaagagcgccgcuauugauggggaauaucgccugaaaggcgagucucggaagaccuuuguugaacuuaugagacgcggagaccugcccguguggcucgcccacaaagucgcuuccgagggcaucaaguacacagaucggaaauggugcuucgacgggcagagaaauaaccagauccuggaagagaauauggauguggagauuuggacgaaggaaggagagaaaaagaagcugcgcccgcgguggcucgacgccagaaccuauagcgauccucuugcccugaaagaauuuaaggacuucgcugcgggccgcaaaucuaucgcccuggaucucguuacagagauugggagagugcccucccaucuggcucaccggacccgcaacgcccuugacaaucuggucaugcuccauacaagcgaacacggaggcagagccuaccggcacgcuguggaggagcugccugaaaccauggagacgcugcuccuucugggccugaugauccuccugaccgggggagccaugcuuuuucugauuuccggcaaggggaucggaaaaacaucuaucggccucauuugugucaucgcgagcuccgggaugcuguggauggccgaaauuccccugcaguggaucgcuagcgccauugugcucgaguucuuuaugaugguucuucugaucccugagcccgaaaagcaacgcaccccgcaggauaaccagcuggcuuauguggugauuggaauccucacacuggccgcgaucauugccgcuaaugagaugggccuucuggaaaccacgaagagagaccucggcaugucuaaagagccuggggucguuucccccacaagcuaccuggauguggaccugcaucccgccucugcuuggacccucuacgccguggcuacaaccgucaucaccccuaugcuucggcacacaauugaaaacagcacggccaaugugucccuggcggccaucgcuaaccaagccguugugcugaugggacucgacaagggcuggccgauuucuaaaauggaucugggggucccccuucuggcucucggaugcuauagccaggugaacccucugacccugacagccgccguccuccuucugaucacccauuacgcgaucauuggccccgggcugcaggcuaaggccacaagagaggcucagaaacgcaccgccgccggaaucaugaagaauccuacgguggacggcauuaugacaaucgaucucgaccccguuauuuaugauuccaaguucgagaaacaacugggccaggugaugcuucugguccucugugcugugcagcugcugcucaugcggaccucuugggcccuuugcgaagcgcugacccuggccacagggccuaucaccacacucugggagggaagcccgggcaaguuuuggaacacgaccaucgcuguuuccauggccaauauuuucagagggagcuaccuggcuggagccggccuugcguuuucuaucaugaaauccguggggacaggaaagcgcggcaccggcagccagggggaaacacugggagagaaauggaagaagaaacucaaccaacugucccggaaggaguucgaccuguauaaaaagucuggcauuaccgaggucgauagaacggaggccaaagaagggcucaagcggggagagaucacccaccaugcugugagccgcggcuccgccaaacuucagugguuuguggaaagaaauaugguuauucccgaggggcgggucaucgaccugggauguggccgcggcggguggucuuacuauugcgcuggacugaagaaggugacagaagugagaggcuacaccaaagggggaccuggccacgaggagcccgucccuaugagcacauacggguggaacauuguuaagcucauguccggaaaagauguguucuaucugcccccggaaaagugugacacccuucugugcgauaucggcgagagcucuccuucccccacaguggaagagagccggaccauccgcguccucaaaaugguggagcccuggcugaagaauaaccaguucuguauuaagguucugaauccuuacaugcccacggugaucgaacaccucgagagacuucagcggaaacauggcgggaugcugguccgcaacccucugucuagaaauuccacacacgaaauguauuggauuagcaacggaaccggcaauaucguggccucuguuaacauggugagccggcuccugcuuaauagauuuaccaugacacaucgccggccgacgauugagaaggacgucgaucugggggcuggaaccagacacgugaacgccgaacccgagacaccuaacauggacgugaucggcgagcgcaucaaacggauuaaggaagaacacaauuccaccuggcauuacgacgaugaaaaccccuauaaaacaugggcguaccacgggucuuaugaggucaaggccaccggaagcgcuuccagcaugaucaauggcguugugaagcuccugacaaaaccuugggacgugguccccauggugacccaaauggccaugacggauaccacaccguucggccagcagagaguuuuuaaggaaaaaguggacacccgcacaccucgguccaugcccgggaccagacgcgucaugggaauuacggcugaguggcuguggcggacacucggcagaaacaagaaaccucgccugugcacccgggaggaguucacaaagaaggugagaaccaaugccgccaugggggcgguuuuuacggaggaaaaccaaugggauucugcuaaagccgccguggaggacgaagauuucuggaaacuugucgaccgcgagagagagcugcauaaacucggaaaguguggcagcugcguguacaauaugauggggaaacgggaaaagaaacugggcgaguuuggaaaggcuaagggcucccgcgccaucugguacauguggcuuggggcuagauaucuggaguucgaggcccucggauuucugaacgaggaucacugguucucucgggaaaauagcuacuccggcguugagggggaaggacugcauaaacucggcuauauucugagagacaucucuaagauccccgggggcgcgauguacgccgaugacaccgcuggaugggacacacggauuaccgaggaugaccuucacaacgaagagaaaaucacacagcagauggauccugagcaccgccagcuggccaaugcuauuuuuaagcucaccuaucaaaacaaaguggucaaggugcagagacccacaccgaccggcacggucauggacaucauuagccggaaggaucagcgcggguccggacaggugggcacauacgggcugaauaccuucaccaacauggaagcccaacuuaucagacagauggagggagaaggcguucugagcaaagcggaccucgagaauccucaucugcccgaaaagaaaaucacacaguggcuggagaccaaggggguggagcggcucaaacgcauggccauuucuggcgaugacugcgucgugaagcccaucgaugacagauuugcuaacgcccugcuugcucugaacgauaugggaaaggugcggaaagacauuccucaguggcaaccguccaagggcuggcacgauuggcagcagguucccuucuguagccaucacuuccacgaacucaucaugaaagacgggcgcaagcugguggucccuugcagaccccaggacgagcuuauuggacgggcccgcaucucucaaggcgcuggguggucccugagagaaacagccugucucggaaaagcguaugcccagauguggagccugauguacuuucaucggcgcgaucugagacucgcuucuaaugccauuugcuccgccgugccuguucacugggugcccacgagccggaccacaugguccauccaugcucaccaucaguggaugaccacagaggacaugcugaccgucuggaacagaguguggaucgaagauaauccuuggauggaggacaagacgcccgucaccacaugggaggaugugccguaccuuggcaagcgcgaagaccaauggugugggagccugauuggccucaccucucgggccacaugggcgcagaacaucccuaccgcuauucagcagguuagaagccugaucggaaaugaggaguuccuugauuauaugcccuccaugaaacgcuuucggaaggaggaggaaucugagggcgccauuugguga

SEQ ID NO: 20622 - RNA, 9873 nt, Artificial Sequence
  derived and/or modified CDS sequence (opt5) from DENV-3__KJ189273__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggcggcaaguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucagugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggucacccugcccgaauauggcacgcuggggcucgagugcuccccucgcaccggacuggacuucaaugagaugauccuucugacaaugaaaaacaaggcuuggauggugcauagacagugguuuuucgaucucccccugccguggaccagcggcgccacaaccgaaacgccuacauggaaucggaaagagcuucuggucaccuuuaagaacgcccacgcuaaaaagcaagaagugguugugcucgggucucaggagggagcgaugcacacagcccugaccggcgcuaccgaaauucaaaauuccgggggcacaagcaucuucgccggacaucugaagugucgccucaaaauggacaagcuggagcuuaaaggcaugucuuacgccaugugcacgaacaccuuuguccugaagaaagagguguccgaaacacagcacgggaccauucucaucaagguugaguacaagggagaagaugcucccuguaaaaucccuuucagcacagaggacggccaugggaaggcccacaacggaagacugauuaccgcgaaucccguggucacgaaaaaggaggaacccgugaacaucgaggcugaaccuccguucggcgaguccaauauugugaucgggauuggcgauaacgcccugaaaaucaauugguauaagaagggaucuagcaucggcaaaauguuugaagccacagcuagaggggccagacgcauggcuauucuuggagacaccgccugggauuucggcuccguugggggaguccucaacagccugggcaagauggugcaucaaaucuuugggucugcguacaccgcccuguucuccggcgugagcugggucaugaaaauuggaaucggcgugcuccugacauggauugggcuuaauucuaagaacaccagcauguccuuuucuugcaucgcuauuggaaucaucacacuguaucucggcgccguugugcaggcugacauggggugugucauuaauuggaaaggaaaggagcugaagugcggcagcgggaucuucgugacgaacgagguucacaccuggacagaacaguacaaauuucaggccgauucccccaagcggcuggcgaccgccauugcuggcgccugggagaauggaguguguggcaucagaagcacaacccgcauggaaaaccuucucuggaaacaaauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucacagccgaaacccagaacuccagcuucaucauugauggaccuaauacacccgagugcccgucugcuuccagagcguggaacgugugggaaguggaggacuauggcuuuggcgucuucaccacgaauaucuggcuccgccugcgggaaguuuacacacaacugugugaccacagacuuaugagcgccgcugugaaagaugagcgcgccgugcaugccgacaugggguacuggaucgagucccagaagaacggaucuuggaaacucgaaaaggcuagccugauugaggucaaaaccugcaccuggccuaagucccacacacuguggucuaauggcgugcucgaaagcgauaugaucauucccaagucccuggccgggccuaucagccagcauaaccaccggcccggauaucacacccagacggcgggcccuuggcaucuugggaaacuggagcucgacuuuaauuacugcgagggaacaaccguugugauuacagaaaacuguggcaccagaggccccucucugcgcacaaccacggucuccgggaagcugauccacgaguggugcugucggagcugcacccuuccgccucucagauauaugggagaagauggcuguugguacgggauggagauccggcccauuucugaaaaagaggagaauauggugaagucccugguuagcgcuggaucuggcaaaguggacaacuucacaauggggguccugugccucgccauccuguuugaagaggugaugcgcggaaaguucggcaagaaacauaugauugccggcguuuucuuuaccuucgugcuucugcucagcgggcaaaucacauggagagauauggcucacacccugauuaugaucggauccaaugccagcgaccggaugggcaugggggucacguaucuggcgcuuauugcuacauuuaagauccagcccuuccuggcccucggauuuuuccugagaaaacucaccucucgcgaaaaccugcuucugggcguggggcucgccauggcuacaacccugcagcugccugaggauaucgaacaaauggccaauggaauugcucuuggccugauggcccucaagcugaucacccaguuugagauuuaccagcucuggacagcgcugaucucccuuacguguagcaacaccauuuucacacugaccguggccuggcggacagcuacccucauccuggccggcgucucccugcuuccgguuugccagucuagcuccaugagaaaaacggacuggcugcccauggcuguggccgccaugggggugccuccccucccucuguuuaucuucucucucaaggauacacugaagcgcagaagcuggccccuuaaugagggagucauggcugugggccugguuuccauucuggcgucuagccuccugcggaacgacgugccuauggccgggccccuugucgcuggaggccugcucaucgccuguuaugugauuaccgggaccuccgccgaucugacaguugaaaaagcugccgacaucaccugggaggaagaggcggaacaaacaggagugagccauaaccucaugauuacggucgacgaugacggcaccaugcgcaucaaggaugacgagacagagaauauccugaccgugcuucugaaaacagcucugcucauugucucuggcaucuuuccguacuccauuccugccacccugcuuguguggcacacguggcagaagcagacccagagaagcgggguucugugggaugugcccucuccucccgaaacacaaaaagccgagcucgaagagggagucuaccggaucaagcagcagggcauuuucgggaaaacccaggugggaguuggcgugcaaaaggagggggucuuucacacaauguggcaugugacccgcggagcugugcugacauauaacggcaagagacucgaaccgaauugggccuccguuaaaaaggaccugaucagcuacggcgggggauggcggcuuucuacgcaguggcagaaaggcgaggaaguccaagugauugcgguggagccugggaagaaccccaaaaauuuccagaccaugccuggaacauuccagaccaccacaggcgaaaucggggcuaucgcccuggauuuuaagcccggaacguccggcagccccauuaucaaccgcgagggcaaggucguggggcuguauggaaauggcguugugaccaaaaacgggggauacgucuccggcauugcccagacaaaugcugagccugacgggccgacccccgaacucgaggaagagauguucaagaaaagaaaccugacaaucauggaucuucacccuggcagcggaaagacccggaaauaucugcccgccauugugcgcgaagcuaucaagagacggcucagaacgcugauccucgccccuacacgcguuguggcggccgagauggaggaagcucugaagggccuucccauucgguaccaaaccaccgccacaaaaucugagcauaccgggagagaaaucgucgaccugaugugccacgcuacauuuaccaugcgccugcucagcccugugcggguuccgaauuauaaccugauuaucauggaugaggcccauuucacggaccccgccuccauugcugcgagaggauacaucucuacacgcgugggcaugggggaagccgcugccaucuuuaugaccgccacaccucccggaaccgcugaugccuucccucagagcaaugcgcccauucaggacgaggagcgggacaucccggaaagauccuggaacucuggcaaugaguggauuacggauuuugcugggaagaccgucugguucgugccuagcaucaaagccggcaacgacauugccaacugucuucgcaagaauggcaaaaaggugauccagcugucccggaagacauuugauaccgaauaccagaagacgaagcucaacgacugggauuucgucguuaccacagacauuucugagaugggagcuaauuuuaaagccgauagagugaucgacccccggcgcugccugaagcccgugauccugaccgaugggccugagagagucauucucgcgggacccaugccugugacggccgcuagcgccgcucagcggcgcggcagaguugggcggaacccgcagaaagaaaaugaccaguauaucuucacaggacaaccccuuaacaaugaugaggaccacgcccacuggaccgaagcuaagaugcugcuggacaacauuaauaccccugagggcaucauucccgcccucuucgaaccugagagagagaaguccgcggccaucgauggggaauaccgccugaaaggcgagagccggaagacauuuguggaacuuaugagacgcggagaccugcccgucuggcucgcucauaaaguggccucugagggcaucaaguauaccgaucggaaauggugcuucgacgggcagagaaacaaucagauucuggaagagaacauggauguugagaucuggacaaaggaaggagagaaaaagaagcugcgcccgcgguggcucgacgcuagaacguacuccgauccucuugcccugaaagaauuuaaggacuucgccgcuggccgcaaaagcauugcgcuggaucucgugaccgagaucgggagaguccccucucaccuggcccaucggacacgcaaugcucuugacaaccuggugaugcuccacaccuccgaacacggaggcagagccuaucggcaugccgucgaggagcugccugaaacaauggagacccugcuccuucugggccugaugauucuccugacagggggagcuaugcuuuuucugaucagcggcaaggggaucggaaaaaccuccauuggccucaucugugugauugccucuagcgggaugcuguggauggcggaaaucccccugcaguggauugccuccgcuaucguucucgaguucuuuaugauggugcuucugauuccugagcccgaaaagcaacgcacaccgcaggauaaucagcuggccuacguggucaucggaauccucacccuggcugccauuaucgcggccaacgagaugggccuucuggaaacaaccaagagagaccucggcaugagcaaagagccugggguugugucucccacguccuaucuggauguggaccugcaccccgcuagcgccuggacacucuacgcugucgccaccacagugauuaccccuaugcuucggcauaccaucgaaaauucuacagcuaacguuagccuggccgcgauugccaaccaagcugugguccugaugggacucgacaagggcuggccgaucuccaaaauggaucugggggugccccuucuggcccucggaugcuacucucaggucaauccucugacgcugaccgcugccgugcuccuucugaucacacacuaugccauuaucggccccgggcugcaggcgaaggcuaccagagaggcccagaaacgcacagcugccggaauuaugaagaacccuaccguugacggcaucaugacgauugaucucgaccccgugaucuacgauagcaaguucgagaaacaacugggccaggucaugcuucuggugcucugugccguucagcugcugcucaugcggacauccugggcucuuugcgaagcccugacccuggcgaccgggccuaucacaacccucugggagggaucuccgggcaaguuuuggaauacaacgauugccgugagcauggcuaacaucuucagaggguccuaucuggccggagcuggccuugccuuuagcauuaugaaaucugucgggaccggaaagcgcggcacaggcucccagggggaaacccugggagagaaauggaagaagaaacucaaucaacugagccggaaggaguucgaccuguacaaaaaguccggcaucacagagguggauagaaccgaggcgaaagaagggcucaagcggggagagauuacgcaucacgccgugucucgcggcagcgcuaaacuucagugguuuguugaaagaaacauggucauccccgaggggcgggugauugaccugggauguggccgcggcgggugguccuauuacugcgccggacugaagaaggugaccgaagucagaggcuauacaaaagggggaccuggccacgaggagcccguuccuaugucuaccuacggguggaauaucgugaagcucaugagcggaaaagauguguucuaccugcccccggaaaagugugacacacuucugugcgauaucggcgaguccagcccuucucccaccgucgaagagucccggacaauucgcgugcucaaaaugguugagcccuggcugaagaacaaucaguucuguaucaaggugcugaacccuuauaugcccaccgucauugaacaucucgagagacuucagcggaaacacggcgggaugcuggugcgcaauccucugagcagaaacucuacgcaugaaauguacuggaucuccaauggaacaggcaacauuguugcuagcgugaauauggucucucggcuccugcuuaacagauuuaccaugacccaccgccggccgacaaucgagaaggacguggaucugggggccggaacgagacacgugaacgcugaacccgagaccccuaauauggacgucaucggcgagcgcauuaaacggaucaaggaagaacacaacagcacauggcacuaugacgaugaaaaucccuacaaaaccugggccuaucauggguccuacgagguuaaggcgacaggaucugccagcuccaugauuaacggcguggugaagcuccugaccaaaccuugggacgucgugcccaugguuacacaaauggcuaugaccgauacgaccccguucggccagcagagaguguuuaaggaaaaagucgacacacgcaccccucggagcaugcccgggacaagacgcgugaugggaaucaccgccgaguggcuguggcggacgcucggcagaaauaagaaaccucgccugugcacacgggaggaguucaccaagaagguuagaacaaacgcugccaugggggccguguuuaccgaggaaaaucaaugggauuccgcgaaagcugccgucgaggacgaagauuucuggaaacuuguggaccgcgagagagagcugcacaaacucggaaaguguggcucuugcguuuauaacaugauggggaaacgggaaaagaaacugggcgaguuuggaaaggccaagggcagccgcgcuauuugguacauguggcuuggggccagauaccuggaguucgaggcucucggauuucugaaugaggaucauugguucucccgggaaaacucuuauagcggcguggagggggaaggacugcacaaacucggcuacauccugagagacaucuccaagauucccgggggcgccauguaugcggaugacacggccggaugggacacccggaucacagaggaugaccuucacaaugaagagaaaauuacccagcagauggauccugagcaucgccagcuggcuaacgccaucuuuaagcucacauaccaaaauaaagucgugaagguccagagacccaccccgacaggcaccgugauggacauuaucucucggaaggaucagcgcgggagcggacagguuggcacguaugggcugaacacauucaccaauauggaagcucaacuuaucagacagauggagggagaaggcgugcuguccaaagccgaccucgagaacccucaucugcccgaaaagaaaauuacccaguggcuggagacaaagggggucgagcggcucaaacgcauggcgaucagcggcgaugacugcguggugaagcccauugaugacagauuugccaacgcucugcuugcccugaaugauaugggaaagguucggaaagacaucccucaguggcaaccgucuaagggcuggcaugauuggcaacaggugcccuucuguucccaccacuuccaugaacucauuaugaaagacgggcgcaagcuggucgugccuugcagaccccaggacgagcuuaucggacgggcucgcauuagccaaggcgccggguggucucugagagaaaccgcuugucucggaaaagccuacgcgcagauguggucccugauguauuuucaccggcgcgaucugagacucgccagcaacgcuaucugcucugccguuccugugcauuggguccccacaucccggacgaccuggagcauccacgcccaucaccaguggaugacaaccgaggacaugcugacaguguggaauagagucuggauugaagauaacccuuggauggaggacaagacccccgugacgaccugggaggauguuccguaccuuggcaagcgcgaagaccaauggugugggucccugaucggccucacaagccgggcuaccugggcccagaauauuccuacagcgauccaacaggugagaucucugauuggaaacgaggaguuccuugauuacaugcccagcaugaaacgcuuucggaaggaggaggaauccgagggcgcuaucugguga

SEQ ID NO: 20623 - RNA, 9873 nt, Artificial Sequence
  derived and/or modified CDS sequence (opt5) from DENV-3__KJ189274__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucagaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagcccggggggcuagacgcauggccauucuuggagacaccgcgugggauuucggcuccguggggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggccggagaacccuuacaccucagcccauggagcugaaauacucuuggaagaccugggggaaagccaagauugugacagcugaaacccagaacuccagcuucaucauugauggaccuaauacacccgagugcccgucugcgucccgcgccuggaacgucugggaaguggaggacuauggcuuuggcguguucaccacgaauaucuggcuccggcugagagaagucuacacacaacugugugaccaccgccuuaugagcgcugccguuaaggaugagcgggccgugcaugcugacaugggguacuggaucgagucccagaaaaacggaucuuggaagcucgaaaaagccagccugauugaggugaagaccugcaccuggccuaaaucccacacacuguggucuaauggcguccucgaaagcgauaugaucauucccaagucccuggcggggccuaucagccagcauaaccacagacccggauaucacacccagacggcuggcccuuggcaucuugggaagcuggagcucgacuuuaauuacugcgagggaacaaccgugguuauuacagaaaacuguggcacccgcggccccucucugcggacaaccacgguguccgggaaacugauccacgaguggugcuguagaagcugcacccuuccgccucuccgguauaugggagaagauggcuguugguacgggauggagauccgccccauuucugaaaaggaggagaauauggucaaaucccuggugagcgccggaucuggcaagguugacaacuucacaaugggggugcugugccucgccauccuguuugaagaggucaugagaggaaaauucggcaagaagcauaugauugcuggcguguucuuuaccuucguucuucugcucagcgggcaaaucacauggcgggauauggcccacacccugauuaugaucggauccaaugcgagcgacagaaugggcaugggggugacguaucuggcucuuauugccacauuuaaaauccagcccuuccuggcccucggauuuuuccugcgcaagcucaccucucgggaaaaccugcuucugggcgucgggcucgcuauggccacaacccugcagcugccugaggauaucgaacaaauggcuaauggaauugcccuuggccugauggcgcucaaacugaucacccaguuugagauuuaccagcucuggacagcccugaucucccuuacguguagcaacaccauuuucacacugaccguggcuuggagaacagccacccucauccuggcuggcgugucccugcuuccggucugccagucuagcuccaugcgcaagacggacuggcugcccauggccguugccgcuaugggggugccuccccucccucuguuuaucuucucucucaaagauacacugaagagacggagcuggccccuuaaugagggagugauggcggucggccugguguccauucuggccucuagccuccugcgcaacgacguuccuauggcugggccccuuguggccggaggccugcucaucgccuguuaugucauuaccgggaccuccgcugaucugacaguggaaaaggccgcggacaucaccugggaggaagaggcugaacaaacaggaguuagccauaaccucaugauuacgguggacgaugacggcaccaugagaaucaaagaugacgagacagagaauauccugaccguccuucugaagacagcccugcucauugugucuggcaucuuuccguacuccauuccugccacccugcuugucuggcacacguggcagaaacagacccagcggagcggggugcugugggauguucccucuccucccgaaacacaaaaggcugagcucgaagagggaguguaccgcaucaaacagcagggcauuuucgggaagacccaggucggagugggcguucaaaaagaggggguguuucacacaauguggcaugucaccagaggagccgugcugacauauaacggcaagcggcucgaaccgaauugggcguccgugaagaaagaccugaucagcuacggcgggggauggcgccuuucuacgcaguggcagaagggcgaggaaguucaagucauugcuguggagccugggaaaaaccccaagaauuuccagaccaugccuggaacauuccagaccaccacaggcgaaaucggggccaucgcccuggauuuuaaacccggaacguccggcagccccauuaucaacagagagggcaagguggucgggcuguauggaaauggcgugguuaccaagaacgggggauacguguccggcauugcucagacaaaugccgagccugacgggccgacccccgaacucgaggaagagauguucaaaaagcggaaccugacaaucauggaucuucacccuggcagcggaaaaacccgcaaguaucugcccgcuauugucagagaagccaucaaacggagacuccgcacgcugauccucgcgccuacacgggugguugccgcugagauggaggaagcccugaagggccuucccauuagauaccaaaccaccgcuacaaagucugagcauaccgggcgcgaaaucguggaccugaugugccacgccacauuuaccaugcggcugcucagcccugucagagugccgaauuauaaccugauuaucauggaugaggcccauuucacggaccccgcuuccauugcggcccgcggauacaucucuacacggguuggcaugggggaagcugccgccaucuuuaugaccgcuacaccucccggaaccgccgaugcguucccucagagcaaugcucccauucaggacgaggagagagacaucccggaacgcuccuggaacucuggcaaugaguggauuacggauuuugccgggaaaaccgugugguucgucccuagcaucaaggccggcaacgacauugcuaacugucuucggaaaaauggaaagaaagugauccagcuguccagaaagacauuugauaccgaauaccaaaagacaaaacucaacgacugggauuucguggucaccacagacauuucugagaugggcgccaauuuuaaggcggaucggguuaucgacccccgcagaugccugaaacccgugauccugaccgaugggccugagcgggugauucucgccggacccaugccugucacggcugccagcgcugcccagcgcagaggccggguggggagaaacccgcagaaggaaaaugaccaguauaucuucacaggacaaccccuuaacaaugaugaggaccacgcucacuggaccgaagccaaaaugcugcuggacaacauuaauaccccugagggcaucauucccgcgcucuucgaaccugagcgcgagaaguccgccgcuaucgauggggaauaccggcugaagggcgagagcagaaaaacauuuguugaacuuaugcgccggggagaccugcccguguggcucgcccauaaggucgcuucugagggcaucaaauauaccgauagaaaguggugcuucgacgggcagcgcaacaaucagauucuggaagagaacauggauguggagaucuggacaaaagaaggagagaagaaaaagcugcggccgagauggcucgacgcccgcacguacuccgauccucuugcccugaaggaauuuaaagacuucgcugcgggcagaaagagcauugcccuggaucucguuaccgagaucgggcgggugcccucucaccuggcucaucgcacaagaaaugcccuugacaaccuggucaugcuccacaccuccgaacacggaggccgggccuaucgccaugcuguggaggagcugccugaaacaauggagacccugcuccuucugggccugaugauucuccugacggggggagccaugcuuuuucugaucagcggcaaagggaucggaaagaccuccauuggccucaucugugucauugcgucuagcgggaugcuguggauggccgaaaucccccugcaguggauugcuuccgccaucgugcucgaguucuuuaugaugguucuucugauuccugagcccgaaaaacaaagaacaccgcaggauaaucagcuggcuuacguggugaucggaauccucacccuggccgcgauuaucgccgcuaacgagaugggccuucuggaaacaaccaagcgggaccucggcaugagcaaggagccuggggucguuucucccacguccuaucuggauguggaccugcaccccgccagcgcuuggacacucuacgccguggcuaccacagucauuaccccuaugcuuagacauaccaucgaaaauucuacagccaacgugagccuggcggccauugcuaaccaagccguugugcugaugggacucgacaaaggcuggccgaucuccaagauggaucugggggucccccuucuggcucucggaugcuacucucaggugaauccucugacgcugaccgccgccguccuccuucugaucacacacuaugcgauuaucggccccgggcugcaggcuaaagccacccgcgaggcucagaagcggacagccgccggaauuaugaaaaacccuaccguggacggcaucaugacgauugaucucgaccccguuaucuacgauagcaaguucgagaagcaacugggccaggugaugcuucugguccucugugcugugcagcugcugcucaugagaacauccugggcccuuugcgaagcgcugacccuggccaccgggccuaucacaacccucugggagggaucuccgggcaaauuuuggaauacaacgauugcuguuagcauggccaacaucuuccgcggguccuaucuggcuggagccggccuugcguuuagcauuaugaagucuguggggaccggaaaacggggcacaggcucccagggggaaacccugggagagaaguggaaaaagaagcucaaucaacugagcagaaaagaauucgaccuguacaagaaauccggcaucacagaggucgaucggaccgaggccaaggaagggcucaaacgcggagagauuacgcaucacgcugugucuagaggcagcgccaagcuucagugguuuguggaacggaacaugguuauccccgaggggcgcgucauugaccugggauguggcagaggcgggugguccuauuacugcgcuggacugaaaaaggugaccgaagugcggggcuauacaaaggggggaccuggccacgaggagcccgucccuaugucuaccuacggguggaauaucguuaaacucaugagcggaaaggauguguucuaccugcccccggaaaaaugugacacacuucugugcgauaucggcgaguccagcccuucucccaccguggaagagucccgcacaauuagaguccucaagaugguggagcccuggcugaaaaacaaucaguucuguaucaagguucugaacccuuauaugcccaccgugauugaacaucucgagcggcuucagcgcaagcacggcgggaugcuggucagaaauccucugagccggaacucuacgcaugaaauguacuggaucuccaauggaacaggcaacauuguggccagcguuaauauggugucuagacuccugcuuaaccgcuuuaccaugacccaccggagaccgacaaucgagaaagacgucgaucugggggcuggaacgcgccacgugaacgccgaacccgagaccccuaauauggacgugaucggcgagcggauuaagagaauccgcgaagagcauaacagcacauggcacuaugacgaugaaaaucccuacaaaaccugggcguaucauggguccuacgaggucaaggccacaggaucugcuagcuccaugauuaacggcguugugaaacuccugaccaagccuugggacgugguccccauggugacacaaauggccaugaccgauacgaccccguucggccagcagcggguuuuuaaggaaaaaguggacacaagaaccccucgcagcaugcccgggacacggagagucaugggaaucaccgcugaguggcuguggcgcacgcucggccggaauaagaaaccuagacugugcacacgcgaggaauucaccaagaaagugagaacaaacgccgccaugggggcgguuuuuaccgaggaaaaucaaugggauuccgcuaaggccgccguggaggacgaagauuucuggaagcuugucgaccgggagcgcgagcugcacaaacucggaaaguguggcucuugcguguauaacaugauggggaaaagagaaaagaaacugggcgaguuuggaaaggcuaaaggcagccgggccauuugguacauguggcuuggggcuagauaccuggaauucgaggcccucggauuucugaaugaggaucauugguucucccgggaaaacucuuauagcggcguugagggggaaggacugcacaagcucggcuacauccugcgcgacaucuccaagauucccgggggcgcgauguaugccgaugacacggcuggaugggacaccagaaucacagaggaugaccuucacaaugaagagaaaauuacccagcagauggauccugagcaucggcagcuggccaacgcuaucuuuaagcucacauaccaaaauaaaguggucaaggugcagcgccccaccccgacaggcaccgucauggacauuaucucuagaaaagaucagcgggggagcggacaggugggcacguaugggcugaacacauucaccaauauggaagcccaacuuauccgccagauggagggagaaggcguucuguccaaggcggaccucgagaacccucaccugcccgaaaagaaaauuacccaguggcuggagacaaaggggguggagagacucaaacggauggccaucagcggcgaugacugcgucgugaagcccauugaugaccgcuuugcuaacgcccugcuugcucugaaugauaugggaaaagugagaaaggacaucccucaguggcaaccgucuaagggcuggcaugauuggcagcagguucccuucuguucccaccacuuccaugaacucauuaugaaagacgggcggaagcugguggucccuugccgcccccaggacgagcuuaucggaagagcccggauuagccaaggcgcuggguggucucugcgcgaaaccgccugucucggaaaagcguacgcccagauguggucccugauguauuuucacagacgggaucugagacucgcuagcaacgccaucugcucugccgugccuguucauugggugcccacaucccgcacgaccuggagcauccacgcucaucaccaguggaugacaaccgaggacaugcugacagucuggaaucggguguggauugaagauaacccuuggauggaggacaagacccccgucacgaccugggaggaugugccguaccuuggcaaaagagaagaccaauggugugggucccugaucggccucacaagccgcgccaccugggcgcagaauauuccuacagcuauccagcagguucggucucugauuggaaacgaggaauuccuugauuacaugcccagcaugaagagauuucgcaaggaggaggaauccgagggcgccaucugguga

SEQ ID NO: 20624 - RNA, 9873 nt, Artificial Sequence
  derived and/or modified CDS sequence (opt5) from DENV-3__KJ189275__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucagaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagcccggggggcuagacgcauggccauucuuggagacaccgcgugggauuucggcuccguggggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggccggagaacccuuacaccucagcccauggagcugaaauacucuuggaagaccugggggaaagccaagauugugacagcugaaacccagaacuccagcuucaucauugauggaccuaauacacccgagugcccgucugcgucccgcgccuggaacgucugggaaguggaggacuauggcuuuggcguguucaccacgaauaucuggcuccggcugagagaagucuacacacaacugugugaccaccgccuuaugagcgcugccguuaaggaugagcgggccgugcaugcugacaugggguacuggaucgagucccagaaaaacggaucuuggaagcucgaaaaagccagccugauugaggugaagaccugcaccuggccuaaaucccacacacuguggucuaauggcguccucgaaagcgauaugaucauucccaagucccuggcggggccuaucagccagcauaaccacagacccggauaucacacccagacggcuggcccuuggcaucuugggaagcuggagcucgacuuuaauuacugcgagggaacaaccgugguuauuacagaaaacuguggcacccgcggccccucucugcggacaaccacgguguccgggaaacugauccacgaguggugcuguagaagcugcacccuuccgccucuccgguauaugggagaagauggcuguugguacgggauggagauccgccccauuucugaaaaggaggagaauauggucaaaucccuggugagcgccggaucuggcaagguugacaacuucacaaugggggugcugugccucgccauccuguuugaagaggucaugagaggaaaauucggcaagaagcauaugauugcuggcguguucuuuaccuucguucuucugcucagcgggcaaaucacauggcgggauauggcccacacccugauuaugaucggauccaaugcgagcgacagaaugggcaugggggugacguaucuggcucuuauugccacauuuaaaauccagcccuuccuggcccucggauuuuuccugcgcaagcucaccucucgggaaaaccugcuucugggcgucgggcucgcuauggccacaacccugcagcugccugaggauaucgaacaaauggcuaauggaauugcccuuggccugauggcgcucaaacugaucacccaguuugagacauaccagcucuggacggcccugauuucccuuaccuguagcaacacaaucuucacccugacaguggcuuggagaaccgccacgcucauucuggcuggcgugucccugcuuccggucugccagucuagcuccaugcgcaagacagacuggcugcccauggccguugccgcuaugggggugccuccccucccucuguuuaucuucucucucaaagauacccugaagagacggagcuggccccuuaaugagggagugauggcggucggccugguguccauccuggccucuagccuccugcgcaacgacguuccuauggcugggccccuuguggccggaggccugcucauugccuguuaugucaucaccgggacauccgcugaucugaccguggaaaaggccgcggacauuacaugggaggaagaggcugaacaaacgggaguuagccauaaccucaugaucaccguggacgaugacggcacaaugagaauuaaagaugacgagaccgagaauauccugacaguccuucugaagaccgcccugcucaucgugucuggcauuuuuccguacuccaucccugccacgcugcuugucuggcacaccuggcagaaacagacacagcggagcggggugcugugggauguucccucuccucccgaaacccaaaaggcugagcucgaagagggaguguaccgcauuaaacagcagggcaucuucgggaagacacaggucggagugggcguucaaaaagaggggguguuucacaccauguggcaugucacaagaggagccgugcugacguauaacggcaagcggcucgaaccgaauugggcguccgugaagaaagaccugauuagcuacggcgggggauggcgccuuucuacccaguggcagaagggcgaggaaguucaagucaucgcuguggagccugggaaaaaccccaagaauuuccagacaaugccuggaaccuuccagaccacaacgggcgaaauuggggccaucgcccuggauuuuaaacccggaaccuccggcagccccaucauuaacagagagggcaagguggucgggcuguauggaaauggcgugguuacaaagaacgggggauacguguccggcaucgcucagaccaaugccgagccugacgggccgacacccgaacucgaggaagagauguucaaaaagcggaaccugaccauuauggaucuucacccuggcagcggaaaaacgcgcaaguaucugcccgcuaucgucagagaagccauuaaacggagacuccgcacacugauccucgcgccuacccgggugguugccgcugagauggaggaagcccugaagggccuucccaucagauaccaaaccacagcuaccaagucugagcauacagggcgcgaaauuguggaccugaugugccacgccaccuuuacgaugcggcugcucagcccugucagagugccgaauuauaaccugaucauuauggaugaggcccauuucacagaccccgcuuccaucgcggcccgcggauacauuucuacccggguuggcaugggggaagcugccgccaucuuuaugacagcuaccccucccggaacggccgaugcguucccucagagcaaugcucccauccaggacgaggagagagacauuccggaacgcuccuggaacucuggcaaugaguggaucaccgauuuugccgggaaaacagugugguucgucccuagcauuaaggccggcaacgacaucgcuaacugucuucggaaaaauggaaagaaagugauucagcuguccagaaagaccuuugauacagaauaccaaaagaccaaacucaacgacugggauuucguggucacaaccgacaucucugagaugggcgccaauuuuaaggcggaucggguuauugacccccgcagaugccugaaacccgugauccugacggaugggccugagcgggugauccucgccggacccaugccugucacagcugccagcgcugcccagcgcagaggccggguggggagaaacccgcagaaggaaaaugaccaguauauuuucaccggacaaccccuuaacaaugaugaggaccacgcucacuggaccgaagccaaaaugcugcuggacaacaucaauacaccugagggcauuauccccgcgcucuucgaaccugagcgcgagaaguccgccgcuauugauggggaauaccggcugaagggcgagagcagaaaaaccuuuguugaacuuaugcgccggggagaccugcccguguggcucgcccauaaggucgcuucugagggcaucaaauauacagauagaaaguggugcuucgacgggcagcgcaacaaucagauccuggaagagaacauggauguggagauuuggacgaaagaaggagagaagaaaaagcugcggccgagauggcucgacgcccgcaccuacuccgauccucuugcccugaaggaauuuaaagacuucgcugcgggcagaaagagcaucgcccuggaucucguuacagagauugggcgggugcccucucaccuggcucaucgcaccagaaaugcccuugacaaccuggucaugcuccacacauccgaacacggaggccgggccuaucgccaugcuguggaggagcugccugaaaccauggagacgcugcuccuucugggccugaugauccuccugaccgggggagccaugcuuuuucugauuagcggcaaagggaucggaaagacauccaucggccucauuugugucaucgcgucuagcgggaugcuguggauggccgaaauuccccugcaguggaucgcuuccgccauugugcucgaguucuuuaugaugguucuucugaucccugagcccgaaaaacaaagaaccccgcaggauaaucagcuggcuuacguggugauuggaauccucacacuggccgcgaucauugccgcuaacgagaugggccuucuggaaaccacgaagcgggaccucggcaugagcaaggagccuggggucguuucucccacauccuaucuggauguggaccugcaccccgccagcgcuuggacccucuacgccguggcuacaaccgucaucaccccuaugcuuagacauacaauugaaaauucuacggccaacgugagccuggcggccaucgcuaaccaagccguugugcugaugggacucgacaaaggcuggccgauuuccaagauggaucugggggucccccuucuggcucucggaugcuacucucaggugaauccucugacccugacagccgccguccuccuucugaucacccacuaugcgaucauuggccccgggcugcaggcuaaagccacacgcgaggcucagaagcggaccgccgccggaaucaugaaaaacccuacgguggacggcauuaugacaaucgaucucgaccccguuauuuacgauagcaaguucgagaagcaacugggccaggugaugcuucugguccucugugcugugcagcugcugcucaugagaaccuccugggcccuuugcgaagcgcugacccuggccacagggccuaucaccacacucugggagggaucuccgggcaaauuuuggaauacgaccaucgcuguuagcauggccaacauuuuccgcggguccuaucuggcuggagccggccuugcguuuagcaucaugaagucuguggggacaggaaaacggggcaccggcucccagggggaaacacugggagagaaguggaaaaagaagcucaaucaacugagcagaaaagaauucgaccuguacaagaaauccggcauuaccgaggucgaucggacggaggccaaggaagggcucaaacgcggagagaucacccaucacgcugugucuagaggcagcgccaagcuucagugguuuguggaacggaacaugguuauucccgaggggcgcgucaucgaccugggauguggcagaggcgggugguccuauuacugcgcuggacugaaaaaggugacagaagugcggggcuauaccaaggggggaccuggccacgaggagcccgucccuaugucuacauacggguggaauauuguuaaacucaugagcggaaaggauguguucuaccugcccccggaaaaaugugacacccuucugugcgauaucggcgaguccagcccuucucccacaguggaagagucccgcaccaucagaguccucaagaugguggagcccuggcugaaaaacaaucaguucuguauuaagguucugaacccuuauaugcccacggugaucgaacaucucgagcggcuucagcgcaagcacggcgggaugcuggucagaaauccucugagccggaacucuacacaugaaauguacuggauuuccaauggaaccggcaacaucguggccagcguuaauauggugucuagacuccugcuuaaccgcuuuaccaugacacaccggagaccgacgauugagaaagacgucgaucugggggcuggaacccgccacgugaacgccgaacccgagacaccuaauauggacgugaucggcgagcggaucaagagaauucgcgaagagcauaacagcaccuggcacuaugacgaugaaaaucccuacaaaacaugggcguaucauggguccuacgaggucaaggccaccggaucugcuagcuccaugaucaacggcguugugaaacuccugacaaagccuugggacgugguccccauggugacccaaauggccaugacggauaccacaccguucggccagcagcggguuuuuaaggaaaaaguggacaccagaacaccucgcagcaugcccgggacccggagagucaugggaauuacggcugaguggcuguggcgcacacucggccggaauaagaaaccuagacugugcacccgcgaggaauucacaaagaaagugagaaccaacgccgccaugggggcgguuuuuacggaggaaaaucaaugggauuccgcuaaggccgccguggaggacgaagauuucuggaagcuugucgaccgggagcgcgagcugcacaaacucggaaaguguggcucuugcguguauaacaugauggggaaaagagaaaagaaacugggcgaguuuggaaaggcuaaaggcagccgggccaucugguacauguggcuuggggcuagauaccuggaauucgaggcccucggauuucugaaugaggaucauugguucucccgggaaaacucuuauagcggcguugagggggaaggacugcacaagcucggcuacauucugcgcgacaucuccaagauccccgggggcgcgauguaugccgaugacaccgcuggaugggacacaagaauuaccgaggaugaccuucacaaugaagagaaaaucacacagcagauggauccugagcaucggcagcuggccaacgcuauuuuuaagcucaccuaccaaaauaaaguggucaaggugcagcgccccacaccgaccggcacggucauggacaucauuucuagaaaagaucagcgggggagcggacaggugggcacauaugggcugaacaccuucaccaauauggaagcccaacuuauccgccagauggagggagaaggcguucuguccaaggcggaccucgagaacccucaccugcccgaaaagaaaaucacacaguggcuggagaccaaggggguggagagacucaaacggauggccauuagcggcgaugacugcgucgugaagcccaucgaugaccgcuuugcuaacgcccugcuugcucugaaugauaugggaaaagugagaaaggacauuccucaguggcaaccgucuaagggcuggcaugauuggcagcagguucccuucuguucccaccacuuccaugaacucaucaugaaagacgggcggaagcugguggucccuugccgcccccaggacgagcuuauuggaagagcccggaucagccaaggcgcuggguggucucugcgcgaaacagccugucucggaaaagcguacgcccagauguggucccugauguauuuucacagacgggaucugagacucgcuagcaacgccauuugcucugccgugccuguucauugggugcccacgucccgcaccacauggagcauccacgcucaucaccaguggaugaccacagaggacaugcugaccgucuggaaucggguguggaucgaagauaacccuuggauggaggacaagacgcccgucaccacaugggaggaugugccguaccuuggcaaaagagaagaccaauggugugggucccugauuggccucaccagccgcgccacaugggcgcagaauaucccuaccgcuauucagcagguucggucucugaucggaaacgaggaauuccuugauuacaugcccagcaugaagagauuucgcaaggaggaggaauccgagggcgccauuugguga

SEQ ID NO: 20625 - RNA, 9873 nt, Artificial Sequence
  derived and/or modified CDS sequence (opt5) from DENV-3__KJ189276__SS-prME
accagccugugccucaugaugauccugcccgcggcucuugccuuccaccugacgucccgggacggcgagccucggaugauuguggggaagaacgaacgcggaaaaucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcuccagugcuccccucgcaccggacuggacuucaaugagaugauccuucugacaaugaaaaacaaggccuggaugguccauagacaaugguuuuucgaucucccccugccguggaccagcggcgccacaucugagaccccuacguggaaucggaaagaacuucuggugacauuuaagaacgcucacgcgaaaaagcaggaggucgugguucucgggucccaggaaggagccaugcacaccgcucugacaggcgccaccgagauucagaauagcgggggcaccucuaucuucgccggacaucugaagugucgccucaaaauggacaagcuggaacuuaaaggcauguccuacgcuaugugcacaaacacguuugugcugaagaaagaggucagcgagacccaacacgggacaauucucaucaagguggaauacaagggagaggaugcccccuguaaaaucccuuucuccaccgaagacggccaugggaaggcgcacaacggaagacugauuacagcuaaucccguugugaccaaaaaggaggagcccgucaacaucgaagccgagccuccguucggcgaaucuaauauugugaucgggauuggcgauaacgcccugaaaaucaauugguauaagaagggaagcuccaucggcaaaauguuugaggcuacggccagaggggcuagacgcauggccauucuuggagacacagcgugggauuucggcagcgucgggggaguucucaacucucugggcaagaugguccaucagaucuuuggguccgccuacaccgcucuguucagcggcgugucuugggugaugaaaauuggaaucggcguccuccugaccuggauugggcuuaauagcaagaacacauccaugucuuuuagcugcaucgccauuggaaucaucacccuguaucucggcgcugugguucaggccgacauggggugugugauuaauuggaaaggaaaggaacugaagugcggcuccgggaucuucgucacaaacgaggugcacacguggaccgagcaguacaaauuucaagcggauagccccaagcggcuggccacagcuauugccggcgcuugggaaaauggaguuuguggcaucagaucuaccacacgcauggagaaccuucucuggaaacagauugccaaugaacugaacuauauccugugggagaauaacaucaagcucaccguggucgugggggacauuaucggaguucuggaacagggcaaacggacgcuuaccccucagcccauggagcugaaguacuccuggaaaacaugggggaaggccaagauugugaccgcugagacacaaaacagcucuuucaucauugauggaccuaauacccccgaaugcccguccgcgagcagagccuggaacgucugggagguggaagacuauggcuuuggcguguucacaaccaauaucuggcuccgccugcgggaggucuacacgcagcugugugaccacagacuuauguccgcugccguuaaagaugaacgcgccgugcaugcugacaugggguacuggaucgagucucagaagaacggaagcuggaaacucgagaaggccucccugauugaagugaaaacaugcaccuggccuaagucucacacccuguggagcaauggcguccucgaguccgauaugaucauucccaagagccuggcggggccuaucucucagcauaaccaccggcccggauaucacacacaaaccgcuggcccuuggcaucuugggaaacuggaacucgacuuuaauuacugcgagggaacgacagugguuauuaccgagaacuguggcacaagaggccccucccugcgcaccacaaccgugagcgggaagcugauccacgaauggugcugucggucuugcacgcuuccgccucucagauauaugggagaggauggcuguugguacgggauggaaauccggcccauuuccgagaaagaagagaauauggucaagagccuggugucugccggaagcggcaaaguugacaacuucaccaugggggugcugugccucgccauccuguuugaggaagucaugcgcggaaaguucggcaagaaacauaugauugcuggcguguucuuuacauucguucuucugcucuccgggcagaucaccuggagagauauggcccacacacugauuaugaucggaagcaaugcgucugaccggaugggcaugggggugaccuaucuggcucuuauugccacguuuaagauccagcccuuccuggcccucggauuuuuccugagaaaacucacaucccgcgagaaccugcuucugggcgucgggcucgcuauggccaccacacugcaacugccugaagauaucgagcagauggcuaauggaauugcccuuggccugauggcgcucaagcugaucacccaguuugaaaccuaccagcucuggacagcccugauuagccuuacguguuccaacaccaucuucacacugaccguggcuuggcggacagccacccucauucuggcuggcgugucucugcuuccggucugccaaagcuccucuaugagaaaaacggacuggcugcccauggccguugccgcuaugggggugccuccccucccucuguuuaucuucagccucaaggauacacugaagcgcagauccuggccccuuaaugagggagugauggcggucggccuggugucuauccuggccagcucccuccugcggaacgacguuccuauggcugggccccuuguggccggaggccugcucauugccuguuaugucaucaccgggaccagcgcugaucugacaguggagaaagccgcggacauuaccugggaagaggaagcugagcagacaggaguuucucauaaccucaugaucacgguggacgaugacggcaccaugcgcauuaaggaugacgaaacagagaauauccugaccguccuucugaaaacagcccugcucaucguguccggcauuuuuccguacagcaucccugccacccugcuugucuggcacacguggcagaagcagacccaaagaucuggggugcugugggauguucccuccccucccgagacacagaaagcugaacucgaggaaggaguguaccggauuaagcagcagggcaucuucgggaaaacccaagucggagugggcguucagaaggaggggguguuucacacaauguggcaugucacccgcggagccgugcugacauauaacggcaagagacucgagccgaauugggcgagcgugaaaaaggaccugauuucuuacggcgggggauggcggcuuuccacgcaguggcaaaaaggcgaagagguucaggucaucgcuguggaaccugggaagaaccccaaaaauuuccagaccaugccuggaacauuccagaccaccacaggcgagauuggggccaucgcccuggauuuuaagcccggaacgagcggcucccccaucauuaaccgcgaaggcaagguggucgggcuguauggaaauggcgugguuaccaaaaacgggggauacgugagcggcaucgcucaaacaaaugccgagccugacgggccgacccccgagcucgaagaggaaauguucaagaaaagaaaccugacaauuauggaucuucacccuggcucuggaaagacccggaaauaucugcccgcuaucguccgcgaggccauuaagagacggcucagaacgcugauccucgcgccuacacgcgugguugccgcugaaauggaggaggcccugaagggccuucccauccgguaccagaccaccgcuacaaaaagcgaacauaccgggagagagauuguggaccugaugugccacgccacauuuaccaugcgccugcucuccccuguccgggugccgaauuauaaccugaucauuauggaugaagcccauuucacggaccccgcuucuaucgcggccagaggauacauuagcacacgcguuggcaugggggaggcugccgccaucuuuaugaccgcuacaccucccggaaccgccgaugcguucccucaguccaaugcucccauccaggacgaagaacgggacauuccggagagaucuuggaacagcggcaaugaauggaucacggauuuugccgggaagaccgugugguucgucccuuccauuaaagccggcaacgacaucgcuaacugucuucgcaagaauggcaaaaaggugauucaacugucucggaagacauuugauaccgaguaccagaaaacaaagcucaacgacugggauuucguggucaccacagacaucagcgaaaugggagccaauuuuaaagcggauagaguuauugacccccggcgcugccugaagcccgugauccugaccgaugggccugagagagugauccucgccggacccaugccugucacggcugccuccgcugcccagcggcgcggcagaguggggcggaacccgcagaaagagaaugaccaauauauuuucacaggacagccccuuaacaaugaugaagaccacgcucacuggaccgaggccaagaugcugcuggacaacaucaauaccccugaaggcauuauccccgcccucuucgagccugaaagagaaaagagcgccgcuauugauggggaguaccgccugaaaggcgaaucucggaagacauuuguugagcuuaugagacgcggagaccugcccguguggcucgcccauaaagucgcuuccgaaggcaucaaguauaccgaucggaaauggugcuucgacgggcagagaaacaaucagauccuggaggaaaacauggauguggagauuuggacaaaggagggagagaagaagaagcugcgcccgcgguggcucgacgccagaacguacagcgauccucuugcccugaaagaguuuaaggacuucgcugcgggccgcaaaucuaucgcccuggaucucguuaccgaaauugggagagugcccucccaccuggcucaucggacacgcaaugcccuugacaaccuggucaugcuccacaccagcgagcacggaggcagagccuaucggcaugcuguggaagaacugccugagacaauggaaacccugcuccuucugggccugaugauccuccugacagggggagccaugcuuuuucugauuuccggcaaggggaucggaaaaaccucuaucggccucauuugugucaucgcgagcuccgggaugcuguggauggccgagauuccccugcaauggaucgcuagcgccauugugcucgaguucuuuaugaugguucuucugaucccugagcccgagaagcagcgcacaccgcaggauaaucaacuggcuuacguggugauuggaauccucacccuggccgcgaucauugccgcuaacgaaaugggccuucuggagacaaccaagagagaccucggcaugucuaaagaaccuggggucguuucccccacgagcuaucuggauguggaccugcaccccgccucugcuuggacacucuacgccguggcuaccacagucaucaccccuaugcuucggcauaccauugagaauagcacagccaacgugucccuggcggccaucgcuaaccaggccguugugcugaugggacucgacaagggcuggccgauuucuaaaauggaucugggggucccccuucuggcucucggaugcuacagccaggugaauccucugacgcugaccgccgccguccuccuucugaucacacacuaugcgaucauuggccccgggcugcaggcuaaggccaccagagaagcucaaaaacgcacagccgccggaaucaugaagaacccuaccguggacggcauuaugacgaucgaucucgaccccguuauuuacgauuccaaguucgagaaacagcugggccaggugaugcuucugguccucugugcugugcagcugcugcucaugcggacaucuugggcccuuugcgaggcgcugacccuggccaccgggccuaucacaacccucugggaaggaagcccgggcaaguuuuggaauacaacgaucgcuguuuccauggccaacauuuucagagggagcuaucuggcuggagccggccuugcguuuucuaucaugaaauccguggggaccggaaagcgcggcacaggcagccaaggggagacccugggagaaaaauggaagaagaaacucaaucagcugucccggaaggaguucgaccuguacaaaaagucuggcauuacagaagucgauagaaccgaggccaaagaggggcucaagcggggagaaaucacgcaucacgcugugagccgcggcuccgccaaacuucagugguuuguggagagaaacaugguuauucccgaagggcgggucaucgaccugggauguggccgcggcggguggucuuauuacugcgcuggacugaagaaggugaccgaggugagaggcuauacaaaagggggaccuggccacgaggaacccgucccuaugagcaccuacggguggaauauuguuaagcucauguccggaaaagauguguucuaccugcccccggagaagugugacacacuucugugcgauaucggcgaaagcucuccuucccccaccguggaggaaagccggacaauccgcguccucaaaaugguggagcccuggcugaagaacaaucaguucuguauuaagguucugaacccuuauaugcccaccgugaucgagcaucucgaaagacuucaacggaaacacggcgggaugcugguccgcaauccucugucuagaaacuccacgcaugagauguacuggauuagcaauggaacaggcaacaucguggccucuguuaauauggugagccggcuccugcuuaacagauuuaccaugacccaccgccggccgacaauugaaaaggacgucgaucugggggcuggaacgagacacgugaacgccgagcccgaaaccccuaauauggacgugaucggcgagcgcaucaaacggauuaaggaggaacauaacuccacauggcacuaugacgaugagaaucccuacaaaaccugggcguaucaugggucuuacgaagucaaggccacaggaagcgcuuccagcaugaucaacggcguugugaagcuccugaccaaaccuugggacgugguccccauggugacacagauggccaugaccgauacgaccccguucggccagcaaagaguuuuuaaggagaaaguggacacacgcaccccucgguccaugcccgggacaagacgcgucaugggaauuaccgcugaauggcuguggcggacgcucggcagaaauaagaaaccucgccugugcacacgggaggaguucaccaagaaggugagaacaaacgccgccaugggggcgguuuuuaccgaagagaaucaguggaacucugcuaaagccgccguggaagaugaggacuucuggaaacuugucgaucgcgaaagagagcugcacaaacucggaaaguguggcagcugcguguauaauaugauggggaaacgggagaagaaacugggcgaauuuggaaaggcuaagggcucccgcgccaucugguacauguggcuuggggcuagauaccuggaguucgaagcccucggauuucugaacgaggaccauugguucucucgggagaauagcuauuccggcguugaaggggagggacugcacaaacucggcuacauucugagagauaucucuaagauccccgggggcgcgauguaugccgacgauacggcuggaugggacacccggauuacagaagacgaucuucacaacgaggagaaaaucacccagcagauggacccugagcaucgcagacuggccaaugcuauuuuuaagcucacauaccaaaacaaaguggucaaggugcagcggcccaccccgacaggcaccgucauggauaucauuagccgcaaggaccagagaggguccggacaggugggcacguaugggcugaauacauucaccaacauggaggcccaacuuauccggcagauggaaggagagggcguucugagcaaagcggaucucgaaaacccucaucugcccgagaagaaaaucacccaguggcuggaaacaaaggggguggagcgccucaaaagaauggccauuucuggcgacgauugcgucgugaagcccaucgacgaucgguuugcuaaugcccugcuugcucugaacgacaugggaaaggugcgcaaagauauuccucaguggcaaccguccaagggcuggcaugacuggcagcagguucccuucuguagccaccacuuccaugagcucaucaugaaagaugggagaaagcugguggucccuugccggccccaggacgaacuuauuggacgcgccagaaucucucaaggcgcuggguggucccugcgggagaccgccugucucggaaaagcguacgcccagauguggagccugauguauuuucaccgcagagaccugcggcucgcuucuaaugccauuugcuccgccgugccuguucauugggugcccacaagcagaacgaccugguccauccacgcucaucaccaguggaugacaaccgaagauaugcugacagucuggaaccgcguguggaucgaggacaauccuuggauggaagauaagacccccgucacgaccugggaggacgugccguaccuuggcaagcgggaggaucaauggugugggagccugauuggccucacaucuagagccaccugggcgcagaacaucccuacagcuauucagcagguucgcagccugaucggaaaugaagaguuccuugacuacaugcccuccaugaaacgguuuagaaaggaagaggagucugaaggcgccauuugguga

SEQ ID NO: 20626 - RNA, 9873 nt, Artificial Sequence
  derived and/or modified CDS sequence (opt5) from DENV-3__KJ189277__SS-prME
accagccugugccucaugaugauccugcccgccgcucuugccuuccaccugacgucccgggacggcgagccucggaugauuguggggaagaacgaacgcggaaaaucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucauguggggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcuccagugcuccccucgcaccggacuggacuucaaugagaugauccuucugacaaugaaaaacaaggccuggaugguccauagacaaugguuuuucgaucucccccugccguggaccagcggcgccacaucugagaccccuacguggaaucggaaagaacuucuggugacauuuaagaacgcucacgcgaaaaagcaggaggucgugguucucgggucccaggaaggagccaugcacaccgcucugacaggcgccaccgagauucagaauagcgggggcaccucuaucuucgccggacaucugaagugucgccucaaaauggacaagcuggaacuuaaaggcauguccuacgcuaugugcacaaacacguuugugcugaagaaagaggucagcgagacccaacacgggacaauucucaucaagguggaauacaagggagaggaugcccccuguaaaaucccuuucuccaccgaagacggccaugggaaggcgcacaacggaagacugauuacagcuaaucccguugugaccaaaaaggaggagcccgucaacaucgaagccgagccuccguucggcgaaucuaauauugugaucgggauuggcgauaacgcccugaaaaucaauugguauaagaagggaagcuccaucggcaaaauguuugaggcuacggccagaggggcuagacgcauggccauucuuggagacacagcgugggauuucggcagcgucgggggaguucucaacucucugggcaagaugguccaucagaucuuuggguccgccuacaccgcucuguucagcggcgugucuugggugaugaaaauuggaaucggcguccuccugaccuggauugggcuuaauagcaagaacacauccaugucuuuuagcugcaucgccauuggaaucaucacccuguaucucggcgcugugguucaggccgacauggggugugugauuaauuggaaaggaaaggaacugaagugcggcuccgggaucuucgucacaaacgaggugcacacguggaccgagcaguacaaauuucaagcggauagccccaagcggcuggccacagcuauugccggcgcuugggaaaauggaguuuguggcaucagaucuaccacacgcauggagaaccuucucuggaaacagauugccaaugaacugaacuauauccugugggagaauaacaucaagcucaccguggucgugggggacauuaucggaguucuggaacagggcaaacggacgcuuaccccucagcccauggagcugaaguacuccuggaaaacaugggggaaggccaagauugugaccgcugagacacaaaacagcucuuucaucauugauggaccuaauacccccgaaugcccguccgcgagcagagccuggaacgucugggagguggaagacuauggcuuuggcguguucacaaccaauaucuggcuccgccugcgggaggcuuacacgcagcugugugaccacagacuuauguccgccgccgucaaagaugaacgcgcuguucaugccgacaugggguacuggaucgagucucagaagaacggaagcuggaaacucgagaaggcgucccugauugaagugaaaacaugcaccuggccuaagucucacacccuguggagcaauggcgugcucgaguccgauaugaucauucccaagagccuggcugggccuaucucucagcauaaccaccggcccggauaucacacacaaaccgccggcccuuggcaucuugggaaacuggaacucgacuuuaauuacugcgagggaacgacagucgugauuaccgagaacuguggcacaagaggccccucccugcgcaccacaaccguuagcgggaagcugauccacgaauggugcugucggucuugcacgcuuccgccucucagauauaugggagaggauggcuguugguacgggauggaaauccggcccauuuccgagaaagaagagaauauggucaagagccuggucucugccggaagcggcaaaguggacaacuucaccauggggguucugugccucgcuauccuguuugaggaagugaugcgcggaaaguucggcaagaaacauaugauugccggcgucuucuuuacauucgugcuucugcucuccgggcagaucaccuggagagauauggcgcacacacugauuaugaucggaagcaaugcuucugaccggaugggcauggggguuaccuaucuggcccuuauugccacguuuaagauccagcccuuccuggcucucggauuuuuccugagaaaacucacaucccgcgagaaccugcuucugggcguggggcucgccauggcuaccacacugcaacugccugaagauaucgagcagauggccaauggaauugcgcuuggccugauggcccucaagcugaucacccaguuugaaaccuaccagcucuggacagcucugauuagccuuacguguuccaacaccaucuucacacugaccgucgccuggcggacagcuacccucauucuggccggcgugucucugcuuccggugugccaaagcuccucuaugagaaaaacggacuggcugcccauggccgucgcugcgauggggguuccuccccucccucuguuuaucuucagccucaaggauacacugaagcgcagauccuggccccuuaaugagggagugauggccgugggccuggucucuauccuggcuagcucccuccugcggaacgacgugccuauggccgggccccuuguugccggaggccugcucauugcuuguuaugugaucaccgggaccagcgccgaucugacagucgagaaagcggcugacauuaccugggaagaggaagccgagcagacaggagugucucauaaccucaugaucacgguugacgaugacggcaccaugcgcauuaaggaugacgaaacagagaauauccugaccgugcuucugaaaacagcccugcucaucgucuccggcauuuuuccguacagcaucccugcuacccugcuuguguggcacacguggcagaagcagacccaaagaucugggguccugugggaugugcccuccccucccgagacacagaaagccgaacucgaggaaggaguuuaccggauuaagcagcagggcaucuucgggaaaacccaagugggagucggcgugcagaaggaggggguuuuucacacaauguggcaugugacccgcggagcgguccugacauauaacggcaagagacucgagccgaauugggcuagcgugaaaaaggaccugauuucuuacggcgggggauggcggcuuuccacgcaguggcaaaaaggcgaagaggugcagguuaucgccgucgaaccugggaagaaccccaaaaauuuccagaccaugccuggaacauuccagaccaccacaggcgagauuggggccaucgcucuggauuuuaagcccggaacgagcggcucccccaucauuaaccgcgaaggcaaggugguggggcuguauggaaauggcgucgugaccaaaaacgggggauacguuagcggcaucgcccaaacaaaugcugagccugacgggccgacccccgagcucgaagaggaaauguucaagaaaagaaaccugacaauuauggaucuucacccuggcucuggaaagacccggaaauaucugcccgccaucgugcgcgaggcgauuaagagacggcucagaacgcugauccucgccccuacacgcgucguggcugccgaaauggaggaggcucugaagggccuucccauccgguaccagaccaccgccacaaaaagcgaacauaccgggagagagauuguugaccugaugugccacgccacauuuaccaugcgccugcucuccccugugcgggucccgaauuauaaccugaucauuauggaugaagcucauuucacggaccccgcgucuaucgccgcuagaggauacauuagcacacgcgugggcaugggggaggccgccgcuaucuuuaugaccgccacaccucccggaaccgcggaugcuuucccucaguccaaugcccccauccaggacgaagaacgggacauuccggagagaucuuggaacagcggcaaugaauggaucacggauuuugccgggaagaccguuugguucgugccuuccauuaaagcuggcaacgacaucgccaacugucuucgcaagaauggcaaaaaggucauucaacugucucggaagacauuugauaccgaguaccagaaaacaaagcucaacgacugggauuucguggugaccacagacaucagcgaaaugggagcgaauuuuaaagccgauagagucauugacccccggcgcugccugaagcccguuauccugaccgaugggccugagagagugauccucgcuggacccaugccugugacggccgcuuccgccgcucagcggcgcggcagagucgggcggaacccgcagaaagagaaugaccaauauauuuucacaggacagccccuuaacaaugaugaagaccacgcccacuggaccgaggcgaagaugcugcuggacaacaucaauaccccugaaggcauuauccccgcccucuucgagccugaaagagaaaagagcgcugccauugauggggaguaccgccugaaaggcgaaucucggaagacauuuguggagcuuaugagacgcggagaccugcccguuuggcucgcucauaaaguggccuccgaaggcaucaaguauaccgaucggaaauggugcuucgacgggcagagaaacaaucagauccuggaggaaaacauggaugucgagauuuggacaaaggagggagagaagaagaagcugcgcccgcgguggcucgacgccagaacguacagcgauccucuugcucugaaagaguuuaaggacuucgcggccggccgcaaaucuaucgcucuggaucucgugaccgaaauugggagaguucccucccaccuggcccaucggacacgcaaugcccuugacaaccuggugaugcuccacaccagcgagcacggaggcagagcuuaucggcaugccgucgaagaacugccugagacaauggaaacccugcuccuucugggccugaugauccuccugacagggggagcgaugcuuuuucugauuuccggcaaggggaucggaaaaaccucuaucggccucauuugugugaucgccagcuccgggaugcuguggauggcugagauuccccugcaauggaucgccagcgcuauuguccucgaguucuuuaugauggugcuucugaucccugagcccgagaagcagcgcacaccgcaggauaaucaacuggccuacguugugauuggaauccucacccuggcggccaucauugcugccaacgaaaugggccuucuggagacaaccaagagagaccucggcaugucuaaagaaccugggguggucucccccacgagcuaucuggauguugaccugcaccccgcuucugccuggacacucuacgcuguggccaccacagugaucaccccuaugcuucggcauaccauugagaauagcacagcgaacgucucccuggccgcuaucgccaaccaggcugugguucugaugggacucgacaagggcuggccgauuucuaaaauggaucugggggugccccuucuggcccucggaugcuacagccaggucaauccucugacgcugaccgccgcggugcuccuucugaucacacacuaugcuaucauuggccccgggcugcaggccaaggcuaccagagaagcccaaaaacgcacagccgcuggaaucaugaagaacccuaccgucgacggcauuaugacgaucgaucucgaccccgugauuuacgauuccaaguucgagaaacagcugggccagguuaugcuucuggugcucugugccguccagcugcugcucaugcggacaucuugggcgcuuugcgaggcccugacccuggcuaccgggccuaucacaacccucugggaaggaagcccgggcaaguuuuggaauacaacgaucgccguguccauggcuaacauuuucagagggagcuaucuggccggagcgggccuugccuuuucuaucaugaaauccguugggaccggaaagcgcggcacaggcagccaaggggagacccugggagaaaaauggaagaagaaacucaaucagcugucccggaaggaguucgaccuguacaaaaagucuggcauuacagaaguggauagaaccgaggcuaaagaggggcucaagcggggagaaaucacgcaucacgccgucagccgcggcuccgcuaaacuucagugguuuguggagagaaacauggugauucccgaagggcggguuaucgaccugggauguggccgcggcggguggucuuauuacugcgccggacugaagaaggucaccgaggugagaggcuauacaaaagggggaccuggccacgaggaacccgugccuaugagcaccuacggguggaauauugucaagcucauguccggaaaagauguuuucuaccugcccccggagaagugugacacacuucugugcgauaucggcgaaagcucuccuucccccaccguggaggaaagccggacaauccgcgugcucaaaauggucgagcccuggcugaagaacaaucaguucuguauuaaggugcugaacccuuauaugcccaccguuaucgagcaucucgaaagacuucaacggaaacacggcgggaugcuggugcgcaauccucugucuagaaacuccacgcaugagauguacuggauuagcaauggaacaggcaacaucgucgcuucugugaauaugguuagccggcuccugcuuaacagauuuaccaugacccaccgccggccgacaauugaaaaggacguggaucugggggccggaacgagacacgucaacgcggagcccgaaaccccuaauauggacgugaucggcgagcgcaucaaacggauuaaggaggaacauaacuccacauggcacuaugacgaugagaaucccuacaaaaccugggccuaucaugggucuuacgaagugaaggcuacaggaagcgccuccagcaugaucaacggcgucguuaagcuccugaccaaaccuugggacguggugcccauggucacacagauggcuaugaccgauacgaccccguucggccagcaaagaguguuuaaggagaaaguugacacacgcaccccucgguccaugcccgggacaagacgcgugaugggaauuaccgccgaauggcuguggcggacgcucggcagaaauaagaaaccucgccugugcacacgggaggaguucaccaagaaggucagaacaaacgccgcgaugggggcuguguuuaccgaagagaaucaguggaacucugccaaagccgcuguugaagaugaggacuucuggaaacuuguggaucgcgaaagagagcugcacaaacucggaaaguguggcagcugcgucuauaauaugauggggaaacgggagaagaaacugggcgaauuuggaaaggccaagggcucccgcgcuaucugguacauguggcuuggggccagauaccuggaguucgaagcgcucggauuucugaacgaggaccauugguucucucgggagaauagcuauuccggcguggaaggggagggacugcacaaacucggcuacauucugagagauaucucuaagauccccgggggcgccauguaugcugacgauacggccggaugggacacccggauuacagaagacgaucuucacaacgaggagaaaaucacccagcagauggacccugagcaucgcagacuggcuaaugccauuuuuaagcucacauaccaaaacaaaguugugaagguccagcggcccaccccgacaggcaccgugauggauaucauuagccgcaaggaccagagaggguccggacaggucggcacguaugggcugaauacauucaccaacauggaggcgcaacuuauccggcagauggaaggagagggcgugcugagcaaagccgaucucgaaaacccucaucugcccgagaagaaaaucacccaguggcuggaaacaaaggggguugagcgccucaaaagaauggcuauuucuggcgacgauugcguggucaagcccaucgacgaucgguuugccaaugcucugcuugcccugaacgacaugggaaaggugcgcaaagauauuccucaguggcaaccguccaagggcuggcaugacuggcaacaggugcccuucuguagccaccacuuccaugagcucaucaugaaagaugggagaaagcugguugugccuugccggccccaggacgaacuuauuggacgcgcuagaaucucucaaggcgccggguggucccugcgggagaccgcgugucucggaaaagccuacgcucagauguggagccugauguauuuucaccgcagagaccugcggcucgccucuaaugccauuugcuccgcugucccugugcauuggguucccacaagcagaacgaccugguccauccacgcccaucaccaguggaugacaaccgaagauaugcugacaguguggaaccgcgucuggaucgaggacaauccuuggauggaagauaagacccccgugacgaccugggaggacgucccguaccuuggcaagcgggaggaucaauggugugggagccugauuggccucacaucuagagcgaccugggcucagaacaucccuacagccauucaacaggugcgcagccugaucggaaaugaagaguuccuugacuacaugcccuccaugaaacgguuuagaaaggaagaggagucugaaggcgccauuugguga

SEQ ID NO: 20627 - RNA, 9873 nt, Artificial Sequence
  derived and/or modified CDS sequence (opt5) from DENV-3__KJ189278__SS-prME
acaagccugugccucaugaugauccugcccgcggcucuugccuuccaccugacaucccgggacggcgaaccucggaugauuguggggaagaacgaacgcggaaaaucucuccuguuuaagacggcgagcggcaccaauauguguacacuuaucgcuauggaucugggggaaaugugcgacgauaccgugacauacaaauguccgcauauuaccgaaguugaacccgaagacaucgauugcugguguaaccucacauccaccugggugacguauggaaccugcaaucaggccggcgagcacagacgggacaagcgcucuguggcccuggcuccucaugucgggaugggacuggauacaagaacccagacauggaugagcgccgagggcgcuuggcggcaaguggaaaaaguugagaccugggcccuccgccaccccggcuucacgauucuggcgcuuuuucuggcccauuacaucgggacaucccucacccagaagguggucaucuucauucugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccagcuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucagugucuggagcccaucgagggcaaaguugugcaguaugaaaaucucaaguacaccgucauuaucacagugcauacgggggaccagcaccagguuggaaacgagacccaaggcgugacagcugaaaucaccccucaggccucuacaaccgaggcuacgcugcccgaauauggcacccuggggcucgagugcuccccucgcacaggacuggacuucaaugagaugauucuucugaccaugaaaaacaaggccuggaugguccauagacagugguuuuucgaucucccccugccguggacaagcggcgccaccacggaaacaccuaccuggaaucggaaagagcuucuggugacauuuaagaacgcucacgcgaaaaagcaagaagucgugguucucgggucucaggagggagccaugcacaccgcucugaccggcgccacagaaauccaaaauuccgggggcacgagcauuuucgccggacaucugaagugucgccucaaaauggacaagcuggagcuuaaaggcaugucuuacgcuaugugcaccaacacauuugugcugaagaaagaggucuccgaaacccagcacgggacaauccucauuaagguggaguacaagggagaagaugcccccuguaaaaucccuuucagcaccgaggacggccaugggaaggcgcacaacggaagacugaucacggcuaaucccguugugaccaagaaggaggaacccgucaacauugaggccgaaccuccguucggcgaguccaauaucgugauugggaucggcgauaacgcccugaaaauuaauugguauaagaagggaucuagcaucggcaaaauguuugaagcuaccgccagaggggcuagacgcauggccauccuuggagacaccgcgugggauuucggcuccgucgggggaguucucaacagccugggcaagaugguccaucaaauuuuugggucugccuacacagcucuguucuccggcgugagcugggugaugaaaaucggaauuggcguccuccugaccuggaucgggcuuaauucuaagaacacaagcauguccuuuucuugcauugccaucggaauuaucacgcuguaucucggcgcugugguucaggccgacauggggugugugaucaauuggaaaggaaaggagcugaagugcggcagcgggauuuucgucaccaacgaggugcacacauggaccgaacaguacaaauuucaggcggauucccccaagcggcuggccacagcuaucgccggcgcuugggagaauggaguuuguggcauuagaagcaccacgcgcauggaaaaccuucucuggaaacaaaucgccaaugagcugaacuauauucugugggaaaauaacgugaagcucaccgucgugguuggggacaucaucggagugcuggagcagggcaaacggacacuuaccccucagcccauggagcugaaguacucuuggaaaacaugggggaaggccaagauugucaccgcugaaacacagaacuccagcuucaucauugauggaccuaauacccccgagugcccgucugcguccagagccuggaacgugugggaaguggaggacuauggcuuuggcgucuucacgacaaauaucuggcuccgccugcgggaaguuuacacccaacugugugaccacagacuuaugagcgcugccgugaaagaugagcgcgccgugcaugcugacaugggguacuggauugagucccagaagaacggaucuuggaaacucgaaaaggccagccugaucgaggucaaaaccugcacauggccuaagucccacacccuguggucuaauggcgugcucgaaagcgauaugaucauucccaagucccuggcggggccuaucagccagcauaaccaccggcccggauaucacacgcagacagcuggcccuuggcaucuugggaaacuggagcucgacuuuaauuacugcgagggaaccacaguugugauuaccgaaaacuguggcacaagaggccccucucugcgcaccacgaccgucuccgggaagcugauccacgaguggugcugucggagcugcacacuuccgccucucagauauaugggagaagauggcuguugguacgggauggagauucggcccaucucugaaaaagaggagaauauggugaagucccugguuagcgccggaucuggcaaaguggacaacuucaccauggggguccugugccucgccauccuguuugaagaggugaugcgcggaaaguucggcaagaaacauaugauugcuggcguuuucuuuacauucgugcuucugcucagcgggcaaaucaccuggagagauauggcccacacgcugauuaugaucggauccaaugcgagcgaccggaugggcaugggggucacauaucuggcucuuauugccaccuuuaagauccagcccuuccuggcccucggauuuuuccugagaaaacucacaucucgcgaaaaccugcuucugggcguggggcucgcuauggccaccacccugcagcugccugaggauauugaacaaauggcuaauggaaucgcccuuggccugauggcgcucaagcugaucacacaguuugagacguaccagcucuggaccgcccugauuucccuuacauguagcaacaccaucuucacacugaccguggcuuggcggacggccacacucauucuggcuggcgucucccugcuuccgguuugccagucuagcuccaugagaaaaaccgacuggcugcccauggccguggccgcuaugggggugccuccccucccucuguuuaucuucucucucaaggauacccugaagcgcagaagcuggccccuuaaugagggagucauggcggugggccugguuuccauucuggccucuagccuccugcggaacgacgugccuauggcugggccccuugucgccggaggccugcucaucgccuguuaugugaucacagggaccuccgcugaucugacaguugaaaaagccgcggacauuacgugggaggaagaggcugaacaaaccggagugagccauaaccucaugaucacagucgacgaugacggcaccaugcgcauuaaggaugacgagacagagaauauccugaccgugcuucugaaaacggcccugcucauugucucuggcaucuuuccguacuccaucccugccacccugcuuguguggcacacauggcagaagcagacccagagaagcgggguucugugggaugugcccucuccucccgaaacacaaaaagcugagcucgaagagggagucuaccggauuaagcagcagggcaucuucgggaaaacccaggugggaguuggcgugcaaaaggagggggucuuucacacaauguggcaugugacgcgcggagccgugcugaccuauaacggcaagagacucgaaccgaauugggcguccguuaaaaaggaccugauuagcuacggcgggggauggcggcuuucuacacaguggcagaaaggcgaggaaguccaagugaucgcuguggagccugggaagaaccccaaaaauuuccagaccaugccuggaaccuuccagacaacgaccggcgaaauuggggccaucgcccuggauuuuaagcccggaacauccggcagccccauuaucaaccgcgagggcaaggucguggggcuguauggaaauggcguugugaccaaaaacgggggauacgucuccggcaucgcucagacaaaugccgagccugacgggccgacccccgaacucgaggaagagauguucaagaaaagaaaccugacgauuauggaucuucacccuggcagcggaaagacacggaaauaucugcccgcuaucgugcgcgaagccauuaagagacggcucagaacccugauccucgcgccuacccgcguuguggccgcugagauggaggaagcccugaagggccuucccauucgguaccaaacaaccgcuacaaaaucugagcauaccgggagagaaaucgucgaccugaugugccacgccacguuuacaaugcgccugcucagcccugugcggguuccgaauuauaaccugaucauuauggaugaggcccauuucaccgaccccgcuuccaucgcggccagaggauacauuucuacacgcgugggcaugggggaagcugccgccaucuuuaugaccgcuacgccucccggaaccgccgaugcguucccucagagcaaugcucccauucaggacgaggagcgggacaucccggaaagauccuggaacucuggcaaugaguggaucacagauuuugccgggaagaccgucugguucgugccuagcauuaaagccggcaacgacaucgcuaacugucuucgcaagaauggcaaaaaggugauucagcugucccggaagacauuugauaccgaauaccagaaaacaaagcucaacgacugggauuucgucguuaccacggacaucucugagaugggagccaauuuuaaagcggauagagugauugacccccggcgcugccugaagcccgugauccugacagaugggccugagagagucauucucgccggacccaugccugugaccgcugccagcgcugcccagcggcgcggcagaguugggcggaacccgcagaaagaaaaugaccaguauaucuucaccggacaaccccuuaacaaugaugaggaccacgcucacuggacagaagccaagaugcugcuggacaacaucaauaccccugagggcauuauccccgcccucuucgaaccugagagagagaaguccgccgcuauugauggggaauaccgccugaaaggcgagagccggaagacauuuguggaacuuaugagacgcggagaccugcccgucuggcucgcccauaaaguggcuucugagggcaucaaguauacggaucggaaauggugcuucgacgggcagagaaacaaucagauucuggaagagaacauggauguugagaucuggaccaaggaaggagagaaaaagaagcugcgcccgcgguggcucgacgccagaacauacuccgauccucuugcccugaaagaauuuaaggacuucgcugcgggccgcaaaagcaucgcccuggaucucgugaccgagauugggagaguccccucucaccuggcucaucggacacgcaaugcccuugacaaccuggugaugcuccacaccuccgaacacggaggcagagccuaucggcaugcugucgaggagcugccugaaacgauggagacccugcuccuucugggccugaugauccuccugacagggggagccaugcuuuuucugauuagcggcaaggggaucggaaaaaccuccauuggccucaucugugugaucgcgucuagcgggaugcuguggauggccgaaauuccccugcaguggaucgcuuccgccauuguucucgaguucuuuaugauggugcuucugaucccugagcccgaaaagcaacgcacaccgcaggauaaucagcuggcuuacguggucauuggaauccucacccuggccgcgauuaucgccgcuaacgagaugggccuucuggaaacgacaaagagagaccucggcaugagcaaagagccugggguugugucucccaccuccuaucuggauguggaccugcaccccgccagcgcuuggacacucuacgccgucgcuaccaccgugaucacaccuaugcuucggcauacgauugaaaauucuaccgccaacguuagccuggcggccaucgcuaaccaagccgugguccugaugggacucgacaagggcuggccgauuuccaaaauggaucugggggugccccuucuggcucucggaugcuacucucaggucaauccucugacacugaccgccgccgugcuccuucugaucacacacuaugcgauuaucggccccgggcugcaggcuaaggccaccagagaggcucagaaacgcacggccgccggaaucaugaagaacccuacaguugacggcauuaugaccaucgaucucgaccccgugauuuacgauagcaaguucgagaaacaacugggccaggucaugcuucuggugcucugugcuguucagcugcugcucaugcggaccuccugggcccuuugcgaagcgcugacacuggccaccgggccuaucacaacgcucugggagggaucuccgggcaaguuuuggaauaccacaauugcugugagcauggccaacaucuucagaggguccuaucuggcuggagccggccuugcguuuagcaucaugaaaucugucgggaccggaaagcgcggcacaggcucccagggggaaacccugggagagaaauggaagaagaaacucaaucaacugagccggaaggaguucgaccuguacaaaaaguccggcauuacggagguggauagaaccgaggccaaagaagggcucaagcggggagagaucacacaucacgcugugucucgcggcagcgccaaacuucagugguuuguugaaagaaacauggucauucccgaggggcgggugaucgaccugggauguggccgcggcgggugguccuauuacugcgcuggacugaagaaggugaccgaagucagaggcuauacaaaagggggaccuggccacgaggagcccguuccuaugucuaccuacggguggaauauugugaagcucaugagcggaaaagauguguucuaccugcccccggaaaagugugacacacuucugugcgauaucggcgaguccagcccuucucccaccgucgaagagucccggacgauucgcgugcucaaaaugguugagcccuggcugaagaacaaucaguucuguaucaaggugcugaacccuuauaugcccacagucaucgaacaucucgagagacuucagcggaaacacggcgggaugcuggugcgcaauccucugagcagaaacucuacccaugaaauguacuggauuuccaauggaaccggcaacaucguugccagcgugaauauggucucucggcuccugcuuaacagauuuacaaugacgcaccgccggccgaccauugagaaggacguggaucugggggcuggaacaagacacgugaacgccgaacccgagaccccuaauauggacgucaucggcgagcgcauuaaacggaucaaggaagaacacaacagcacauggcacuaugacgaugaaaaucccuacaaaaccugggcguaucauggguccuacgagguuaaggccacaggaucugcuagcuccaugaucaacggcguggugaagcuccugaccaaaccuugggacgucgugcccaugguuacgcaaauggccaugaccgauacaaccccguucggccagcagagaguguuuaaggaaaaagucgacacacgcaccccucggagcaugcccgggacgagacgcgugaugggaauuacagcugaguggcuguggcggacccucggcagaaauaagaaaccucgccugugcacacgggaggaguucaccaagaagguuagaacgaacgccgccaugggggcgguguuuaccgaggaaaaucaaugggauuccgcuaaagccgccgucgaggacgaagauuucuggaaacuuguggaccgcgagagagagcugcacaaacucggaaaguguggcucuugcguuuauaacaugauggggaaacgggaaaagaaacugggcgaguuuggaaaggcuaagggcagccgcgccaucugguacauguggcuuggggcuagauaccuggaguucgaggcccucggauuucugaaugaggaucauugguucucccgggaaaacucuuauagcggcguggagggggaaggacugcacaaacucggcuacauucugagagacaucuccaagauucccgggggcgcgauguaugccgaugacacagcuggaugggacacccggaucacagaggaugaccuucacaaugaagagaaaaucacccagcagauggauccugagcaucgccagcuggccaacgcuauuuuuaagcucacauaccaaaauaaagucgugaagguccagagacccaccccgacgggcacagugauggacaucauuucucggaaggaucagcgcgggagcggacagguuggcaccuaugggcugaacaccuucacaaauauggaagcccaacuuaucagacagauggagggagaaggcgugcuguccaaagcggaccucgagaacccucaucugcccgaaaagaaaauuacccaguggcuggagacaaagggggucgagcggcucaaacgcauggccaucagcggcgaugacugcguggugaagcccaucgaugacagauuugcuaacgcccugcuugcucugaaugauaugggaaagguucggaaagacauuccucaguggcaaccgucuaagggcuggcaugauuggcaacaggugcccuucuguucccaccacuuccaugaacucaucaugaaagacgggcgcaagcuggucgugccuugcagaccccaggacgagcuuauuggacgggcccgcaucagccaaggcgcuggguggucucugagagaaacggccugucucggaaaagcguacgcccagauguggucccugauguauuuucaccggcgcgaucugagacucgcuagcaacgccauuugcucugccguuccugugcauuggguccccaccucccggacaaccuggagcauccacgcucaucaccaguggaugacaaccgaggacaugcugacgguguggaauagagucuggauugaagauaacccuuggauggaggacaagacccccgugacaaccugggaggauguuccguaccuuggcaagcgcgaagaccaauggugugggucccugaucggccucacaagccgggccaccugggcgcagaauaucccuacggcuauucaacaggugagaucucugaucggaaacgaggaguuccuugauuacaugcccagcaugaaacgcuuucggaaggaggaggaauccgagggcgccauuugguga

SEQ ID NO: 20628 - RNA, 9873 nt, Artificial Sequence
  derived and/or modified CDS sequence (opt5) from DENV-3__KJ189279__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggucacccugcccgaauauggcacgcuggggcucgagugcuccccucgcaccggacuggacuucaaugagaugauccuucugacaaugaaaaacaaggcuuggauggugcauagacagugguuuuucgaucucccccugccguggaccagcggcgccacaaccgaaacgccuacauggaaucggaaagagcuucuggucaccuuuaagaacgcccacgcuaaaaagcaagaagugguugugcucgggucucaggagggagcgaugcacacagcccugaccggcgcuaccgaaauucaaaauuccgggggcacaagcaucuucgccggacaucugaagugucgccucaaaauggacaagcuggagcuuaaaggcaugucuuacgccaugugcacgaacaccuuuguccugaagaaagagguguccgaaacacagcacgggaccauucucaucaagguugaguacaagggagaagaugcucccuguaaaaucccuuucagcacagaggacggccaugggaaggcccacaacggaagacugauuaccgcgaaucccguggucacgaaaaaggaggaacccgugaacaucgaggcugaaccuccguucggcgaguccaauauugugaucgggauuggcgauaacgcccugaaaaucaauugguauaagaagggaucuagcaucggcaaaauguuugaagccacagcuagaggggccagacgcauggcuauucuuggagacaccgccugggauuucggcuccguugggggaguccucaacagccugggcaagauggugcaucaaaucuuugggucugcguacaccgcccuguucuccggcgugagcugggucaugaaaauuggaaucggcgugcuccugacauggauugggcuuaauucuaagaacaccagcauguccuuuucuugcaucgcuauuggaaucaucacacuguaucucggcgccguugugcaggcugacauggggugugucauuaauuggaaaggaaaggagcugaagugcggcagcgggaucuucgugacgaacgagguucacaccuggacagaacaguacaaauuucaggccgauucccccaagcggcuggcgaccgccauugcuggcgccugggagaauggaguguguggcaucagaagcacaacccgcauggaaaaccuucucuggaaacaaauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucacagccgaaacccagaacuccagcuucaucauugauggaccuaauacacccgagugcccgucugcuuccagagcguggaacgugugggaaguggaggacuauggcuuuggcgucuucaccacgaauaucuggcuccgccugcgggaaguuuacacacaacugugugaccacagacuuaugagcgccgcuaucaaagaugagcgcgccgugcaugccgacaugggguacuggauugagucccagaagaacggaucuuggaaacucgaaaaggcuagccugaucgaggugaaaaccugcaccuggccuaagucccacacacuguggucuaauggcguccucgaaagcgauaugauuauccccaagucccuggccgggccuauuagccagcauaaccaccggcccggauaucacacccagacggcgggcccuuggcaucuugggaaacuggagcucgacuuuaauuacugcgagggaacaaccgugguuaucacagaaaacuguggcaccagaggccccucucugcgcacaaccacgguguccgggaagcugauccacgaguggugcugucggagcugcacccuuccgccucucagauauaugggagaagauggcuguugguacgggauggagauucggcccaucucugaaaaagaggagaauauggucaagucccuggugagcgcuggaucuggcaaaguugacaacuucacaaugggggugcugugccucgccauucuguuugaagaggucaugcgcggaaaguucggcaagaaacauaugaucgccggcguguucuuuaccuucguucuucugcucagcgggcaaauuacauggagagauauggcucacacccugaucaugauuggauccaaugccagcgaccggaugggcaugggggugacguaucuggcgcuuaucgcuacauuuaagauccagcccuuccuggcccucggauuuuuccugagaaaacucaccucucgcgaaaaccugcuucugggcgucgggcucgccauggcuacaacccugcagcugccugaggauauugaacaaauggccaauggaaucgcucuuggccugauggcccucaagcugauuacccaguuugagacauaccagcucuggacggcgcugaucucccuuaccuguagcaacacaauuuucacccugacaguggccuggcggaccgcuacgcucauccuggccggcgugucccugcuuccggucugccagucuagcuccaugagaaaaacagacuggcugcccauggcuguugccgccaugggggugccuccccucccucuguuuaucuucucucucaaggauacccugaagcgcagaagcuggccccuuaaugagggagugauggcugucggccugguguccauucuggcgucuagccuccugcggaacgacguuccuauggccgggccccuuguggcuggaggccugcucaucgccuguuaugucauuaccgggacauccgccgaucugaccguggaaaaagcugccgacaucacaugggaggaagaggcggaacaaacgggaguuagccauaaccucaugauuaccguggacgaugacggcacaaugcgcaucaaggaugacgagaccgagaauauccugacaguccuucugaaaaccgcucugcucauugugucuggcaucuuuccguacuccauuccugccacgcugcuugucuggcacaccuggcagaagcagacacagagaagcggggugcugugggauguucccucuccucccgaaacccaaaaagccgagcucgaagagggaguguaccggaucaagcagcagggcauuuucgggaaaacacaggucggagugggcguucaaaaggaggggguguuucacaccauguggcaugucacacgcggagcugugcugacguauaacggcaagagacucgaaccgaauugggccuccgugaaaaaggaccugaucagcuacggcgggggauggcggcuuucuacccaguggcagaaaggcgaggaaguucaagucauugcgguggagccugggaagaaccccaaaaauuuccagacaaugccuggaaccuuccagaccacaacgggcgaaaucggggcuaucgcccuggauuuuaagcccggaaccuccggcagccccauuaucaaccgcgagggcaagguggucgggcuguauggaaauggcgugguuaccaagaacgggggauacguguccggcauugcccagaccaaugcugagccugacgggccgacacccgaacucgaggaagagauguucaagaaaagaaaccugaccaucauggaucuucacccuggcagcggaaagacgcggaaauaucugcccgccauuguccgcgaagcuaucaagagacggcucagaacacugauccucgccccuacccgcgugguugcggccgagauggaggaagcucugaagggccuucccauucgguaccaaaccacagccaccaaaucugagcauacagggagagaaaucguggaccugaugugccacgcuaccuuuacgaugcgccugcucagcccuguccgggugccgaauuauaaccugauuaucauggaugaggcccauuucacagaccccgccuccauugcugcgagaggauacaucucuacccgcguuggcaugggggaagccgcugccaucuuuaugacagccaccccucccggaacggcugaugccuucccucagagcaaugcgcccauucaggacgaggagcgggacaucccggaaagauccuggaacucuggcaaugaguggauuaccgauuuugcugggaagacagugugguucgucccuagcaucaaagccggcaacgacauugccaacugucuucgcaagaauggcaaaaaggugauccagcugucccggaagaccuuugauacagaauaccagaaaacaaagcucaacgacugggauuucguggucacaaccgacauuucugagaugggagcuaauuuuaaagccgauagaguuaucgacccccggcgcugccugaagcccgugauccugacggaugggccugagagagugauucucgcgggacccaugccugucacagccgcuagcgccgcucagcggcgcggcagaguggggcggaacccgcagaaagaaaaugaccaguauaucuucaccggacaaccccuuaacaaugaugaggaccacgcccacuggaccgaagcuaagaugcugcuggacaacauuaauacaccugagggcaucauucccgcccucuucgaaccugagagagagaaguccgcggccaucgauggggaauaccgccugaaaggcgagagccggaagaccuuuguugaacuuaugagacgcggagaccugcccguguggcucgcucauaaagucgccucugagggcaucaaguauacagaucggaaauggugcuucgacgggcagagaaacaaucagauucuggaagagaacauggauguggagaucuggacgaaggaaggagagaaaaagaagcugcgcccgcgguggcucgacgcuagaaccuacuccgauccucuugcccugaaagaauuuaaggacuucgccgcuggccgcaaaagcauugcgcuggaucucguuacagagaucgggagagugcccucucaccuggcccaucggacccgcaaugcucuugacaaccuggucaugcuccacacauccgaacacggaggcagagccuaucggcaugccguggaggagcugccugaaaccauggagacgcugcuccuucugggccugaugauucuccugaccgggggagcuaugcuuuuucugaucagcggcaaggggaucggaaaaacauccauuggccucaucugugucauugccucuagcgggaugcuguggauggcggaaaucccccugcaguggauugccuccgcuaucgugcucgaguucuuuaugaugguucuucugauuccugagcccgaaaagcaacgcaccccgcaggauaaucagcuggccuacguggugaucggaauccucacacuggcugccauuaucgcggccaacgagaugggccuucuggaaaccacgaagagagaccucggcaugagcaaagagccuggggucguuucucccacauccuaucuggauguggaccugcaccccgcuagcgccuggacccucuacgcuguggccacaaccgucauuaccccuaugcuucggcauacaaucgaaaauucuacggcuaacgugagccuggccgcgauugccaaccaagcuguugugcugaugggacucgacaagggcuggccgaucuccaaaauggaucugggggucccccuucuggcccucggaugcuacucucaggugaauccucugacccugacagcugccguccuccuucugaucacccacuaugccauuaucggccccgggcugcaggcgaaggcuacaagagaggcccagaaacgcaccgcugccggaauuaugaagaacccuacgguggacggcaucaugacaauugaucucgaccccguuaucuacgauagcaaguucgagaaacaacugggccaggugaugcuucugguccucugugccgugcagcugcugcucaugcggaccuccugggcucuuugcgaagcccugacccuggcgacagggccuaucaccacacucugggagggaucuccgggcaaguuuuggaauacgaccauugccguuagcauggcuaacaucuucagaggguccuaucuggccggagcuggccuugccuuuagcauuaugaaaucuguggggacaggaaagcgcggcaccggcucccagggggaaacacugggagagaaauggaagaagaaacucaaucaacugagccggaaggaguucgaccuguacaaaaaguccggcaucaccgaggucgauagaacggaggcgaaagaagggcucaagcggggagagauuacccaucacgccgugucucgcggcagcgcuaaacuucagugguuuguggaaagaaacaugguuauccccgaggggcgggucauugaccugggauguggccgcggcgggugguccuauuacugcgccggacugaagaaggugacagaagugagaggcuauaccaaagggggaccuggccacgaggagcccgucccuaugucuacauacggguggaauaucguuaagcucaugagcggaaaagauguguucuaccugcccccggaaaagugugacacccuucugugcgauaucggcgaguccagcccuucucccacaguggaagagucccggaccauucgcguccucaaaaugguggagcccuggcugaagaacaaucaguucuguaucaagguucugaacccuuauaugcccacggugauugaacaucucgagagacuucagcggaaacacggcgggaugcugguccgcaauccucugagcagaaacucuacacaugaaauguacuggaucuccaauggaaccggcaacauuguggcuagcguuaauauggugucucggcuccugcuuaacagauuuaccaugacacaccgccggccgacgaucgagaaggacgucgaucugggggccggaaccagacacgugaacgcugaacccgagacaccuaauauggacgugaucggcgagcgcauuaaacggaucaaggaagaacacaacagcaccuggcacuaugacgaugaaaaucccuacaaaacaugggccuaucauggguccuacgaggucaaggcgaccggaucugccagcuccaugauuaacggcguugugaagcuccugacaaaaccuugggacgugguccccauggugacccaaauggcuaugacggauaccacaccguucggccagcagagaguuuuuaaggaaaaaguggacacccgcacaccucggagcaugcccgggaccagacgcgucaugggaaucacggccgaguggcuguggcggacacucggcagaaauaagaaaccucgccugugcacccgggaggaguucacaaagaaggugagaaccaacgcugccaugggggccguuuuuacggaggaaaaucaaugggauuccgcgaaagcugccguggaggacgaagauuucuggaaacuugucgaccgcgagagagagcugcacaaacucggaaaguguggcucuugcguguauaacaugauggggaaacgggaaaagaaacugggcgaguuuggaaaggccaagggcagccgcgcuauuugguacauguggcuuggggccagauaccuggaguucgaggcucucggauuucugaaugaggaucauugguucucccgggaaaacucuuauagcggcguugagggggaaggacugcacaaacucggcuacauccugagagacaucuccaagauucccgggggcgccauguaugcggaugacaccgccggaugggacacacggaucaccgaggaugaccuucacaaugaagagaaaauuacacagcagauggauccugagcaucgccagcuggcuaacgccaucuuuaagcucaccuaccaaaauaaaguggucaaggugcagagacccacaccgaccggcacggucauggacauuaucucucggaaggaucagcgcgggagcggacaggugggcacauaugggcugaacaccuucaccaauauggaagcucaacuuaucagacagauggagggagaaggcguucuguccaaagccgaccucgagaacccucaucugcccgaaaagaaaauuacacaguggcuggagaccaaggggguggagcggcucaaacgcauggcgaucagcggcgaugacugcgucgugaagcccauugaugacagauuugccaacgcucugcuugcccugaaugauaugggaaaggugcggaaagacaucccucaguggcaaccgucuaagggcuggcaugauuggcagcagguucccuucuguucccaccacuuccaugaacucauuaugaaagacgggcgcaagcugguggucccuugcagaccccaggacgagcuuaucggacgggcucgcauuagccaaggcgccggguggucucugagagaaacagcuugucucggaaaagccuacgcgcagauguggucccugauguauuuucaccggcgcgaucugagacucgccagcaacgcuaucugcucugccgugccuguucauugggugcccacgucccggaccacauggagcauccacgcccaucaccaguggaugaccacagaggacaugcugaccgucuggaauagaguguggauugaagauaacccuuggauggaggacaagacgcccgucaccacaugggaggaugugccguaccuuggcaagcgcgaagaccaauggugugggucccugaucggccucaccagccgggcuacaugggcccagaauauuccuaccgcgauccagcagguuagaucucugauuggaaacgaggaguuccuugauuacaugcccagcaugaaacgcuuucggaaggaggaggaauccgagggcgcuaucugguga

SEQ ID NO: 20629 - RNA, 9873 nt, Artificial Sequence
  derived and/or modified CDS sequence (opt5) from DENV-3__KJ189280__SS-prME
accagccugugccucaugaugauccugcccgcggcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccagaacuccagcuucaucauugauggaccuaauacacccgagugcccgucugcguccagagccuggaacgucugggaaguggaggacuauggcuuuggcguguucaccacgaauaucuggcuccgccugcgggaagucuacacacaacugugugaccacagacuuaugagcgcugccguuaaagaugagcgcgccgugcaugcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccaccggcccggauaucacacccagacggcuggcccuuggcaucuugggaaacuggagcucgacuuuaauuacugcgagggaacaaccgugguuauuacagaaaacuguggcaccagaggccccucucugcgcacaaccacgguguccgggaagcugauccacgaguggugcugucggagcugcacccuuccgccucucagauauaugggagaagauggcuguugguacgggauggagauccggcccauuucugaaaaagaggagaauauggucaagucccuggugagcgccggaucuggcaaaguugacaacuucacaaugggggugcugugccucgccauccuguuugaagaggucaugcgcggaaaguucggcaagaaacauaugauugcuggcguguucuuuaccuucguucuucugcucagcgggcaaaucacauggagagauauggcccacacccugauuaugaucggauccaaugcgagcgaccggaugggcaugggggugacguaucuggcucuuauugccacauuuaagauccagcccuuccuggcccucggauuuuuccugagaaaacucaccucucgcgaaaaccugcuucugggcgucgggcucgcuauggccacaacccugcagcugccugaggauaucgaacaaauggcuaauggaauugcccuuggccugauggcgcucaagcugaucacccaguuugagacauaccagcucuggacggcccugauuucccuuaccuguagcaacacaaucuucacccugacaguggcuuggcggaccgccacgcucauucuggcuggcgugucccugcuuccggucugccagucuagcuccaugagaaaaacagacuggcugcccauggccguugccgcuaugggggugccuccccucccucuguuuaucuucucucucaaggauacccugaagcgcagaagcuggccccuuaaugagggagugauggcggucggccugguguccauccuggccucuagccuccugcggaacgacguuccuauggcugggccccuuguggccggaggccugcucauugccuguuaugucaucaccgggacauccgcugaucugaccguggaaaaagccgcggacauuacaugggaggaagaggcugaacaaacgggaguuagccauaaccucaugaucaccguggacgaugacggcacaaugcgcauuaaggaugacgagaccgagaauauccugacaguccuucugaaaaccgcccugcucaucgugucuggcauuuuuccguacuccaucccugccacgcugcuugucuggcacaccuggcagaagcagacacagagaagcggggugcugugggauguucccucuccucccgaaacccaaaaagcugagcucgaagagggaguguaccggauuaagcagcagggcaucuucgggaaaacacaggucggagugggcguucaaaaggaggggguguuucacaccauguggcaugucacacgcggagccgugcugacguauaacggcaagagacucgaaccgaauugggcguccgugaaaaaggaccugauuagcuacggcgggggauggcggcuuucuacccaguggcagaaaggcgaggaaguucaagucaucgcuguggagccugggaagaaccccaaaaauuuccagacaaugccuggaaccuuccagaccacaacgggcgaaauuggggccaucgcccuggauuuuaagcccggaaccuccggcagccccaucauuaaccgcgagggcaagguggucgggcuguauggaaauggcgugguuaccaagaacgggggauacguguccggcaucgcucagaccaaugccgagccugacgggccgacacccgaacucgaggaagagauguucaagaaaagaaaccugaccauuauggaucuucacccuggcagcggaaagacgcggaaauaucugcccgcuaucguccgcgaagccauuaagagacggcucagaacacugauccucgcgccuacccgcgugguugccgcugagauggaggaagcccugaagggccuucccauccgguaccaaaccacagcuaccaaaucugagcauacagggagagaaauuguggaccugaugugccacgccaccuuuacgaugcgccugcucagcccuguccgggugccgaauuauaaccugaucauuauggaugaggcccauuucacagaccccgcuuccaucgcggccagaggauacauuucuacccgcguuggcaugggggaagcugccgccaucuuuaugacagcuaccccucccggaacggccgaugcguucccucagagcaaugcucccauccaggacgaggagcgggacauuccggaaagauccuggaacucuggcaaugaguggaucaccgauuuugccgggaagacagugugguucgucccuagcauuaaagccggcaacgacaucgcuaacugucuucgcaagaauggcaaaaaggugauucagcugucccggaagaccuuugauacagaauaccagaaaacaaagcucaacgacugggauuucguggucacaaccgacaucucugagaugggagccaauuuuaaagcggauagaguuauugacccccggcgcugccugaagcccgugauccugacggaugggccugagagagugauccucgccggacccaugccugucacagcugccagcgcugcccagcggcgcggcagaguggggcggaacccgcagaaagaaaaugaccaguauauuuucaccggacaaccccuuaacaaugaugaggaccacgcucacuggaccgaagccaagaugcugcuggacaacaucaauacaccugagggcauuauccccgcccucuucgaaccugagagagagaaguccgccgcuauugauggggaauaccgccugaaaggcgagagccggaagaccuuuguugaacuuaugagacgcggagaccugcccguguggcucgcccauaaagucucuuccgagggcaucaaguauacagaucggaaauggugcuucgacgggcagagaaacaaucagauccuggaagagaacauggauguggagauuuggacgaaggaaggagagaaaaagaagcugcgcccgcgguggcucgacgcuagaaccuacagcgauccucuugcccugaaagaauuuaaggacuucgccgcuggccgcaaaucuaucgcgcuggaucucguuacagagauugggagagugcccucccaccuggcccaucggacccgcaaugcucuugacaaccuggucaugcuccacacaagcgaacacggaggcagagccuaucggcaugccguggaggagcugccugaaaccauggagacgcugcuccuucugggccugaugauccuccugaccgggggagcuaugcuuuuucugauuuccggcaaggggaucggaaaaacaucuaucggccucauuugugucaucgccagcuccgggaugcuguggauggcggaaauuccccugcaguggaucgccagcgcuauugugcucgaguucuuuaugaugguucuucugaucccugagcccgaaaagcaacgcaccccgcaggauaaucagcuggccuacguggugauuggaauccucacacuggcugccaucauugcggccaacgagaugggccuucuggaaaccacgaagagagaccucggcaugucuaaagagccuggggucguuucccccacaagcuaucuggauguggaccugcaccccgcuucugccuggacccucuacgcuguggccacaaccgucaucaccccuaugcuucggcauacaauugaaaauagcacggcuaacgugucccuggccgcgaucgccaaccaagcuguugugcugaugggacucgacaagggcuggccgauuucuaaaauggaucugggggucccccuucuggcccucggaugcuacagccaggugaauccucugacccugacagcugccguccuccuucugaucacccacuaugccaucauuggccccgggcugcaggcgaaggcuacaagagaggcccagaaacgcaccgcugccggaaucaugaagaacccuacgguggacggcauuaugacaaucgaucucgaccccguuauuuacgauuccaaguucgagaaacaacugggccaggugaugcuucugguccucugugccgugcagcugcugcucaugcggaccucuugggcucuuugcgaagcccugacccuggcgacagggccuaucaccacacucugggagggaagcccgggcaaguuuuggaauacgaccaucgccguuuccauggcuaacauuuucagagggagcuaucuggccggagcuggccuugccuuuucuaucaugaaauccguggggacaggaaagcgcggcaccggcagccagggggaaacacugggagagaaauggaagaagaaacucaaucaacugucccggaaggaguucgaccuguacaaaaagucuggcauuaccgaggucgauagaacggaggcgaaagaagggcucaagcggggagagaucacccaucacgccgugagccgcggcuccgcuaaacuucagugguuuguggaaagaaacaugguuauucccgaggggcgggucaucgaccugggauguggccgcggcggguggucuuauuacugcgccggacugaagaaggugacagaagugagaggcuauaccaaagggggaccuggccacgaggagcccgucccuaugagcacauacggguggaauauuguuaagcucauguccggaaaagauguguucuaccugcccccggaaaagugugacacccuucugugcgauaucggcgagagcucuccuucccccacaguggaagagagccggaccauccgcguccucaaaaugguggagcccuggcugaagaacaaucaguucuguauuaagguucugaacccuuauaugcccacggugaucgaacaucucgagagacuucagcggaaacacggcgggaugcugguccgcaauccucugucuagaaacuccacacaugaaauguacuggauuagcaauggaaccggcaacaucguggcuucuguuaauauggugagccggcuccugcuuaacagauuuaccaugacacaccgccggccgacgauugagaaggacgucgaucugggggccggaaccagacacgugaacgcugaacccgagacaccuaauauggacgugaucggcgagcgcaucaaacggauuaaggaagaacacaacuccaccuggcacuaugacgaugaaaaucccuacaaaacaugggccuaucaugggucuuacgaggucaaggcgaccggaagcgccuccagcaugaucaacggcguugugaagcuccugacaaaaccuugggacgugguccccauggugacccaaauggcuaugacggauaccacaccguucggccagcagagaguuuuuaaggaaaaaguggacacccgcacaccucgguccaugcccgggaccagacgcgucaugggaauuacggccgaguggcuguggcggacacucggcagaaauaagaaaccucgccugugcacccgggaggaguucacaaagaaggugagaaccaacgcugccaugggggccguuuuuacggaggaaaaucaaugggauucugcgaaagcugccguggaggacgaagauuucuggaaacuugucgaccgcgagagagagcugcacaaacucggaaaguguggcagcugcguguauaacaugauggggaaacgggaaaagaaacugggcgaguuuggaaaggccaagggcucccgcgcuaucugguacauguggcuuggggccagauaccuggaguucgaggcucucggauuucugaaugaggaucauugguucucucgggaaaacagcuauuccggcguugagggggaaggacugcacaaacucggcuacauucugagagacaucucuaagauccccgggggcgccauguaugcggaugacaccgccggaugggacacacggauuaccgaggaugaccuucacaaugaagagaaaaucacacagcagauggauccugagcaucgccagcuggcuaacgccauuuuuaagcucaccuaccaaaauaaaguggucaaggugcagagacccacaccgaccggcacggucauggacaucauuagccggaaggaucagcgcggguccggacaggugggcacauaugggcugaacaccuucaccaauauggaagcucaacuuaucagacagauggagggagaaggcguucugagcaaagccgaccucgagaacccucaucugcccgaaaagaaaaucacacaguggcuggagaccaaggggguggagcggcucaaacgcauggcgauuucuggcgaugacugcgucgugaagcccaucgaugacagauuugccaacgcucugcuugcccugaaugauaugggaaaggugcggaaagacauuccucaguggcaaccguccaagggcuggcaugauuggcagcagguucccuucuguagccaccacuuccaugaacucaucaugaaagacgggcgcaagcugguggucccuugcagaccccaggacgagcuuauuggacgggcucgcaucucucaaggcgccggguggucccugagagaaacagcuugucucggaaaagccuacgcgcagauguggagccugauguauuuucaccggcgcgaucugagacucgccucuaacgcuauuugcuccgccgugccuguucauugggugcccacgagccggaccacaugguccauccacgcccaucaccaguggaugaccacagaggacaugcugaccgucuggaauagaguguggaucgaagauaacccuuggauggaggacaagacgcccgucaccacaugggaggaugugccguaccuuggcaagcgcgaagaccaauggugugggagccugauuggccucaccucucgggcuacaugggcccagaauaucccuaccgcgauucagcagguuagaagccugaucggaaacgaggaguuccuugauuacaugcccuccaugaaacgcuuucggaaggaggaggaaucugagggcgcuauuugguga

SEQ ID NO: 20630 - RNA, 9873 nt, Artificial Sequence
  derived and/or modified CDS sequence (opt5) from DENV-3__KJ189281__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccagaacuccagcuucaucauugauggaccuaauacacccgagugcccgucugcguccagagccuggaacgucugggaaguggaggacuauggcuuuggcguguucaccacgaauaucuggcuccgccugcgggaagucuacacacaacugugugaccacagacuuaugagcgcugccguuaaagaugagcgcgccgugcaugcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccaccggcccggauaucacacccagacggcuggcccuuggcaucuugggaaacuggagcucgacuuuaauuacugcgagggaacaaccgugguuauuacagaaaacuguggcaccagaggccccucucugcgcacaaccacgguguccgggaagcugauccacgaguggugcugucggagcugcacccuuccgccucucagauauaugggagaagauggcuguugguacgggauggagauccggcccauuucugaaaaagaggagaauauggucaagucccuggugagcgccggaucuggcaaaguugacaacuucacaaugggggugcugugccucgccauccuguuugaagaggucaugcgcggaaaguucggcaagaaacauaugauugcuggcguguucuuuaccuucguucuucugcucagcgggcaaaucacauggagagauauggcccacacccugauuaugaucggauccaaugcgagcgaccggaugggcaugggggugacguaucuggcucuuauugccacauuuaagauccagcccuuccugguccucggauuuuuccugagaaaacucaccucucgcgaaaaccugcuucugggcguggggcucgccauggcuacaacccugcagcugccugaggauaucgaacaaauggccaauggaauugcucuuggccugauggcccucaagcugaucacccaguuugagacauaccagcucuggacggcgcugauuucccuuaccuguagcaacacaaucuucacccugacaguggccuggcggaccgcuacgcucauucuggccggcgucucccugcuuccgguuugccagucuagcuccaugagaaaaacagacuggcugcccauggcuguggccgccaugggggugccuccccucccucuguuuaucuucucucucaaggauacccugaagcgcagaagcuggccccuuaaugagggagucauggcugugggccugguuuccauccuggcgucuagccuccugcggaacgacgugccuauggccgggccccuugucgcuggaggccugcucauugccuguuaugugaucaccgggacauccgccgaucugaccguugaaaaagcugccgacauuacaugggaggaagaggcggaacaaacgggagugagccauaaccucaugaucaccgucgacgaugacggcacaaugcgcauuaaggaugacgagaccgagaauauccugacagugcuucugaaaaccgcucugcucaucgucucuggcauuuuuccguacuccaucccugccacgcugcuuguguggcacaccuggcagaagcagacacagagaagcgggguucugugggaugugcccucuccucccgaaacccaaaaagccgagcucgaagagggagucuaccggauuaagcagcagggcaucuucgggaaaacacaggugggaguuggcgugcaaaaggagggggucuuucacaccauguggcaugugacacgcggagcugugcugacguauaacggcaagagacucgaaccgaauugggccuccguuaaaaaggaccugauuagcuacggcgggggauggcggcuuucuacccaguggcagaaaggcgaggaaguccaagugaucgcgguggagccugggaagaaccccaaaaauuuccagacaaugccuggaaccuuccagaccacaacgggcgaaauuggggcuaucgcccuggauuuuaagcccggaaccuccggcagccccaucauuaaccgcgagggcaaggucguggggcuguauggaaauggcguugugaccaagaacgggggauacgucuccggcaucgcccagaccaaugcugagccugacgggccgacacccgaacucgaggaagagauguucaagaaaagaaaccugaccauuauggaucuucacccuggcagcggaaagacgcggaaauaucugcccgccaucgugcgcgaagcuauuaagagacggcucagaacacugauccucgccccuacccgcguuguggcggccgagauggaggaagcucugaagggccuucccauccgguaccaaaccacagccaccaaaucugagcauacagggagagaaauugucgaccugaugugccacgcuaccuuuacgaugcgccugcucagcccugugcggguuccgaauuauaaccugaucauuauggaugaggcccauuucacagaccccgccuccaucgcugcgagaggauacauuucuacccgcgugggcaugggggaagccgcugccaucuuuaugacagccaccccucccggaacggcugaugccuucccucagagcaaugcgcccauccaggacgaggagcgggacauuccggaaagauccuggaacucuggcaaugaguggaucaccgauuuugcugggaagacagucugguucgugccuagcauuaaagccggcaacgacaucgccaacugucuucgcaagaauggcaaaaaggugauucagcugucccggaagaccuuugauacagaauaccagaaaacaaagcucaacgacugggauuucgucguuacaaccgacaucucugagaugggagcuaauuuuaaagccgauagagugauugacccccggcgcugccugaagcccgugauccugacggaugggccugagagagucauccucgcgggacccaugccugugacagccgcuagcgccgcucagcggcgcggcagaguugggcggaacccgcagaaagaaaaugaccaguauauuuucaccggacaaccccuuaacaaugaugaggaccacgcccacuggaccgaagcuaagaugcugcuggacaacaucaauacaccugagggcauuauccccgcccucuucgaaccugagagagagaaguccgcggccauugauggggaauaccgccugaaaggcgagagccggaagaccuuuguggaacuuaugagacgcggagaccugcccgucuggcucgcucauaaaguggccucugagggcaucaaguauacagaucggaaauggugcuucgacgggcagagaaacaaucagauccuggaagagaacauggauguugagauuuggacgaaggaaggagagaaaaagaagcugcgcccgcgguggcucgacgcuagaaccuacuccgauccucuugcccugaaagaauuuaaggacuucgccgcuggccgcaaaagcaucgcgcuggaucucgugacagagauugggagaguccccucucaccuggcccaucggacccgcaaugcucuugacaaccuggugaugcuccacacauccgaacacggaggcagagccuaucggcaugccgucgaggagcugccugaaaccauggagacgcugcuccuucugggccugaugauccuccugaccgggggagcuaugcuuuuucugauuagcggcaaggggaucggaaaaacauccaucggccucauuugugugaucgccucuagcgggaugcuguggauggcggaaauuccccugcaguggaucgccuccgcuauuguucucgaguucuuuaugauggugcuucugaucccugagcccgaaaagcaacgcaccccgcaggauaaucagcuggccuacguggucauuggaauccucacacuggcugccaucauugcggccaacgagaugggccuucuggaaaccacgaagagagaccucggcaugagcaaagagccugggguugugucucccacauccuaucuggauguggaccugcaccccgcuagcgccuggacccucuacgcugucgccacaaccgugaucaccccuaugcuucggcauacaauugaaaauucuacggcuaacguuagccuggccgcgaucgccaaccaagcugugguccugaugggacucgacaagggcuggccgauuuccaaaauggaucugggggugccccuucuggcccucggaugcuacucucaggucaauccucugacccugacagcugccgugcuccuucugaucacccacuaugccaucauuggccccgggcugcaggcgaaggcuacaagagaggcccagaaacgcaccgcugccggaaucaugaagaacccuacgguugacggcauuaugacaaucgaucucgaccccgugauuuacgauagcaaguucgagaaacaacugggccaggucaugcuucuggugcucugugccguucagcugcugcucaugcggaccuccugggcucuuugcgaagcccugacccuggcgacagggccuaucaccacacucugggagggaucuccgggcaaguuuuggaauacgaccaucgccgugagcauggcuaacauuuucagaggguccuaucuggccggagcuggccuugccuuuagcaucaugaaaucugucgggacaggaaagcgcggcaccggcucccagggggaaacacugggagagaaauggaagaagaaacucaaucaacugagccggaaggaguucgaccuguacaaaaaguccggcauuaccgagguggauagaacggaggcgaaagaagggcucaagcggggagagaucacccaucacgccgugucucgcggcagcgcuaaacuucagugguuuguugaaagaaacauggucauucccgaggggcgggugaucgaccugggauguggccgcggcgggugguccuauuacugcgccggacugaagaaggugacagaagucagaggcuauaccaaagggggaccuggccacgaggagcccguuccuaugucuacauacggguggaauauugugaagcucaugagcggaaaagauguguucuaccugcccccggaaaagugugacacccuucugugcgauaucggcgaguccagcccuucucccacagucgaagagucccggaccauccgcgugcucaaaaugguugagcccuggcugaagaacaaucaguucuguauuaaggugcugaacccuuauaugcccacggucaucgaacaucucgagagacuucagcggaaacacggcgggaugcuggugcgcaauccucugagcagaaacucuacacaugaaauguacuggauuuccaauggaaccggcaacaucguugcuagcgugaauauggucucucggcuccugcuuaacagauuuaccaugacacaccgccggccgacgauugagaaggacguggaucugggggccggaaccagacacgugaacgcugaacccgagacaccuaauauggacgucaucggcgagcgcaucaaacggauuaaggaagaacacaacagcaccuggcacuaugacgaugaaaaucccuacaaaacaugggccuaucauggguccuacgagguuaaggcgaccggaucugccagcuccaugaucaacggcguggugaagcuccugacaaaaccuugggacgucgugcccaugguuacccaaauggcuaugacggauaccacaccguucggccagcagagaguguuuaaggaaaaagucgacacccgcacaccucggagcaugcccgggaccagacgcgugaugggaauuacggccgaguggcuguggcggacacucggcagaaauaagaaaccucgccugugcacccgggaggaguucacaaagaagguuagaaccaacgcugccaugggggccguguuuacggaggaaaaucaaugggauuccgcgaaagcugccgucgaggacgaagauuucuggaaacuuguggaccgcgagagagagcugcacaaacucggaaaguguggcucuugcguuuauaacaugauggggaaacgggaaaagaaacugggcgaguuuggaaaggccaagggcagccgcgcuaucugguacauguggcuuggggccagauaccuggaguucgaggcucucggauuucugaaugaggaucauugguucucccgggaaaacucuuauagcggcguggagggggaaggacugcacaaacucggcuacauucugagagacaucuccaagauccccgggggcgccauguaugcggaugacaccgccggaugggacacacggauuaccgaggaugaccuucacaaugaagagaaaaucacacagcagauggauccugagcaucgccagcuggcuaacgccauuuuuaagcucaccuaccaaaauaaagucgugaagguccagagacccacaccgaccggcacggugauggacaucauuucucggaaggaucagcgcgggagcggacagguuggcacauaugggcugaacaccuucaccaauauggaagcucaacuuaucagacagauggagggagaaggcgugcuguccaaagccgaccucgagaacccucaucugcccgaaaagaaaaucacacaguggcuggagaccaagggggucgagcggcucaaacgcauggcgauuagcggcgaugacugcguggugaagcccaucgaugacagauuugccaacgcucugcuugcccugaaugauaugggaaagguucggaaagacauuccucaguggcaaccgucuaagggcuggcaugauuggcaacaggugcccuucuguucccaccacuuccaugaacucaucaugaaagacgggcgcaagcuggucgugccuugcagaccccaggacgagcuuauuggacgggcucgcaucagccaaggcgccggguggucucugagagaaacagcuugucucggaaaagccuacgcgcagauguggucccugauguauuuucaccggcgcgaucugagacucgccagcaacgcuauuugcucugccguuccugugcauuggguccccacgucccggaccacauggagcauccacgcccaucaccaguggaugaccacagaggacaugcugaccguguggaauagagucuggaucgaagauaacccuuggauggaggacaagacgcccgugaccacaugggaggauguuccguaccuuggcaagcgcgaagaccaauggugugggucccugauuggccucaccagccgggcuacaugggcccagaauaucccuaccgcgauucaacaggugagaucucugaucggaaacgaggaguuccuugauuacaugcccagcaugaaacgcuuucggaaggaggaggaauccgagggcgcuauuugguga

SEQ ID NO: 20631 - RNA, 9873 nt, Artificial Sequence
  derived and/or modified CDS sequence (opt5) from DENV-3__KJ189282__SS-prME
accagccugugccucaugaugauccugcccgccgcucuugccuuccaccugacaucccgggacggagaaccucggaugauuguggggaaaaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggcauucuggagcagggcaaacggacccuuacaccucagcccauggagcugaaguacucuuggaaaaccugggggaaggccaagaucguuacagcugaaacccagaacuccagcuucauuaucgauggaccuaauacacccgagugcccgucugcguccagagccuggaacgugugggaagucgaggacuauggcuuuggcguguucaccacgaauaucuggcuccgccugcgggaggcuuacacacaacugugugaccacagacuuaugagcgccgccgugaaagaugagcgcgcuguccaugccgacaugggguacuggauugagucccagaagaacggaucuuggaaacucgaaaaggcgagccugaucgagguuaaaaccugcaccuggccuaagucccacacacuguggucuaauggcgugcucgaaagcgauaugauuauccccaagucccuggcugggccuauuagccagcauaaccaccggcccggauaucacacccagacggccggcccuuggcaucuugggaaacuggagcucgacuuuaauuacugcgagggaacaaccguggucaucacagaaaacuguggcaccagaggccccucucugcgcacaaccacgguguccgggaagcugauccacgaguggugcugucggagcugcacccuuccgccucucagauauaugggagaagauggcuguugguacgggauggagauucggcccaucucugaaaaagaggagaauaugguuaagucccuggugagcgccggaucuggcaaagucgacaacuucacaaugggggugcugugccucgcuauucuguuugaagagguuaugcgcggaaaguucggcaagaaacauaugaucgccggcguguucuuuaccuucguccuucugcucagcgggcaaauuacauggagagauauggcgcacacccugaucaugauuggauccaaugcuagcgaccggaugggcaugggggugacguaucuggcccuuaucgccacauuuaagauccagcccuuccuggcucucggauuuuuccugagaaaacucaccucucgcgaaaaccugcuucugggcguugggcucgccauggcuacaacccugcagcugccugaggauauugaacaaauggccaauggaaucgcgcuuggccugauggcccucaagcugauuacccaguuugagacauaccagcucuggacggcucugaucucccuuaccuguagcaacacaauuuucacccugacaguggccuggcggaccgcuacgcucauccuggccggcgucucccugcuuccggugugccagucuagcuccaugagaaaaacagacuggcugcccauggccguggcugcgaugggggucccuccccucccucuguuuaucuucucucucaaggauacccugaagcgcagaagcuggccccuuaaugagggaguuauggccgugggccugguguccauucuggcuucuagccuccugcggaacgacgucccuauggccgggccccuuguggccggaggccugcucaucgcuuguuauguuauuaccgggacauccgccgaucugaccguggaaaaagcggcugacaucacaugggaggaagaggccgaacaaacgggagucagccauaaccucaugauuaccguggacgaugacggcacaaugcgcaucaaggaugacgagaccgagaauauccugacaguucuucugaaaaccgcccugcucauugugucuggcaucuuuccguacuccauuccugcuacgcugcuugucuggcacaccuggcagaagcagacacagagaagcggggugcugugggauguccccucuccucccgaaacccaaaaagccgagcucgaagagggaguguaccggaucaagcagcagggcauuuucgggaaaacacagguuggagugggcguccaaaaggaggggguguuucacaccauguggcauguuacacgcggagcggugcugacguauaacggcaagagacucgaaccgaauugggcuuccgucaaaaaggaccugaucagcuacggcgggggauggcggcuuucuacccaguggcagaaaggcgaggaagugcaagugauugccguugagccugggaagaaccccaaaaauuuccagacaaugccuggaaccuuccagaccacaacgggcgaaaucggggccaucgcucuggauuuuaagcccggaaccuccggcagccccauuaucaaccgcgagggcaaggucguggggcuguauggaaauggcguggucaccaagaacgggggauacguguccggcauugcccagaccaaugcugagccugacgggccgacacccgaacucgaggaagagauguucaagaaaagaaaccugaccaucauggaucuucacccuggcagcggaaagacgcggaaauaucugcccgccauuguucgcgaagcgaucaagagacggcucagaacacugauccucgccccuacccgcguggucgcugccgagauggaggaagcucugaagggccuucccauucgguaccaaaccacagccaccaaaucugagcauacagggagagaaaucguggaccugaugugccacgccaccuuuacgaugcgccugcucagcccuguucgggugccgaauuauaaccugauuaucauggaugaggcucauuucacagaccccgcguccauugccgcuagaggauacaucucuacccgcgucggcaugggggaagccgccgcuaucuuuaugacagccaccccucccggaacggcggaugcuuucccucagagcaaugcccccauucaggacgaggagcgggacaucccggaaagauccuggaacucuggcaaugaguggauuaccgauuuugccgggaagacagugugguucguuccuagcaucaaagcuggcaacgacauugccaacugucuucgcaagaauggcaaaaaggugauccagcugucccggaagaccuuugauacagaauaccagaaaacaaagcucaacgacugggauuucgucgugacaaccgacauuucugagaugggagcgaauuuuaaagccgauagagugaucgacccccggcgcugccugaagcccgucauccugacggaugggccugagagaguuauucucgcuggacccaugccugugacagccgcuagcgccgcucagcggcgcggcagaguggggcggaacccgcagaaagaaaaugaccaguauaucuucaccggacaaccccuuaacaaugaugaggaccacgcccacuggaccgaagcgaagaugcugcuggacaacauuaauacaccugagggcaucauucccgcccucuucgaaccugagagagagaaguccgcugccaucgauggggaauaccgccugaaaggcgagagccggaagaccuuugucgaacuuaugagacgcggagaccugcccguguggcucgcucauaaaguugccucugagggcaucaaguauacagaucggaaauggugcuucgacgggcagagaaacaaucagauucuggaagagaacauggauguggagaucuggacgaaggaaggagagaaaaagaagcugcgcccgcgguggcucgacgccagaaccuacuccgauccucuugcucugaaagaauuuaaggacuucgcggccggccgcaaaagcauugcucuggaucucgucacagagaucgggagagugcccucucaccuggcccaucggacccgcaaugcccuugacaaccugguuaugcuccacacauccgaacacggaggcagagcuuaucggcaugccguggaggagcugccugaaaccauggagacgcugcuccuucugggccugaugauucuccugaccgggggagcgaugcuuuuucugaucagcggcaaggggaucggaaaaacauccauuggccucaucugugucauugccucuagcgggaugcuguggauggcugaaaucccccugcaguggauugccuccgcuaucgugcucgaguucuuuaugaugguccuucugauuccugagcccgaaaagcaacgcaccccgcaggauaaucagcuggccuacgugguuaucggaauccucacacuggcggccauuaucgcugccaacgagaugggccuucuggaaaccacgaagagagaccucggcaugagcaaagagccugggguggugucucccacauccuaucuggaugucgaccugcaccccgcuagcgccuggacccucuacgcuguugccacaaccgugauuaccccuaugcuucggcauacaaucgaaaauucuacggcgaacgugagccuggccgcuauugccaaccaagcugucgugcugaugggacucgacaagggcuggccgaucuccaaaauggaucuggggguuccccuucuggcccucggaugcuacucucaggugaauccucugacccugacagccgcgguccuccuucugaucacccacuaugcuauuaucggccccgggcugcaggccaaggcuacaagagaggcccagaaacgcaccgccgcuggaauuaugaagaacccuacgguggacggcaucaugacaauugaucucgaccccgucaucuacgauagcaaguucgagaaacaacugggccaggugaugcuucugguucucugugccgugcagcugcugcucaugcggaccuccugggcgcuuugcgaagcccugacccuggcuacagggccuaucaccacacucugggagggaucuccgggcaaguuuuggaauacgaccauugccgucagcauggcuaacaucuucagaggguccuaucuggccggagcgggccuugccuuuagcauuaugaaaucuguggggacaggaaagcgcggcaccggcucccagggggaaacacugggagagaaauggaagaagaaacucaaucaacugagccggaaggaguucgaccuguacaaaaaguccggcaucaccgagguugauagaacggaggcuaaagaagggcucaagcggggagagauuacccaucacgccgugucucgcggcagcgcuaaacuucagugguuugucgaaagaaacauggugauccccgaggggcgggugauugaccugggauguggccgcggcgggugguccuauuacugcgccggacugaagaagguuacagaagucagaggcuauaccaaagggggaccuggccacgaggagcccgugccuaugucuacauacggguggaauaucgugaagcucaugagcggaaaagaugucuucuaccugcccccggaaaagugugacacccuucugugcgauaucggcgaguccagcccuucucccacaguugaagagucccggaccauucgcgugcucaaaaugguggagcccuggcugaagaacaaucaguucuguaucaagguccugaacccuuauaugcccacggugauugaacaucucgagagacuucagcggaaacacggcgggaugcugguucgcaauccucugagcagaaacucuacacaugaaauguacuggaucuccaauggaaccggcaacauuguggcuagcgucaauauggugucucggcuccugcuuaacagauuuaccaugacacaccgccggccgacgaucgagaaggacguugaucugggggccggaaccagacacgugaacgcggaacccgagacaccuaauauggacgucaucggcgagcgcauuaaacggaucaaggaagaacacaacagcaccuggcacuaugacgaugaaaaucccuacaaaacaugggccuaucauggguccuacgaggugaaggcuaccggaucugccagcuccaugauuaacggcguggucaagcuccugacaaaaccuugggacguugugcccauggugacccaaauggcuaugacggauaccacaccguucggccagcagagagucuuuaaggaaaaaguggacacccgcacaccucggagcauggccgggaccagacgcguuaugggaaucacggccgaguggcuguggcggacacucggcagaaauaagaaaccccgccugugcacccgggaggaguucacaaagaaggugagaaccaacgcggcuaugggggccgucuuuacggaggaaaaucaaugggauuccgccaaagcugccguggaggacgaagauuucuggaaacuuguugaccgcgagagagagcugcacaaacucggaaaguguggcucuugcguguauaacaugauggggaaacgggaaaagaaacugggcgaguuuggaaaggcuaagggcagccgcgccauuugguacauguggcuuggggcgagauaccuggaguucgaggcccucggauuucugaaugaggaucauugguucucccgggaaaacucuuauagcggcgucgagggggaaggacugcacaaacucggcuacauccugagagacaucuccaagauuccugggggcgcuauguaugccgaugacaccgcuggaugggacacacggaucaccgaggaugaccuucacaaugaagagaaaauuacacagcagauggaucccgagcaucgccagcuggccaacgcgaucuuuaagcucaccuaccaaaauaaagugguuaaggugcagagaccuacacccaccggcacggucauggacauuaucucucggaaggaucagcgcgggagcggacaggugggcacauaugggcugaacaccuucaccaauauggaagcccaacuuaucagacagauggagggagaaggcguccuguccaaagcugaccucgagaacccgcaucugccugaaaagaaaauuacacaguggcuggagaccaaggggguggagcggcucaaacgcauggccaucagcggcgaugacugcguugugaagcccauugaugacagauuugcuaacgcccugcuugcucugaaugauaugggaaagguccggaaagacaucccccaguggcaaccuucuaagggcuggcaugauuggcaacaggugccguucuguucccaccacuuccaugaacucauuaugaaagacgggcgcaagcuggugguucccugcagaccucaggacgagcuuaucggacgggcccgcauuagccaaggcgcgggguggucucugagagaaacagccugucucggaaaggcuuacgcccagauguggucccugauguauuuucaccggcgcgaucugagacucgccagcaacgcuaucugcucugccgugcccguccauugggugccuacgucccggaccacauggagcauccacgcgcaucaccaguggaugaccacagaggacaugcugaccguuuggaauagaguguggauugaagauaaccccuggauggaggacaagacgccugucaccacaugggaggaugugcccuaccuuggcaagcgcgaagaccaauggugugggucccugaucggccucaccagccgggcuacaugggcccagaauauuccgaccgccauccagcaggucagaucucugauuggaaacgaggaguuccuugauuacaugccuagcaugaaacgcuuucggaaggaggaggaauccgagggcgcuaucugguga

SEQ ID NO: 20632 - RNA, 9873 nt, Artificial Sequence
  derived and/or modified CDS sequence (opt5) from DENV-3__KJ189283__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucagaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagcccggggggcuagacgcauggccauucuuggagacaccgcgugggauuucggcuccguggggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccagaacuccagcuucaucauugauggaccuaauacacccgagugcccgucugcguccagagccuggaacgucugggaaguggaggacuauggcuuuggcguguucaccacgaauaucuggcuccgccugcgggaagucuacacacaacugugugaccacagacuuaugagcgcugccguuaaagaugagcgcgccgugcaugcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccaccggcccggauaucacacccagacggcuggcccuuggcaucuugggaaacuggagcucgacuuuaauuacugcgagggaacaaccgugguuauuacagaaaacuguggcaccagaggccccucucugcgcacaaccacgguguccgggaagcugauccacgaguggugcugucggagcugcacccuuccgccucucagauauaugggagaagauggcuguugguacgggauggagauccggcccauuucugaaaaagaggagaauauggucaagucccuggugagcgccggaucuggcaaaguugacaacuucacaaugggggugcugugccucgccauccuguuugaagaggucaugcgcggaaaguucggcaagaaacauaugauugcuggcguguucuuuaccuucguucuucugcucagcgggcaaaucacauggagagauauggcccacacccugauuaugaucggauccaaugcgagcgaccggaugggcaugggggugacguaucuggcucuuauugccacauuuaagauccagcccuuccuggcccucggauuuuuccugagaaaacucaccucucgcgaaaaccugcuucugggcgucgggcucgcuauggccacaacccugcagcugccugaggauaucgaacaaauggcuaauggaauugcccuuggccugauggcgcucaagcugaucacccaguuugagacauaccagcucuggacggcccugauuucccuuaccuguagcaaaacaaucuucacccugacaguggcuuggcggaccgccacgcucauucuggcuggcgugucccugcuuccggucugccagucuagcuccaugagaaagacagacuggcugcccauggccguugccgcuaugggggugccuccccucccucuguuuaucuucucucucaaggauacccugaaacgcagaagcuggccccuuaacgagggagugauggcggucggccugguguccauccuggccucuagccuccugcggaaugacguuccuauggcugggccccuuguggccggaggccugcucauugccuguuaugucaucaccgggacauccgcugaucugaccguggaaaaggccgcggacauuacaugggaggaagaggcugaacaaacgggaguuagccauaaccucaugaucaccguggacgaugacggcacaaugcgcauuaaagaugacgagaccgagaacauccugacaguccuucugaagaccgcccugcucaucgugucuggcauuuuuccguacuccaucccugccacgcugcuugucuggcacaccuggcagaaacagacacagagaagcggggugcugugggauguucccucuccucccgaaacccaaaaggcugagcucgaagagggaguguaccggauuaaacagcagggcaucuucgggaagacacaggucggagugggcguucaaaaggaggggguguuucacaccauguggcaugucacacgcggagccgugcugacguauaauggcaaaagacucgaaccgaacugggcguccgugaagaaagaccugauuagcuacggcgggggauggcggcuuucuacccaguggcagaagggcgaggaaguucaagucaucgcuguggagccugggaaaaaucccaagaacuuccagacaaugccuggaaccuuccagaccacaacgggcgaaauuggggccaucgcccuggauuuuaagcccggaaccuccggcagccccaucauuaaucgcgagggcaaaguggucgggcuguauggaaacggcgugguuacaaagaaugggggauacguguccggcaucgcucagaccaacgccgagccugacgggccgacacccgaacucgaggaagagauguucaaaaagagaaaucugaccauuauggaucuucacccuggcagcggaaaaacgcggaaguaucugcccgcuaucguccgcgaagccauuaagagacggcucagaacacugauccucgcgccuacccgcgugguugccgcugagauggaggaagcccugaaaggccuucccauccgguaccaaaccacagcuaccaagucugagcauacagggagagaaauuguggaccugaugugccacgccaccuuuacgaugcgccugcucagcccuguccgggugccgaacuauaaucugaucauuauggaugaggcccauuucacagaccccgcuuccaucgcggccagaggauacauuucuacccgcguuggcaugggggaagcugccgccaucuuuaugacagcuaccccucccggaacggccgaugcguucccucagagcaacgcucccauccaggacgaggagcgggacauuccggaaagauccuggaauucuggcaacgaguggaucaccgauuuugccgggaaaacagugugguucgucccuagcauuaaggccggcaaugacaucgcuaacugucuucgcaaaaacggaaagaaggugauucagcugucccggaaaaccuuugauacagaauaccaaaagaccaaacucaaugacugggauuucguggucacaaccgacaucucugagaugggcgccaacuuuaaggcggauagaguuauugacccccggcgcugccugaaacccgugauccugacggaugggccugagagagugauccucgccggacccaugccugucacagcugccagcgcugcccagcggcgcggcagaguggggcggaauccgcagaaggaaaacgaccaguauauuuucaccggacaaccccuuaauaacgaugaggaccacgcucacuggaccgaagccaagaugcugcuggacaauaucaacacaccugagggcauuauccccgcgcucuucgaaccugagagagagaaauccgccgcuauugauggggaauaccgccugaagggcgagagccggaaaaccuuuguugaacuuaugagacgcggagaccugcccguguggcucgcccauaaggucgcuucugagggcaucaaauauacagaucggaaguggugcuucgacgggcagagaaauaaccagauccuggaagagaauauggauguggagauuuggacgaaagaaggagagaagaagaaacugcgcccgcgguggcucgacgccagaaccuacuccgauccucuugcccugaaggaauuuaaagacuucgcugcgggccgcaagagcaucgcccuggaucucguuacagagauugggagagugcccucucaccuggcucaucggacccgcaacgcccuugacaaucuggucaugcuccacacauccgaacacggaggcagagccuaucggcaugcuguggaggagcugccugaaaccauggagacgcugcuccuucugggccugaugauccuccugaccgggggagccaugcuuuuucugauuagcggcaaagggaucggaaagacauccaucggccucauuugugucaucgcgucuagcgggaugcuguggauggccgaaauuccccugcaguggaucgcuuccgccauugugcucgaguucuuuaugaugguucuucugaucccugagcccgaaaagcaacgcaccccgcaggauaaccagcuggcuuacguggugauuggaauccucacacuggccgcgaucauugccgcuaaugagaugggccuucuggaaaccacgaaaagagaccucggcaugagcaaggagccuggggucguuucucccacauccuaucuggauguggaccugcaccccgccagcgcuuggacccucuacgccguggcuacaaccgucaucaccccuaugcuucggcauacaauugaaaacucuacggccaaugugagccuggcggccaucgcuaaccaagccguugugcugaugggacucgacaaaggcuggccgauuuccaagauggaucugggggucccccuucuggcucucggaugcuacucucaggugaacccucugacccugacagccgccguccuccuucugaucacccacuaugcgaucauuggccccgggcugcaggcuaaagccacaagagaggcucagaagcgcaccgccgccggaaucaugaagaauccuacgguggacggcauuaugacaaucgaucucgaccccguuauuuacgauagcaaauucgagaagcaacugggccaggugaugcuucugguccucugugcugugcagcugcugcucaugcggaccuccugggcccuuugcgaagcgcugacccuggccacagggccuaucaccacacucugggagggaucuccgggcaaauuuuggaacacgaccaucgcuguuagcauggccaauauuuucagaggguccuaucuggcuggagccggccuugcguuuagcaucaugaagucuguggggacaggaaaacgcggcaccggcucccagggggaaacacugggagagaaguggaagaaaaagcucaaccaacugagccggaaagaauucgaccuguacaagaaauccggcauuaccgaggucgauagaacggaggccaaggaagggcucaaacggggagagaucacccaucacgcugugucucgcggcagcgccaagcuucagugguuuguggaaagaaauaugguuauucccgaggggcgggucaucgaccugggauguggccgcggcgggugguccuauuacugcgcuggacugaagaaagugacagaagugagaggcuauaccaaggggggaccuggccacgaggagcccgucccuaugucuacauacggguggaacauuguuaaacucaugagcggaaaggauguguucuaccugcccccggaaaaaugugacacccuucugugcgauaucggcgaguccagcccuucucccacaguggaagagucccggaccauccgcguccucaagaugguggagcccuggcugaagaauaaccaguucuguauuaaaguucugaauccuuauaugcccacggugaucgaacaucucgagagacuucagcggaagcacggcgggaugcugguccgcaacccucugagcagaaauucuacacaugaaauguacuggauuuccaacggaaccggcaauaucguggccagcguuaacauggugucucggcuccugcuuaauagauuuaccaugacacaccgccggccgacgauugagaaagacgucgaucugggggcuggaaccagacacgugaacgccgaacccgagacaccuaacauggacgugaucggcgagcgcaucaagcggauuaaagaagagcauaauagcaccuggcacuaugacgaugaaaaccccuacaagacaugggcguaucauggguccuacgaggucaaggccaccggaucugcuagcuccaugaucaauggcguugugaaacuccugacaaagccuugggacgugguccccauggugacccaaauggccaugacggauaccacaccguucggccagcagagaguuuuuaaagaaaagguggacacccgcacaccucggagcaugcccgggaccagacgcgucaugggaauuacggcugaguggcuguggcggacacucggcagaaacaaaaagccucgccugugcacccgggaggaauucacaaagaaagugagaaccaaugccgccaugggggcgguuuuuacggaggaaaaccaaugggauuccgcuaaggccgccguggaggacgaagauuucuggaaacuugucgaccgcgagagagagcugcacaagcucggaaaauguggcucuugcguguauaauaugauggggaagcgggaaaaaaagcugggcgaguuuggaaaggcuaaaggcagccgcgccaucugguacauguggcuuggggcuagauaccuggaauucgaggcccucggauuucugaacgaggaucauugguucucccgggaaaauucuuauagcggcguugagggggaaggacugcacaagcucggcuacauucugagagacaucuccaaaauccccgggggcgcgauguaugccgaugacaccgcuggaugggacacacggauuaccgaggaugaccuucacaacgaagagaagaucacacagcagauggauccugagcaucgccagcuggccaaugcuauuuuuaaacucaccuaccaaaacaagguggucaaggugcagagacccacaccgaccggcacggucauggacaucauuucucggaaagaucagcgcgggagcggacaggugggcacauaugggcugaauaccuucaccaacauggaagcccaacuuaucagacagauggagggagaaggcguucuguccaaggcggaccucgagaauccucaccugcccgaaaaaaagaucacacaguggcuggagaccaaagggguggagcggcucaagcgcauggccauuagcggcgaugacugcgucgugaagcccaucgaugacagauuugcuaacgcccugcuugcucugaacgauaugggaaaagugcggaaggacauuccucaguggcaaccgucuaaaggcuggcaugauuggcagcagguucccuucuguucccaccacuuccaugaacucaucaugaaggacgggcgcaaacugguggucccuugcagaccccaggacgagcuuauuggacgggcccgcaucagccaaggcgcuggguggucucugagagaaacagccugucucggaaaggcguacgcccagauguggucccugauguauuuucaccggcgcgaucugagacucgcuagcaaugccauuugcucugccgugccuguucauugggugcccacgucccggaccacauggagcauccacgcucaucaccaguggaugaccacagaggacaugcugaccgucuggaacagaguguggaucgaagauaauccuuggauggaggacaagacgcccgucaccacaugggaggaugugccguaccuuggcaaacgcgaagaccaauggugugggucccugauuggccucaccagccgggccacaugggcgcagaacauccugaccgcuauucagcagguuagaucucuuaucggaaaugaggaauuccuggauuacaugccuagcaugaagcgcuuucggaaagaggaggaauccgagggcgccauuugguga

SEQ ID NO: 20633 - RNA, 9873 nt, Artificial Sequence
  derived and/or modified CDS sequence (opt5) from DENV-3__KJ189284__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggucacccugcccgaauauggcacgcuggggcucgagugcuccccucgcaccggacuggacuucaaugagaugauccuucugacaaugaaaaacaaggcuuggauggugcauagacagugguuuuucgaucucccccugccguggaccagcggcgccacaaccgaaacgccuacauggaaucggaaagagcuucuggucaccuuuaagaacgcccacgcuaaaaagcaagaagugguugugcucgggucucaggagggagcgaugcacacagcccugaccggcgcuaccgaaauucaaaauuccgggggcacaagcaucuucgccggacaucugaagugucgccucaaaauggacaagcuggagcuuaaaggcaugucuuacgccaugugcacgaacaccuuuguccugaagaaagagguguccgaaacacagcacgggaccauucucaucaagguugaguacaagggagaagaugcucccuguaaaaucccuuucagcacagaggacggccaugggaaggcccacaacggaagacugauuaccgcgaaucccguggucacgaaaaaggaggaacccgugaacaucgaggcugaaccuccguucggcgaguccaauauugugaucgggauuggcgauaacgcccugaaaaucaauugguauaagaagggaucuagcaucggcaaaauguuugaagccacagcuagaggggccagacgcauggcuauucuuggagacaccgccugggauuucggcuccguugggggaguccucaacagccugggcaagauggugcaucaaaucuuugggucugcguacaccgcccuguucuccggcgugagcugggucaugaaaauuggaaucggcgugcuccugacauggauugggcuuaauucuaagaacaccagcauguccuuuucuugcaucgcuauuggaaucaucacacuguaucucggcgccguugugcaggcugacauggggugugucauuaauuggaaaggaaaggagcugaagugcggcagcgggaucuucgugacgaacgagguucacaccuggacagaacaguacaaauuucaggccgauucccccaagcggcuggcgaccgccauugcuggcgccugggagaauggaguguguggcaucagaagcacaacccgcauggaaaaccuucucuggaaacaaauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucacagccgaaacccagaacuccagcuucaucauugauggaccuaauacacccgagugcccgucugcuuccagagcguggaacgugugggaaguggaggacuauggcuuuggcgucuucaccacgaauaucuggcuccgccugcgggaaguuuacacacaacugugugaccacagacuuaugagcgccgcugugaaagaugagcgcgccgugcaugccgacaugggguacuggaucgagucccagaagaacggaucuuggaaacucgaaaaggcuagccugauugaggucaaaaccugcaccuggccuaagucccacacacuguggucuaauggcgugcucgaaagcgauaugaucauucccaagucccuggccgggccuaucagccagcauaaccaccggcccggauaucacacccagacggcgggcccuuggcaucuugggaaacuggagcucgacuuuaauuacugcgagggaacaaccguugugauuacagaaaacuguggcaccagaggccccucucugcgcacaaccacggucuccgggaagcugauccacgaguggugcugucggagcugcacccuuccgccucucagauauaugggagaagauggcuguugguacgggauggagauccggcccauuucugaaaaagaggagaauauggugaagucccugguuagcgcuggaucuggcaaaguggacaacuucacaauggggguccugugccucgccauccuguuugaagaggugaugcgcggaaaguucggcaagaaacauaugauugccggcguuuucuuuaccuucgugcuucugcucagcgggcaaaucacauggagagauauggcucacacccugauuaugaucggauccaaugccagcgaccggaugggcaugggggucacguaucuggcgcuuauugcuacauuuaagauccagcccuuccuggcccucggauuuuuccugagaaaacucaccucucgcgaaaaccugcuucugggcguggggcucgccauggcuacaacccugcagcugccugaggauaucgaacaaauggccaauggaauugcucuuggccugauggcccucaagcugaucacccaguuugagacauaccagcucuggacggcgcugauuucccuuaccuguagcaacacaaucuucacccugacaguggccuggcggaccgcuacgcucauucuggccggcgucucccugcuuccgguuugccagucuagcuccaugagaaaaacagacuggcugcccauggcuguggccgccaugggggugccuccccucccucuguuuaucuucucucucaaggauacccugaagcgcagaagcuggccccuuaaugagggagucauggcugugggccugguuuccauccuggcgucuagccuccugcggaacgacgugccuauggccgggccccuugucgcuggaggccugcucauugccuguuaugugaucaccgggacauccgccgaucugaccguugaaaaagcugccgacauuacaugggaggaagaggcggaacaaacgggagugagccauaaccucaugaucaccgucgacgaugacggcacaaugcgcauuaaggaugacgagaccgagaauauccugacagugcuucugaaaaccgcucugcucaucgucucuggcauuuuuccguacuccaucccugccacgcugcuuguguggcacaccuggcagaagcagacacagagaagcgggguucugugggaugugcccucuccucccgaaacccaaaaagccgagcucgaagagggagucuaccggauuaagcagcagggcaucuucgggaaaacacaggugggaguuggcgugcaaaaggagggggucuuucacaccauguggcaugugacacgcggagcugugcugacguauaacggcaagagacucgaaccgaauugggccuccguuaaaaaggaccugauuagcuacggcgggggauggcggcuuucuacccaguggcagaaaggcgaggaaguccaagugaucgcgguggagccugggaagaaccccaaaaauuuccagacaaugccuggaaccuuccagaccacaacgggcgaaauuggggcuaucgcccuggauuuuaagcccggaaccuccggcagccccaucauuaaccgcgagggcaaggucguggggcuguauggaaauggcguugugaccaagaacgggggauacgucuccggcaucgcccagaccaaugcugagccugacgggccgacacccgaacucgaggaagagauguucaagaaaagaaaccugaccauuauggaucuucacccuggcagcggaaagacgcggaaauaucugcccgccaucgugcgcgaagcuauuaagagacggcucagaacacugauccucgccccuacccgcguuguggcggccgagauggaggaagcucugaagggccuucccauccgguaccaaaccacagccaccaaaucugagcauacagggagagaaauugucgaccugaugugccacgcuaccuuuacgaugcgccugcucagcccugugcggguuccgaauuauaaccugaucauuauggaugaggcccauuucacagaccccgccuccaucgcugcgagaggauacauuucuacccgcgugggcaugggggaagccgcugccaucuuuaugacagccaccccucccggaacggcugaugccuucccucagagcaaugcgcccauccaggacgaggagcgggacauuccggaaagauccuggaacucuggcaaugaguggaucaccgauuuugcugggaagacagucugguucgugccuagcauuaaagccggcaacgacaucgccaacugucuucgcaagaauggcaaaaaggugauucagcugucccggaagaccuuugauacagaauaccagaaaacaaagcucaacgacugggauuucgucguuacaaccgacaucucugagaugggagcuaauuuuaaagccgauagagugauugacccccggcgcugccugaagcccgugauccugacggaugggccugagagagucauccucgcgggacccaugccugugacagccgcuagcgccgcucagcggcgcggcagaguugggcggaacccgcagaaagaaaaugaccaguauauuuucaccggacaaccccuuaacaaugaugaggaccacgcccacuggaccgaagcuaagaugcugcuggacaacaucaauacaccugagggcauuauccccgcccucuucgaaccugagagagagaaguccgcggccauugauggggaauaccgccugaaaggcgagagccggaagaccuuuguggaacuuaugagacgcggagaccugcccgucuggcucgcucauaaaguggccucugagggcaucaaguauacagaucggaaauggugcuucgacgggcagagaaacaaucagauccuggaagagaacauggauguugagauuuggacgaaggaaggagagaaaaagaagcugcgcccgcgguggcucgacgcuagaaccuacuccgauccucuugcccugaaagaauuuaaggacuucgccgcuggccgcaaaagcaucgcgcuggaucucgugacagagauugggagaguccccucucaccuggcccaucggacccgcaaugcucuugacaaccuggugaugcuccacacauccgaacacggaggcagagccuaucggcaugccgucgaggagcugccugaaaccauggagacgcugcuccuucugggccugaugauccuccugaccgggggagcuaugcuuuuucugauuagcggcaaggggaucggaaaaacauccaucggccucauuugugugaucgccucuagcgggaugcuguggauggcggaaauuccccugcaguggaucgccuccgcuauuguucucgaguucuuuaugauggugcuucugaucccugagcccgaaaagcaacgcaccccgcaggauaaucagcuggccuacguggucauuggaauccucacacuggcugccaucauugcggccaacgagaugggccuucuggaaaccacgaagagagaccucggcaugagcaaagagccugggguugugucucccacauccuaucuggauguggaccugcaccccgcuagcgccuggacccucuacgcugucgccacaaccgugaucaccccuaugcuucggcauacaauugaaaauucuacggcuaacguuagccuggccgcgaucgccaaccaagcugugguccugaugggacucgacaagggcuggccgauuuccaaaauggaucugggggugccccuucuggcccucggaugcuacucucaggucaauccucugacccugacagcugccgugcuccuucugaucacccacuaugccaucauuggccccgggcugcaggcgaaggcuacaagagaggcccagaaacgcaccgcugccggaaucaugaagaacccuacgguugacggcauuaugacaaucgaucucgaccccgugauuuacgauagcaaguucgagaaacaacugggccaggucaugcuucuggugcucugugccguucagcugcugcucaugcggaccuccugggcucuuugcgaagcccugacccuggcgacagggccuaucaccacacucugggagggaucuccgggcaaguuuuggaauacgaccaucgccgugagcauggcuaacauuuucagaggguccuaucuggccggagcuggccuugccuuuagcaucaugaaaucugucgggacaggaaagcgcggcaccggcucccagggggaaacacugggagagaaauggaagaagaaacucaaucaacugagccggaaggaguucgaccuguacaaaaaguccggcauuaccgagguggauagaacggaggcgaaagaagggcucaagcggggagagaucacccaucacgccgugucucgcggcagcgcuaaacuucagugguuuguugaaagaaacauggucauucccgaggggcgggugaucgaccugggauguggccgcggcgggugguccuauuacugcgccggacugaagaaggugacagaagucagaggcuauaccaaagggggaccuggccacgaggagcccguuccuaugucuacauacggguggaauauugugaagcucaugagcggaaaagauguguucuaccugcccccggaaaagugugacacccuucugugcgauaucggcgaguccagcccuucucccacagucgaagagucccggaccauccgcgugcucaaaaugguugagcccuggcugaagaacaaucaguucuguauuaaggugcugaacccuuauaugcccacggucaucgaacaucucgagagacuucagcggaaacacggcgggaugcuggugcgcaauccucugagcagaaacucuacacaugaaauguacuggauuuccaauggaaccggcaacaucguugcuagcgugaauauggucucucggcuccugcuuaacagauuuaccaugacacaccgccggccgacgauugagaaggacguggaucugggggccggaaccagacacgugaacgcugaacccgagacaccuaauauggacgucaucggcgagcgcaucaaacggauuaaggaagaacacaacagcaccuggcacuaugacgaugaaaaucccuacaaaacaugggccuaucauggguccuacgagguuaaggcgaccggaucugccagcuccaugaucaacggcguggugaagcuccugacaaaaccuugggacgucgugcccaugguuacccaaauggcuaugacggauaccacaccguucggccagcagagaguguuuaaggaaaaagucgacacccgcacaccucggagcaugcccgggaccagacgcgugaugggaauuacggccgaguggcuguggcggacacucggcagaaauaagaaaccucgccugugcacccgggaggaguucacaaagaagguuagaaccaacgcugccaugggggccguguuuacggaggaaaaucaaugggauuccgcgaaagcugccgucgaggacgaagauuucuggaaacuuguggaccgcgagagagagcugcacaaacucggaaaguguggcucuugcguuuauaacaugauggggaaacgggaaaagaaacugggcgaguuuggaaaggccaagggcagccgcgcuaucugguacauguggcuuggggccagauaccuggaguucgaggcucucggauuucugaaugaggaucauugguucucccgggaaaacucuuauagcggcguggagggggaaggacugcacaaacucggcuacauucugagagacaucuccaagauccccgggggcgccauguaugcggaugacaccgccggaugggacacacggauuaccgaggaugaccuucacaaugaagagaaaaucacacagcagauggauccugagcaucgccagcuggcuaacgccauuuuuaagcucaccuaccaaaauaaagucgugaagguccagagacccacaccgaccggcacggugauggacaucauuucucggaaggaucagcgcgggagcggacagguuggcacauaugggcugaacaccuucaccaauauggaagcucaacuuaucagacagauggagggagaaggcgugcuguccaaagccgaccucgagaacccucaucugcccgaaaagaaaaucacacaguggcuggagaccaagggggucgagcggcucaaacgcauggcgauuagcggcgaugacugcguggugaagcccaucgaugacagauuugccaacgcucugcuugcccugaaugauaugggaaagguucggaaagacauuccucaguggcaaccgucuaagggcuggcaugauuggcaacaggugcccuucuguucccaccacuuccaugaacucaucaugaaagacgggcgcaagcuggucgugccuugcagaccccaggacgagcuuauuggacgggcucgcaucagccaaggcgccggguggucucugagagaaacagcuugucucggaaaagccuacgcgcagauguggucccugauguauuuucaccggcgcgaucugagacucgccagcaacgcuauuugcucugccguuccugugcauuggguccccacgucccggaccacauggagcauccacgcccaucaccaguggaugaccacagaggacaugcugaccguguggaauagagucuggaucgaagauaacccuuggauggaggacaagacgcccgugaccacaugggaggauguuccguaccuuggcaagcgcgaagaccaauggugugggucccugauuggccucaccagccgggcuacaugggcccagaauaucccuaccgcgauucaacaggugagaucucugaucggaaacgaggaguuccuugauuacaugcccagcaugaaacgcuuucggaaggaggaggaauccgagggcgcuauuugguga

SEQ ID NO: 20634 - RNA, 9873 nt, Artificial Sequence
  derived and/or modified CDS sequence (opt5) from DENV-3__KJ189286__SS-prME
accagcuucugccugaugaugauccuccccgccgcucuggccuuucaccuuacaucccgggacggcgagccucggaugauuguggggaagaaugaacgcggaaaaucucuccuguucaagacggcgagcggcaucaauauguguacccugauugcuauggaucuuggggagaugugcgacgauacagugaccuacaaauguccgcauaucacagaaguugagcccgaagacauugauugcugguguaaccugaccuccacaugggugaccuauggaacgugcaaucaggccggcgagcaccggcgggacaagcgcucuguggcccucgcuccucaugucgggaugggacuggauaccagaacacaaaccuggaugagcgccgagggcgcuuggagacagguggaaaaaguugagacaugggcccugcgccaccccggcuuuaccauccucgcgcuguuccuugcccauuacaucgggacgucccugacacagaagguggucauuuuuauccuccugaugcuugugaccccuucuaugacaaugagauguguuggagugggcaaccgggacuucgucgaagggcugagcggagcuaccuggguggaugugguccucgagcacggcgggugcguuaccacaauggccaagaauaaacccacgcuggacauugagcugcagaagaccgaagcuacacaacucgccacccugcgcaaacuuuguaucgagggaaagauuacaaacaucaccacggauuccagaugcccuacacagggcgaagcggugcugccggaggaacaggaccagaauuauguguguaaacacaccuacgucgaucggggcugggggaacggaugcggccucuuugggaagggaagccuggugaccugcgccaaguuccaaugucuugagcccauugagggcaaaguugugcaguaugaaaaucugaaguacacagucaucaucaccgugcauacaggggaccagcaccagguuggaaacgagacgcaaggcgugaccgcugaaauuacaccucaggccucuaccacagaggcuacccuccccgaauauggcacgcuggggcuggagugcuccccucgcaccggacucgacuuuaaugagaugauccugcuuacaaugaaaaacaaggccuggaugguccauagacagugguucuuugaucugccccucccguggaccagcggcgccacaaccgaaacgccuacauggaaucggaaagagcugcuugugaccuucaagaacgcucacgcgaaaaagcaagaagucgugguucuggggucucaggagggagccaugcacacagcucucaccggcgccaccgaaauucaaaauuccgggggcacaagcaucuuugccggacaucugaagugucgccugaaaauggacaagcucgagcugaaaggcaugucuuacgcuaugugcacgaacaccuucgugcuuaagaaagaggucuccgaaacacagcacgggaccauucugaucaagguggaguacaagggagaagaugcccccuguaaaaucccuuucagcacagaggacggccaugggaaggcgcacaacggaagacucauuaccgcuaaucccguugugacgaaaaaggaggaacccgucaacaucgaggccgaaccuccguuuggcgaguccaauauugugaucgggauuggcgauaacgcccugaaaaucaauugguauaagaagggaucuagcaucggcaaaauguucgaagcuacagccagaggggcuagacgcauggccauucugggagacaccgcgugggauuuuggcuccgucgggggaguucuuaacagccucggcaagaugguccaucaaaucuucgggucugccuacaccgcucuguuuuccggcgugagcugggugaugaaaauuggaaucggcguccugcucacauggauugggcucaauucuaagaacaccagcauguccuucucuugcaucgccauuggaaucaucacacuuuaucugggcgcugugguucaggccgacauggggugugugauuaauuggaaaggaaaggagcucaagugcggcagcgggaucuuugucacgaacgaggugcacaccuggacagaacaguacaaauuccaggcggauucccccaagcggcuggccaccgcuauugccggcgcuugggagaauggaguuuguggcaucagaagcacaacccgcauggaaaaccugcuuuggaaacaaauugccaaugagcucaacuauauccugugggaaaauaacaucaagcugacgguggucgugggggacauuaucggaguucucgagcagggcaaacggacccugacaccucagcccauggagcuuaaguacucuuggaaaaccugggggaaggccaagauugugacagcugaaacccagaacuccagcuuuaucauugauggaccuaauacacccgagugcccgucugcguccagagccuggaacgucugggaaguggaggacuauggcuucggcguguuuaccacgaauaucuggcugcgccuccgggaagucuacacacaacugugugaccacagacugaugagcgcugccguuaaagaugagcgcgccgugcaugcugacaugggguacuggaucgagucccagaagaacggaucuuggaaacuugaaaaggccagccucauugaggugaaaaccugcaccuggccuaagucccacacacuguggucuaauggcguccuggaaagcgauaugaucauucccaagucccucgcggggccuaucagccagcauaaccaccggcccggauaucacacccagacggcuggcccuuggcaucuggggaaacuugagcuggacuucaauuacugcgagggaacaaccgugguuauuacagaaaacuguggcaccagaggccccucucuccgcacaaccacgguguccgggaagcugauccacgaguggugcugucggagcugcacccugccgccucuuagauauaugggagaagauggcuguugguacgggauggagauccggcccauuucugaaaaagaggagaauauggucaagucccucgugagcgccggaucuggcaaaguugacaacuuuacaaugggggugcugugccuggccauccucuucgaagaggucaugcgcggaaaguucggcaagaaacauaugauugcuggcguguuuuucaccuuuguucugcuucugagcgggcaaaucacauggagagauauggcccacacccucauuaugaucggauccaaugcgagcgaccggaugggcaugggggugacguaucuggcucugauugccacauucaagauccagcccuuucuugcccugggauucuuucucagaaaacugaccucucgcgaaaaccuccugcuuggcgucgggcuggcuauggccacaacccuccagcugccugaggauaucgaacaaauggcuaauggaauugcccugggccuuauggcgcugaagcucaucacccaguucgagacauaccagcuguggacggcccucauuucccugaccuguagcaacacaaucuuuacccuuacaguggcuuggcggaccgccacgcugauucucgcuggcgugucccugcugccggucugccagucuagcuccaugagaaaaacagacuggcuucccauggccguugccgcuaugggggugccuccccugccucucuucaucuuuaaucugaaggauacccucaagcgcagaucuuggccccugaacgagggagugauggcggucggccuugugagcauccuggccuccucucugcuccggaacgacguuccuauggcugggccccugguggccggaggccuucugauugccuguuaugucaucaccgggacaagcgcugaucucaccguggaaaaagccgcggacauuacaugggaggaagaggcugaacaaacgggaguuucccauaaucugaugaucaccguggacgaugacggcacaaugcgcauuaaggaugacgagaccgagaacauccucacaguccugcuuaaaaccgcccugcugaucgugagcggcauuuucccguacucuaucccugccacgcuccuggucuggcacaccuggcagaagcagacacagagauccggggugcuuugggauguucccagcccucccgaaacccaaaaagcugagcuggaagagggaguguaccggauuaagcagcagggcaucuuugggaaaacacaggucggagugggcguucaaaaggaggggguguuccacaccauguggcaugucacacgcggagccgugcucacguauaauggcaagagacuggaaccgaacugggcgucugugaaaaaggaccucauuuccuacggcgggggauggcggcugagcacccaguggcagaaaggcgaggaaguucaagucaucgcuguggagccugggaagaaucccaaaaacuuccagacaaugccuggaaccuuucagaccacaacgggcgaaauuggggccaucgcccuugauuucaagcccggaaccucuggcucccccaucauuaaucgcgagggcaagguggucgggcuguauggaaacggcgugguuaccaaaaaugggggauacgugagcggcaucgcucagaccaacgccgagccugacgggccgacacccgaacuggaggaagagauguuuaagaaaagaaaucucaccauuauggaucugcacccuggcuccggaaagacgcggaaauaucuucccgcuaucguccgcgaagccauuaagagacggcugagaacacucauccuggcgccuacccgcgugguugccgcugagauggaggaagcccucaagggccugcccauccgguaccaaaccacagcuaccaaaagcgagcauacagggagagaaauuguggaccuuaugugccacgccaccuucacgaugcgccugcugucuccuguccgggugccgaacuauaaucucaucauuauggaugaggcccauuuuacagaccccgcuagcaucgcggccagaggauacauuuccacccgcguuggcaugggggaagcugccgccaucuucaugacagcuaccccucccggaacggccgaugcguuuccucagucuaacgcucccauccaggacgaggagcgggacauuccggaaagaagcuggaacuccggcaacgaguggaucaccgauuucgccgggaagacagugugguuugucccuucuauuaaagccggcaacgacaucgcuaauugucugcgcaagaacggcaaaaaggugauucagcuuagccggaagaccuucgauacagaauaccagaaaacaaagcugaaugacugggauuuuguggucacaaccgacaucuccgagaugggagccaacuucaaagcggauagaguuauugacccccggcgcugccucaagcccgugauccugacggaugggccugagagagugauccuggccggacccaugccugucacagcugccucugcugcccagcggcgcggcagaguggggcggaauccgcagaaagaaaacgaccaguauauuuucaccggacaaccccucaauaacgaugaggaccacgcucacuggaccgaagccaagaugcuucuggacaauaucaacacaccugagggcauuauccccgcgcuguuugaaccugagagagaaaagagcgccgcuauugauggggaauaccgccucaaaggcgagucccggaagaccuucguugaacugaugagacgcggagaccuucccguguggcuggcccauaaagucgcuagcgagggcaucaaguauacagaucggaaauggugcuuugacgggcagagaaauaaccagauccucgaagagaauauggauguggagauuuggacgaaggaaggagagaaaaagaagcugcgcccgcgguggcuggacgccagaaccuacucugauccucucgcccuuaaagaguucaaggacuuugcugcgggccgcaaauccaucgcccuggaucugguuacagagauugggagagugcccagccaccucgcucaucggacccgcaacgcccuggacaaucuugucaugcugcacacaucugaacacggaggcagagccuaucggcaugcuguggaggagcucccugaaaccauggagacgcugcugcuccuuggccugaugauccugcucaccgggggagccaugcuguuccuuauuuccggcaaggggaucggaaaaacaagcaucggccugauuugugucaucgcguccucugggaugcucuggauggccgaaauuccccugcaguggaucgcuagcgccauugugcuggaguuuuucaugaugguucuccuuaucccugagcccgaaaagcaacgcaccccgcaggauaaccagcuggcuuacguggugauuggaauccugacacucgccgcgaucauugccgcuaaugagaugggccugcuugaaaccacgaagagagaccugggcauguccaaagagccuggggucguuagccccacaucuuaucucgauguggaccugcaccccgccuccgcuuggacccuguacgccguggcuacaaccgucaucaccccuaugcuccggcauacaauugaaaacagcacggccaacgugucucuugcggccaucgcuaaucaagccguugugcugaugggacuggacaagggcuggccgauuagcaaaauggaucucggggucccccugcuugcucugggaugcuacucccaggugaacccucucacccugacagccgccguccugcuccuuaucacccacuaugcgaucauuggccccgggcugcaggcuaaggccacaagagaggcucagaaacgcaccgccgccggaaucaugaagaauccuacgguggacggcauuaugacaaucgaucuggaccccguuauuuacgauucuaaguuugagaaacaacucggccaggugaugcugcuuguccugugugcugugcagcuccugcugaugcggaccagcugggcccucugcgaagcgcuuacccuggccacagggccuaucaccacacugugggagggauccccgggcaaguucuggaacacgaccaucgcuguuucuauggccaauauuuuuagagggagcuaucucgcuggagccggccuggcguucuccaucaugaaaagcguggggacaggaaagcgcggcaccggcucucagggggaaacacuuggagagaaauggaagaagaaacugaaccaacucucccggaaggaauuugaccuguacaaaaagagcggcauuaccgaggucgauagaacggaggccaaagaagggcugaagcggggagagaucacccaucacgcugugucccgcggcucugccaaacuccagugguucguggaaagaaauaugguuauucccgaggggcgggucaucgaccuuggauguggccgcggcggguggagcuauuacugcgcuggacugaagaaggugacagaagugagaggcuauaccaaagggggaccuggccacgaggagcccgucccuauguccacauacggguggaacauuguuaagcugaugucuggaaaagauguguucuaccugcccccggaaaagugugacacccugcuuugcgauaucggcgagagcuccccuagccccacaguggaagagucucggaccauccgcguccugaaaaugguggagcccuggcucaagaauaaccaguuuuguauuaagguucugaauccuuauaugcccacggugaucgaacaucuggagagacuccagcggaaacacggcgggaugcuuguccgcaacccucuguccagaaauagcacacaugaaauguacuggauuucuaacggaaccggcaauaucguggccuccguuaacauggugagccggcugcuccugaacagauucaccaugacacaccgccggccgacgauugagaaggacgucgaucuuggggcuggaaccagacacgugaaugccgaacccgagacaccuaacauggacgugaucggcgagcgcaucaaacggauuaaggaggaacauaauucuaccuggcacuaugacgaugaaaaccccuacaaaacaugggcguaucaugggagcuacgaggucaaggccaccggauccgcuucuagcaugaucaauggcguugugaagcugcucacaaaaccuugggacgugguccccauggugacccaaauggccaugacggauaccacaccguuuggccagcagagaguuuucaaggaaaaaguggacacccgcacaccucgguccaugcccgggaccagacgcgucaugggaauuacggcugaguggcuguggcggacacugggcagaaacaagaaaccucgccucugcacccgggaggaauuuacaaagaaggugagaaccaaugccgccaugggggcgguuuucacggaggaaaaccaaugggauagcgcuaaagccgccguggaggacgaagauuuuuggaagcuggucgaccgcgagagagagcuucacaaacugggaaaguguggcuccugcguguauaauaugauggggaaacgggaaaagaaacucggcgaguucggaaaggcuaagggcucucgcgccaucugguacauguggcugggggcuagauaccuugaauuugaggcccugggauuccucaacgaggaucauugguuuagccgggaaaauuccuauucuggcguugagggggaaggacugcacaaacugggcuacauucucagagacaucagcaagauccccgggggcgcgauguaugccgaugacaccgcuggaugggacacacggauuaccgaggaugaccugcacaacgaagagaaaaucacacagcagauggauccugagcaucgccagcuugccaaugcuauuuucaagcugaccuaccaaaacaaaguggucaaggugcagagacccacaccgaccggcacggucauggacaucauuucccggaaggaucagcgcgggucuggacaggugggcacauaugggcucaauaccuuuaccaacauggaagcccaacugaucagacagauggagggagaaggcguucuuagcaaagcggaccuggagaacccucaccuccccgaaaagaaaaucacacaguggcuggagaccaaggggguggagcggcugaaacgcauggccauuuccggcgaugacugcgucgugaagcccaucgaugacagauucgcuaaugcccuccuggcucuuaacgauaugggaaaggugcggaaagacauuccucaguggcaaccgagcaagggcuggcaugauuggcagcagguucccuucuguucucaccacuuucaugaacugaucaugaaagacgggcgcaagcucguggucccuugcagaccccaggacgagcugauuggacgggcccgcaucucccaaggcgcuggguggagccuuagagaaacagccugucugggaaaagcguacgcccagauguggucucucauguauuuccaccggcgcgaucugagacuggcuuccaaugccauuugcagcgccgugccuguucauugggugcccacgucucggaccacaugguccauccacgcucaucaccaguggaugaccacagaggacaugcucaccgucuggaacagaguguggaucgaagauaauccuuggauggaggacaagacgcccgucaccacaugggaggaugugccguaccugggcaagcgcgaagaccaauggugugggagccuuauuggccugaccucccgggccacaugggcgcagaacaucccuaccgcuauucagcagguuagaagccucaucggaaaugaggaauuucuggauuacaugcccucuaugaaacgcuuccggaaggaggaggaaagcgagggcgccauuugguga

SEQ ID NO: 20635 - RNA, 9873 nt, Artificial Sequence
  derived and/or modified CDS sequence (opt5) from DENV-3__KJ189287__SS-prME
accagccugugccucaugaugauccugcccgccgcucuugccuuccaccugacaucccgggacggagaaccucggaugauuguggggaagaaugaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggcauucuggagcagggcaaacggacccuuacaccucagcccauggagcugaaguacucuuggaaaaccugggggaaggccaagaucguuacagcugaaacccagaacuccagcuucauuaucgauggaccuaauacacccgagugcccgucugcguccagagccuggaacgugugggaagucgaggacuauggcuuuggcguguucaccacgaauaucuggcuccgccugcgggaaguguacacacaacugugugaccacagacuuaugagcgcugccgucaaagaugagcgcgccguucaugcugacaugggguacuggauugagucccagaagaacggaucuuggaaacucgaaaaggccagccugaucgaggugaaaaccugcaccuggccuaagucccacacacuguggucuaauggcgugcucgaaagcgauaugauuauccccaagucccuggcggggccuauuagccagcauaaccaccggcccggauaucacacccagacggcuggcccuuggcaucuugggaaacuggagcucgacuuuaauuacugcgagggaacaaccgucgugaucacagaaaacuguggcaccagaggccccucucugcgcacaaccacgguuuccgggaagcugauccacgaguggugcugucggagcugcacccuuccgccucucagauauaugggagaagauggcuguugguacgggauggagauucggcccaucucugaaaaagaggagaauauggugaagucccuggucagcgccggaucuggcaaaguggacaacuucacaauggggguucugugccucgccauucuguuugaagaggugaugcgcggaaaguucggcaagaaacauaugaucgcuggcgucuucuuuaccuucgugcuucugcucagcgggcaaauuacauggagaaauauggcccacacccugaucaugauuggauccaacgcgagcgaucggaugggcauggggguuacguaucuggcucuuaucgccacauuuaagauccagcccuuccuggugcucggauuuuuccugagaaaacucaccucucgcgaaaaucugcuucugggcgucgggcucgccauggcuacaacccugcagcugccugaggacauugaacaaauggccaacggaaucgcucuuggccugauggcccucaagcugauuacccaguuugagacauaccagcucuggacggcgcugaucucccuuaccuguagcaauacaauuuucacccugacaguggccuggcggaccgcuacgcucauccuggccggcgugucccugcuuccggucugccagucuagcuccaugagaaaaacagauuggcugcccauggcuguugccgccaugggggugccuccccucccucuguuuaucuucucucucaaggacacccugaagcgcagaagcuggccccuuaacgagggagugauggcugucggccugguguccauucuggcgucuagccuccugcggaacgauguuccuauggccgggccccuuguggcuggaggccugcucaucgccuguuaugucauuaccgggacauccgccgaccugaccguggaaaaagcugccgauaucacaugggaggaagaggcggaacaaacgggaguuagccauaaucucaugauuaccguggacgacgauggcacaaugcgcaucaaggacgaugagaccgagaacauccugacaguccuucugaaaaccgcucugcucauugugucuggcaucuuuccguacuccauuccugccacgcugcuugucuggcacaccuggcagaagcagacacagagaagcggggugcugugggacguucccucuccucccgaaacccaaaaagccgagcucgaagagggaguguaccggaucaagcagcagggcauuuucgggaaaacacaggucggagugggcguucaaaaggaggggguguuucacaccauguggcaugucacacgcggagcugugcugacguauaauggcaagagacucgaaccgaacugggccuccgugaaaaaggaucugaucagcuacggcgggggauggcggcuuucuacccaguggcagaaaggcgaggaaguucaagucauugcgguggagccugggaagaaucccaaaaacuuccagacaaugccuggaaccuuccagaccacaacgggcgaaaucggggcuaucgcccuggacuuuaagcccggaaccuccggcagccccauuaucaaucgcgagggcaagguggucgggcuguauggaaacggcgugguuaccaagaaugggggauacguguccggcauugcccagaccaacgcugagccugaugggccgacacccgaacucgaggaagagauguucaagaaaagaaaucugaccaucauggaccuucacccuggcagcggaaagacgcggaaauaucugcccgccauuguccgcgaagcuaucaagagacggcucagaacacugauccucgccccuacccgcgugguugcggccgagauggaggaagcucugaagggccuucccauucgguaccaaaccacagccaccaaaucugagcauacagggagagaaaucguggaucugaugugccacgcuaccuuuacgaugcgccugcucagcccuguccgggugccgaacuauaaucugauuaucauggacgaggcccauuucacagaucccgccuccauugcugcgagaggauacaucucuacccgcguuggcaugggggaagccgcugccaucuuuaugacagccaccccucccggaacggcugacgccuucccucagagcaacgcgcccauucaggaugaggagcgggacaucccggaaagauccuggaacucuggcaacgaguggauuaccgacuuugcugggaagacagugugguucgucccuagcaucaaagccggcaacgauauugccaauugucuucgcaagaacggcaaaaaggugauccagcugucccggaagaccuuugacacagaauaccagaaaacaaagcucaaugauugggacuucguggucacaaccgauauuucugagaugggagcuaacuuuaaagccgacagaguuaucgauccccggcgcugccugaagcccgugauccugacggacgggccugagagagugauucucgcgggacccaugccugucacagccgcuagcgccgcucagcggcgcggcagaguggggcggaauccgcagaaagaaaacgaucaguauaucuucaccggacaaccccuuaauaacgacgaggaucacgcccacuggaccgaagcuaagaugcugcuggacaauauuaacacaccugagggcaucauucccgcccucuucgaaccugagagagagaaguccgcggccaucgacggggaauaccgccugaaaggcgagagccggaagaccuuuguugaacuuaugagacgcggagaucugcccguguggcucgcucauaaagucgccucugagggcaucaaguauacagaccggaaauggugcuucgaugggcagagaaauaaccagauucuggaagagaauauggacguggagaucuggacgaaggaaggagagaaaaagaagcugcgcccgcgguggcucgaugcuagaaccuacuccgacccucuugcccugaaagaauuuaaggauuucgccgcuggccgcaaaagcauugcgcuggaccucguuacagagaucgggagagugcccucucaccuggcccaucggacccgcaacgcucuugauaaucuggucaugcuccacacauccgaacacggaggcagagccuaucggcaugccguggaggagcugccugaaaccauggagacgcugcuccuucugggccugaugauucuccugaccgggggagcuaugcuuuuucugaucagcggcaaggggaucggaaaaacauccauuggccucaucugugucauugccucuagcgggaugcuguggauggcggaaaucccccugcaguggauugccuccgcuaucgugcucgaguucuuuaugaugguucuucugauuccugagcccgaaaagcaacgcaccccgcaggacaaccagcuggccuacguggugaucggaauccucacacuggcugccauuaucgcggccaaugagaugggccuucuggaaaccacgaagagagaucucggcaugagcaaagagccuggggucguuucucccacauccuaucuggacguggaucugcaccccgcuagcgccuggacccucuacgcuguggccacaaccgucauuaccccuaugcuucggcauacaaucgaaaacucuacggcuaacgugagccuggccgcgauugccaaucaagcuguugugcugaugggacucgacaagggcuggccgaucuccaaaauggaccugggggucccccuucuggcccucggaugcuacucucaggugaacccucugacccugacagcugccguccuccuucugaucacccacuaugccauuaucggccccgggcugcaggcgaaggcuacaagagaggcccagaaacgcaccgcugccggaauuaugaagaauccuacgguggauggcaucaugacaauugaccucgaucccguuaucuacgacagcaaguucgagaaacaacugggccaggugaugcuucugguccucugugccgugcagcugcugcucaugcggaccuccugggcucuuugcgaagcccugacccuggcgacagggccuaucaccacacucugggagggaucuccgggcaaguuuuggaacacgaccauugccguuagcauggcuaauaucuucagaggguccuaucuggccggagcuggccuugccuuuagcauuaugaaaucuguggggacaggaaagcgcggcaccggcucccagggggaaacacugggagagaaauggaagaagaaacucaaccaacugagccggaaggaguucgaucuguacaaaaaguccggcaucaccgaggucgacagaacggaggcgaaagaagggcucaagcggggagagauuacccaucacgccgugucucgcggcagcgcuaaacuucagugguuuguggaaagaaauaugguuauccccgaggggcgggucauugaucugggauguggccgcggcgggugguccuauuacugcgccggacugaagaaggugacagaagugagaggcuauaccaaagggggaccuggccacgaggagcccgucccuaugucuacauacggguggaacaucguuaagcucaugagcggaaaagacguguucuaccugcccccggaaaagugugauacccuucugugcgacaucggcgaguccagcccuucucccacaguggaagagucccggaccauucgcguccucaaaaugguggagcccuggcugaagaauaaccaguucuguaucaagguucugaauccuuauaugcccacggugauugaacaucucgagagacuucagcggaaacacggcgggaugcugguccgcaacccucugagcagaaauucuacacaugaaauguacuggaucuccaacggaaccggcaauauuguggcuagcguuaacauggugucucggcuccugcuuaacagauuuaccaugacacaccgccggccgacgaucgagaaggaugucgaccugggggccggaaccagacacgugaaugcugaacccgagacaccuaacauggaugugaucggcgagcgcauuaaacggaucaaggaagaacacaauagcaccuggcacuaugacgacgaaaaccccuacaaaacaugggccuaucauggguccuacgaggucaaggcgaccggaucugccagcuccaugauuaauggcguugugaagcuccugacaaaaccuugggaugugguccccauggugacccaaauggcuaugacggacaccacaccguucggccagcagagaguuuuuaaggaaaaaguggauacccgcacaccucggagcauggccgggaccagacgcgucaugggaaucacggcugaguggcuguggcggacacucggcagaaacaagaaaccccgccugugcacccgggaggaguucacaaagaaggugagaaccaaugccgccaugggggcgguuuuuacggaggaaaaccaaugggacuccgcuaaagccgccguggaggaugaagacuucuggaaacuugucgaucgcgagagagagcugcacaaacucggaaaguguggcucuugcguguauaauaugauggggaaacgggaaaagaaacugggcgaguuuggaaaggcuaagggcagccgcgccauuugguacauguggcuuggggcuagauaccuggaguucgaggcccucggauuucugaacgaggaccauugguucucccgggaaaauucuuauagcggcguugagggggaaggacugcacaaacucggcuacauccugagagauaucuccaagauuccugggggcgcgauguaugccgacgauaccgcuggaugggacacacggaucaccgaggacgaucuucacaacgaagagaaaauuacacagcagauggaccccgagcaucgccagcuggccaaugcuaucuuuaagcucaccuaccaaaacaaaguggucaaggugcagagaccuacacccaccggcacggucauggauauuaucucucggaaggaccagcgcgggagcggacaggugggcacauaugggcugaauaccuucaccaacauggaagcccaacuuaucagacagauggagggagaaggcguucuguccaaagcggaucucgagaacccgcaucugccugaaaagaaaauuacacaguggcuggagaccaaggggguggagcggcucaaacgcauggccaucagcggcgacgauugcgucgugaagcccauugacgauagauuugcuaaugcccugcuugcucugaacgacaugggaaaggugcggaaagauaucccccaguggcaaccuucuaagggcuggcaugacuggcagcagguuccguucuguucccaccacuuccaugaacucauuaugaaagaugggcgcaagcuggugguccccugcagaccucaggacgagcuuaucggacgggcccgcauuagccaaggcgcuggguggucucugagagaaacagccugucucggaaaagcguacgcccagauguggucccugauguauuuucaccggcgcgaccugagacucgcuagcaaugccaucugcucugccgugcccguucauugggugccuacgucccggaccacauggagcauccacgcucaucaccaguggaugaccacagaggauaugcugaccgucuggaacagaguguggauugaagacaaucccuggauggaggauaagacgccugucaccacaugggaggacgugcccuaccuuggcaagcgcgaagaucaauggugugggucccugaucggccucaccagccgggccacaugggcgcagaacauuccgaccgcuauccagcagguuagaucucugauuggaaaugaggaguuccuugacuacaugccuagcaugaaacgcuuucggaaggaggaggaauccgagggcgccaucugguga

SEQ ID NO: 20636 - RNA, 9873 nt, Artificial Sequence
  derived and/or modified CDS sequence (opt5) from DENV-3__KJ189288__SS-prME
acaagccugugccucaugaugauccugcccgccgcucuugccuuccaccugacaucccgggacggagaaccucggaugauuguggggaagaacgaacgcggaaaaucucuccuguuuaagacggcgagcggcaccaauauguguacacuuaucgcuauggaucugggggaaaugugcgacgauaccgugacauacaaauguccgcauauuaccgaaguugaacccgaagacaucgauugcugguguaaccucacauccaccugggugacguauggaaccugcaaucaggccggcgaacacagacgggacaagcgcucuguggcccuggcuccucaugucgggaugggacuggauacaagaacccagacauggaugagcgccgagggcgcuuggcggcaaguggaaaaaguugagaccugggcccuccgccaccccggcuucacgauucuggcgcuuuuucuggcccauuacaucgggacaucccucacccagaagguggucaucuucauucugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccaacuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucaaugucuggagcccaucgagggcaaaaugguucaguaugaaaaucucaaguacaccgugauuaucacaguccauacgggggaccagcaccaggugggaaacgagacccaaggcguuacagcugaaaucaccccucaggccucuacaaccgaggcuacgcugcccgaauauggcacccuggggcucgagugcuccccucgcacaggacuggacuucaaugagaugauucuucugaccaugaaaaacaaggccuggauggugcauagacagugguuuuucgaucucccccugccguggacaagcggcgccaccacggaaacaccuaccuggaaucggaaagagcuucuggucacauuuaagaacgcucacgcgaaaaagcaagaaguggucgugcucgggucucaggagggagccaugcacaccgcucugaccggcgccacagaaauccaaaauuccgggggcacgagcauuuucgccggacaucugaagugucgccucaaaauggacaagcuggagcuuaaaggcaugucuuacgcuaugugcaccaacacauuuguucugaagaaagagguguccgaaacccagcacgggacaauccucauuaaggucgaguacaagggagaagaugcccccuguaaaaucccuuucagcaccgaggacggccaugggaaggcgcacaacggaagacugaucacggcuaaucccgugguuaccaagaaggaggaacccgugaacauugaggccgaaccuccguucggcgaguccaauaucgucauugggaucggcgauaacgcccugaaaauuaauugguauaagaagggaucuagcaucggcaaaauguuugaagcuaccgccagaggggcuagacgcauggccauccuuggagacaccgcgugggauuucggcuccgucgggggagugcucaacagccugggcaagaugguucaucaaauuuuugggucugccuacacagcucuguucuccggcgucagcugggugaugaaaaucggaauuggcgugcuccugaccuggaucgggcuuaauucuaagaacacaagcauguccuuuucuugcauugccaucggaauuaucacgcuguaucucggcgcugucgugcaggccgacaugggguguguuaucaauuggaaaggaaaggagcugaagugcggcagcgggauuuucgugaccaacgagguccacacauggaccgaacaguacaaauuucaggcggauucccccaagcggcuggccacagcuaucgccggcgcuugggagaauggaguguguggcauuagaagcaccacgcgcauggaaaaccuucucuggaaacaaaucgccaaugagcugaacuauauucugugggaaaauaacguuaagcucaccguggucgugggggacaucaucggaguucuggagcagggcaaacggacacuuaccccucagcccauggagcugaaguacucuuggaaaacaugggggaaggccaagauugugaccgcugaaacacagaacuccagcuucaucauugauggaccuaauacccccgagugcccgucugcguccagagccuggaacgucugggaaguggaggacuauggcuuuggcguguucacgacaaauaucuggcuccgccugcgggaggcuuacacccaacugugugaccacagacuuaugagcgccgccgucaaagaugagcgcgcuguucaugccgacaugggguacuggauugagucccagaagaacggaucuuggaaacucgaaaaggcgagccugaucgaggugaaaaccugcacauggccuaagucccacacccuguggucuaauggcgugcucgaaagcgauaugaucauucccaagucccuggcugggccuaucagccagcauaaccaccggcccggauaucacacgcagacagccggcccuuggcaucuugggaaacuggagcucgacuuuaauuacugcgagggaaccacagucgugauuaccgaaaacuguggcacaagaggccccucucugcgcaccacgaccguuuccgggaagcugauccacgaguggugcugucggagcugcacacuuccgccucucagauauaugggagaagauggcuguugguacgggauggagauucggcccaucucugaaaaagaggagaauauggugaagucccuggucagcgccggaucuggcaaaguggacaacuucaccauggggguucugugccucgcuauccuguuugaagaggugaugcgcggaaaguucggcaagaaacauaugauugccggcgucuucuuuacauucgugcuucugcucagcgggcaaaucaccuggagagauauggcgcacacgcugauuaugaucggauccaaugcuagcgaccggaugggcauggggguuacauaucuggcccuuauugccaccuuuaagauccagcccuuccuggcucucggauuuuuccugagaaaacucacaucucgcgaaaaccugcuucugggcguggggcucgccauggcuaccacccugcagcugccugaggauauugaacaaauggccaauggaaucgcgcuuggccugauggcccucaagcugaucacacaguuugagacguaccagcucuggaccgcucugauuucccuuacauguagcaacaccaucuucacacugaccgucgccuggcggacggcuacacucauucuggccggcgugucccugcuuccggugugccagucuagcuccaugagaaaaaccgacuggcugcccauggccgucgcugcgauggggguuccuccccucccucuguuuaucuucucucucaaggauacccugaagcgcagaagcuggccccuuaaugagggagugauggccgugggccuggucuccauucuggcuucuagccuccugcggaacgacgugccuauggccgggccccuuguugccggaggccugcucaucgcuuguuaugugaucacagggaccuccgccgaucugacagucgaaaaagcggcugacauuacgugggaggaagaggccgaacaaaccggagugagccauaaccucaugaucacaguugacgaugacggcaccaugcgcauuaaggaugacgagacagagaauauccugaccgugcuucugaaaacggcccugcucauugucucuggcaucuuuccguacuccaucccugcuacccugcuuguguggcacacauggcagaagcagacccagagaagcgggguccugugggaugugcccucuccucccgaaacacaaaaagccgagcucgaagagggaguuuaccggauuaagcagcagggcaucuucgggaaaacccaggugggagucggcgugcaaaaggaggggguuuuucacacaauguggcaugugacgcgcggagcgguccugaccuauaacggcaagagacucgaaccgaauugggcuuccgugaaaaaggaccugauuagcuacggcgggggauggcggcuuucuacacaguggcagaaaggcgaggaagugcaaguuaucgccgucgagccugggaagaaccccaaaaauuuccagaccaugccuggaaccuuccagacaacgaccggcgaaauuggggccaucgcucuggauuuuaagcccggaacauccggcagccccauuaucaaccgcgagggcaaggugguggggcuguauggaaauggcgucgugaccaaaaacgggggauacguuuccggcaucgcccagacaaaugcugagccugacgggccgacccccgaacucgaggaagagauguucaagaaaagaaaccugacgauuauggaucuucacccuggcagcggaaagacacggaaauaucugcccgccaucgugcgcgaagcgauuaagagacggcucagaacccugauccucgccccuacccgcgucguggcugccgagauggaggaagcucugaagggccuucccauucgguaccaaacaaccgccacaaaaucugagcauaccgggagagaaaucguugaccugaugugccacgccacguuuacaaugcgccugcucagcccugugcgggucccgaauuauaaccugaucauuauggaugaggcucauuucaccgaccccgcguccaucgccgcuagaggauacauuucuacacgcgugggcaugggggaagccgccgcuaucuuuaugaccgccacgccucccggaaccgcggaugcuuucccucagagcaaugcccccauucaggacgaggagcgggacaucccggaaagauccuggaacucuggcaaugaguggaucacagauuuugccgggaagaccguuugguucgugccuagcauuaaagcuggcaacgacaucgccaacugucuucgcaagaauggcaaaaaggucauucagcugucccggaagacauuugauaccgaauaccagaaaacaaagcucaacgacugggauuucguggugaccacggacaucucugagaugggagcgaauuuuaaagccgauagagucauugacccccggcgcugccugaagcccguuauccugacagaugggccugagagagugauucucgcuggacccaugccugugaccgccgcuagcgccgcucagcggcgcggcagagucgggcggaacccgcagaaagaaaaugaccaguauaucuucaccggacaaccccuuaacaaugaugaggaccacgcccacuggacagaagcgaagaugcugcuggacaacaucaauaccccugagggcauuauccccgcccucuucgaaccugagagagagaaguccgcugccauugauggggaauaccgccugaaaggcgagagccggaagacauuuguggaacuuaugagacgcggagaccugcccguuuggcucgcucauaaaguggccucugagggcaucaaguauacggaucggaaauggugcuucgacgggcagagaaacaaucagauucuggaagagaacauggaugucgagaucuggaccaaggaaggagagaaaaagaagcugcgcccgcgguggcucgacgccagaacauacuccgauccucuugcucugaaagaauuuaaggacuucgcggccggccgcaaaagcaucgcucuggaucucgugaccgagauugggagaguucccucucaccuggcccaucggacacgcaaugcccuugacaaccuggugaugcuccacaccuccgaacacggaggcagagcuuaucggcaugccgucgaggagcugccugaaacgauggagacccugcuccuucugggccugaugauccuccugacagggggagcgaugcuuuuucugauuagcggcaaggggaucggaaaaaccuccauuggccucaucugugugaucgccucuagcgggaugcuguggauggcugaaauuccccugcaguggaucgccuccgcuauuguccucgaguucuuuaugauggugcuucugguuccugagcccgaaaagcaacgcacaccgcaggauaaucagcuggccuacguggugaucggcauucucacccuggcggccaucauugcugccaacgagaugggccuucuggaaacgacaaagagagaccucggcaugagcaaagagccuggggucguuucucccaccuccuaucuggauguggaccugcaccccgcuagcgccuggacacucuacgcuguggccaccaccgucaucacaccuaugcuucggcauacgaucgaaaauucuaccgcgaacgugagccuggccgcuauugccaaccaagcuguugugcugaugggacucgacaagggcuggccgaucuccaaaauggaucugggggucccccuucuggcccucggaugcuacucucaggugaauccucugacacugaccgccgcgguccuccuucugauuacacacuaugcuaucauuggccccgggcugcaggccaaggcuaccagagaggcccagaaacgcacggccgcuggaaucaugaagaacccuacaguggacggcaucaugaccauugaucucgaccccguuaucuacgauagcaaguucgagaaacaacugggccaggugaugcuucugguccucugugccgugcagcugcugcucaugcggaccuccugggcgcuuugcgaagcccugacacuggcuaccgggccuauuacaacgcucugggagggaucuccgggcaaguuuuggaauaccacaaucgccguuagcauggcuaacauuuucagaggguccuaucuggccggagcgggccuugccuuuagcaucaugaaaucuguggggaccggaaagcgcggcacaggcucccagggggaaacccugggagagaaauggaagaagaaacucaaucaacugagccggaaggaguucgaccuguacaaaaaguccggcaucacggaggucgauagaaccgaggcuaaagaagggcucaagcggggagagauuacacaucacgccgugucucgcggcagcgcuaaacuucagugguuuguggaaagaaacaugguuauccccgaggggcgggucauugaccugggauguggccgcggcgggugguccuauuacugcgccggacugaagaaggugaccgaagugagaggcuauacaaaagggggaccuggccacgaggagcccgucccuaugucuaccuacggguggaauaucguuaagcucaugagcggaaaagauguguucuaccugcccccggaaaagugugacacacuucugugcgauauuggcgaguccagcccuucucccaccguggaagagucccggacgauccgcguccucaaaaugguggagcccuggcugaagaacaaucaguucuguauuaagguucugaacccuuauaugcccacagugaucgaacaucucgagagacuucagcggaaacacggcgggaugcugguccgcaauccucugagcagaaacucuacccaugaaauguacuggaucuccaauggaaccggcaacauuguggcuagcguuaauauggugucucggcuccugcuuaacagauuuacaaugacgcaccgccggccgaccaucgagaaggacgucgaucugggggccggaacaagacacgugaacgcggaacccgagaccccuaauauggacgugauuggcgagcgcaucaaacggauuaaggaagaacacaacagcacauggcacuaugacgaugaaaaucccuacaaaaccugggccuaucauggguccuacgaggucaaggcuacaggaucugccagcuccaugaucaacggcguugugaagcuccugaccaaaccuugggacgugguccccauggugacgcaaauggcuaugaccgauacaaccccguucggccagcagagaguuuuuaaggaaaaaguggacacacgcaccccucggagcaugcccgggacgagacgcgucaugggaaucacagccgaguggcuguggcggacccucggcagaaauaagaaaccucgccugugcacacgggaggaguucaccaagaaggugagaacgaacgccgcgaugggggcuguuuuuaccgaggaaaaucaaugggauuccgccaaagccgcuguggaggacgaagauuucuggaaacuugucgaccgcgagagagagcugcacaaacucggaaaguguggcucuugcguguauaacaugauggggaaacgggaaaagaaacugggcgaguuuggaaaggccaagggcagccgcgcuauuugguacauguggcuuggggccagauaccuggaguucgaggcgcucggauuucugaaugaggaucauugguucucccgggaaaacucuuauagcggcguugagggggaaggacugcacaaacucggcuacauccugagagacauuuccaagauccccgggggcgccauguaugcugaugacacagccggaugggacacccggauuacagaggaugaccuucacaaugaagagaaaaucacccagcagauggauccugagcaucgccagcuggcuaacgccaucuuuaagcucacauaccaaaauaaaguggucaaggugcagagacccaccccgacgggcacagucauggacauuaucucucggaaggaucagcgcgggagcggacaggugggcaccuaugggcugaacaccuucacaaauauggaagcgcaacuuauuagacagauggagggagaaggcguucuguccaaagccgaccucgagaacccucaucugcccgaaaagaaaaucacccaguggcuggagacaaaggggguggagcggcucaaacgcauggcuauuagcggcgaugacugcgucgugaagcccaucgaugacagauuugccaacgcucugcuugcccugaaugauaugggaaaggugcggaaagacaucccucaguggcaaccgucuaagggcuggcaugauuggcagcagguucccuucuguucccaccacuuccaugaacucauuaugaaagacgggcgcaagcugguggucccuugcagaccccaggacgagcuuaucggacgggcucgcauuagccaaggcgccggguggucucugagagaaacggcgugucucggaaaagccuacgcucagauguggucccugauguauuuucaccggcgcgaucugagacucgccagcaacgccaucugcucugcugugccuguucauugggugcccaccucccggacaaccuggagcauucacgcccaucaccaguggaugacaaccgaggacaugcugacggucuggaauagaguguggaucgaagauaacccuuggauggaggacaagacccccgucacaaccugggaggaugugccguaccuuggcaagcgcgaagaccaauggugugggucccugauuggccucacaagccgggcgaccugggcucagaauaucccuacggccauccagcagguuagaucucugauuggaaacgaggaguuccuugauuacaugcccagcaugaaacgcuuucggaaggaggaggaauccgagggcgccaucugguga

SEQ ID NO: 20637 - RNA, 9873 nt, Artificial Sequence
  derived and/or modified CDS sequence (opt5) from DENV-3__KJ189289__SS-prME
accagccugugccucaugaugauccugcccgcggcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggcggcaaguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacaccauuggaguucuggagcagggcaaacggacacuuaccccucagcccauggagcugaaguacucuuggaaaacaugggggaaggccaagaucgugaccgcugaaacacagaacuccagcuucauuaucgauggaccuaauacccccgagugcccgucugcguccagagccuggaacgucugggaaguggaggacuauggcuuuggcguguucacgacaaauauuuggcuccgccugcgggaagucuacacccaacugugugaccacagacuuaugagcgcugccguuaaagaugagcgcgccgugcaugcugacaugggguacuggaucgagucccagaagaacggaucuuggaaacucgaaaaggccagccugaucgaggugaaaaccugcacauggccuaagucccacacccuguggucuaauggcguccucgaaagcgauaugauuauccccaagucccuggcggggccuauuagccagcauaaccaccggcccggauaucacacgcagacagcuggcccuuggcaucuugggaaacuggagcucgacuuuaauuacugcgagggaaccacagugguuaucaccgaaaacuguggcacaagaggccccucucugcgcaccacgaccguguccgggaagcugauucacgaguggugcugucggagcugcacacuuccgccucucagauauaugggagaagauggcuguugguacgggauggagauccggcccaucucugaaaaagaggagaauauggucaagucccuggugagcgccggaucuggcaaaguugacaacuucaccaugggggugcugugccucgccauucuguuugaagaggucaugcgcggaaaguucggcaagaaacauaugaucgcuggcguguucuuuacauucguucuucugcucagcgggcaaauuaccuggagagauauggcccacacgcugaucaugauuggauccaaugcgagcgaccggaugggcaugggggugacauaucuggcucuuaucgccaccuuuaagauucagcccuuccuggcccucggauuuuuccugagaaaacucacaucucgcgaaaaccugcuucugggcgucgggcucgcuauggccaccacccugcagcugccugaggauaucgaacaaauggcuaauggaaucgcccuuggccugauggcgcucaagcugauuacacaguuugagacguaccagcucuggaccgcccugaucucccuuacauguagcaacaccauuuucacacugaccguggcuuggcggacggccacacucauccuggcuggcgugucccugcuuccggucugccagucuagcuccaugagaaaaaccgacuggcugcccauggccguugccgcuaugggggugccuccccucccucuguuuauuuucucucucaaggauacccugaagcgcagaagcuggccccuuaaugagggagugauggcggucggccugguguccauccuggccucuagccuccugcggaacgacguuccuauggcugggccccuuguggccggaggccugcucaucgccuguuaugucauuacagggaccuccgcugaucugacaguggaaaaagccgcggacaucacgugggaggaagaggcugaacaaaccggaguuagccauaaccucaugauuacaguggacgaugacggcaccaugcgcaucaaggaugacgagacagagaauauucugaccguccuucugaaaacggcccugcucaucgugucuggcaucuuuccguacuccauuccugccacccugcuugucuggcacacauggcagaagcagacccagagaagcggggugcugugggauguucccucuccucccgaaacacaaaaagcugagcucgaagagggaguguaccggaucaagcagcagggcauuuucgggaaaacccaggucggagugggcguucaaaaggaggggguguuucacacaauguggcaugucacgcgcggagccgugcugaccuauaacggcaagagacucgaaccgaauugggcguccgugaaaaaggaccugaucagcuacggcgggggauggcggcuuucuacacaguggcagaaaggcgaggaaguucaagucauugcuguggagccugggaagaaccccaaaaauuuccagaccaugccuggaaccuuccagacaacgaccggcgaaaucggggccauugcccuggauuuuaagcccggaacauccggcagccccaucaucaaccgcgagggcaagguggucgggcuguauggaaauggcgugguuaccaaaaacgggggauacguguccggcauugcucagacaaaugccgagccugacgggccgacccccgaacucgaggaagagauguucaagaaaagaaaccugacgaucauggaucuucacccuggcagcggaaagacacggaaauaucugcccgcuauuguccgcgaagccaucaagagacggcucagaacccugauucucgcgccuacccgcgugguugccgcugagauggaggaagcccugaagggccuucccauccgguaccaaacaaccgcuacaaaaucugagcauaccgggagagaaaucguggaccugaugugccacgccacguuuacaaugcgccugcucagcccuguccgggugccgaauuauaaccugauuaucauggaugaggcccauuucaccgaccccgcuuccauugcggccagaggauacaucucuacacgcguuggcaugggggaagcugccgccauuuuuaugaccgcuacgccucccggaaccgccgaugcguucccucagagcaaugcucccauccaggacgaggagcgggacaucccggaaagauccuggaacucuggcaaugaguggauuacagauuuugccgggaagaccgugugguucgucccuagcaucaaagccggcaacgacauugcuaacugucuucgcaagaauggcaaaaaggugauccagcugucccggaagacauuugauaccgaauaccagaagacaaagcucaacgacugggauuucguggucaccacggacauuucugagaugggagccaauuuuaaagcggauagaguuaucgacccccggcgcugccugaagcccgugauucugacagaugggccugagagagugauccucgccggacccaugccugucaccgcugccagcgcugcccagcggcgcggcagaguggggcggaacccgcagaaagaaaaugaccaguauaucuucaccggacaaccccuuaacaaugaugaggaccacgcucacuggacagaagccaagaugcugcuggacaacauuaauaccccugagggcaucauucccgcccucuucgaaccugagagagagaaguccgccgcuaucgauggggaauaccgccugaaaggcgagagccggaagacauuuguugaacuuaugagacgcggagaccugcccguguggcucgcccauaaagucgcuucugagggcauuaaguauacggaucggaaauggugcuucgacgggcagagaaacaaucagauccuggaagagaacauggauguggagaucuggaccaaggaaggagagaaaaagaagcugcgcccgcgguggcucgacgccagaacauacuccgauccucuugcccugaaagaauuuaaggacuucgcugcgggccgcaaaagcauugcccuggaucucguuaccgagaucgggagagugcccucucaccuggcucaucggacacgcaaugcccuugacaaccuggucaugcuccacaccuccgaacacggaggcagagccuaucggcaugcuguggaggagcugccugaaacgauggagacccugcuccuucugggccugaugauucuccugacagggggagccaugcuuuuucugaucagcggcaaggggauuggaaaaaccuccaucggccucaucugugucauugcgucuagcgggaugcuguggauggccgaaaucccccugcaguggauugcuuccgccaucgugcucgaguucuuuaugaugguucuucugauuccugagcccgaaaagcaacgcacaccgcaggauaaucagcuggcuuacguggugaucggcauucucacccuggccgcgaucaucgccgcuaacgagaugggccuucuggaaacgacaaagagagaccucggcaugagcaaagagccuggggucguuucuuccaccagcuaucuggauguggaccugcaccccgccucugcuuggacacucuacgccguggcuaccaccgucauuacacccaugcuucggcauacgaucgaaaauagcaccgccaacgugucccuggcggccauugcuaaccaagccguugugcugaugggacucgacaagggcuggccuaucucuaaaauggaucugggggucccgcuucuggcucucggaugcuacagccaggugaauccccugacacugaccgccgccguccuccuucugauuacacacuaugcgaucaucggcccugggcugcaggcuaaggccaccagagaggcucagaaacgcacggccgccggaauuaugaagaaccccacaguggacggcaucaugaccauugaucucgacccuguuaucuacgauuccaaguucgagaaacaacugggccaggugaugcuucugguccucugugcugugcagcugcugcucaugcggaccucuugggcccuuugcgaagcgcugacacuggccaccgggcccauuacaacgcucugggagggaagcccuggcaaguuuuggaauaccacaaucgcuguuuccauggccaacaucuucagagggagcuaucuggcuggagccggccuugcguuuucuauuaugaaauccguggggaccggaaagcgcggcacaggcagccagggggaaacccugggagagaaauggaagaagaaacucaaucaacugucccggaaggaguucgaccuguacaaaaagucuggcaucacggaggucgauagaaccgaggccaaagaagggcucaagcggggagagauuacacaucacgcugugagccgcggcuccgccaaacuucagugguuuguggaaagaaacaugguuaucccggaggggcgggucauugaccugggauguggccgcggcggguggucuuauuacugcgcuggacugaagaaggugaccgaagugagaggcuauacaaaagggggacccggccacgaggagccuguccccaugagcaccuacggguggaauaucguuaagcucauguccggaaaagauguguucuaccugccucccgaaaagugugacacacuucugugcgauauuggcgagagcucuccguccccuaccguggaagagagccggacgauccgcguccucaaaaugguggagcccuggcugaagaacaaucaguucuguaucaagguucugaaccccuauaugccuacagugauugaacaucucgagagacuucagcggaaacacggcgggaugcugguccgcaauccccugucuagaaacuccacccaugaaauguacuggaucagcaauggaaccggcaacauuguggccucuguuaauauggugagccggcuccugcuuaacagauuuacaaugacgcaccgccggccuaccaucgagaaggacgucgaucugggggcuggaacaagacacgugaacgccgaaccggagacccccaauauggacgugauuggcgagcgcaucaaacggaucaaggaagaacacaacuccacauggcacuaugacgaugaaaauccuuacaaaaccugggcguaucaugggucuuacgaggucaaggccacaggaagcgcuuccagcaugauuaacggcguugugaagcuccugaccaaacccugggacguggucccuauggugacgcaaauggccaugaccgauacaacccccuucggccagcagagaguuuuuaaggaaaaaguggacacacgcaccccgcgguccaugccugggacgagacgcgucaugggaaucacagcugaguggcuguggcggacccucggcagaaauaagaaaccccgccugugcacacgggaggaguucaccaagaaggugagaacgaacgccgccaugggggcgguuuuuaccgaggaaaaucaaugggauucugcuaaaacagccguggaggacgaagauuucuggaaacuugucgaccgcgagagagagcugcacaaacucggaaaguguggcagcugcguguauaacaugauggggaaacgggaaaagaaacugggcgaguuuggaaaggccaagggcucccgcgcuauuugguacauguggcuuggggccagauaccuggaguucgaggcucucggauuucugaaugaggaucauugguucucucgggaaaacagcuauuccggcguugagggggaaggacugcacaaacucggcuacauccugagagacauuucuaagaucccugggggcgccauguaugcggaugacaccgccggaugggacacacggaucaccgaggaugaccuucacaaugaagagaaaauuacacagcagauggaucccgagcaucgccagcuggcuaacgccaucuuuaagcucaccuaccaaaauaaaguggucaaggugcagagaccuacgcccacaggcaccgucauggacauuaucagccggaaggaucagcgcggguccggacaggugggcaccuaugggcugaacacauucaccaauauggaagcucaacuuauuagacagauggagggagaaggcguucugagcaaagccgaccucgagaacccgcaucugccugaaaagaaaaucacacaguggcuggagacgaaggggguggagcggcucaaacgcauggcgaucucuggcgaugacugcgucgugaagcccauugaugacagauuugccaacgcucugcuugcccugaaugauaugggaaaggugcggaaagacaucccccaguggcaaccuuccaagggcuggcaugauuggcagcagguuccguucuguagccaccacuuccaugaacucauuaugaaagacgggcgcaagcuggugguccccugcagaccucaggacgagcuuaucggacgggcucgcauuucucaaggcgccggguggucccugagagaaaccgcuugucucggaaaagccuacgcgcagauguggagccugauguauuuucaccggcgcgaucugagacucgccucuaacgcuaucugcuccgccgugcccguucauugggugccuacaagccggaccacaugguccauucacgcccaucaccaguggaugaccacggaggacaugcugaccgucuggaauagaguguggaucgaagauaaccccuggauggaggacaagacaccugucaccacaugggaggaugugcccuaccuuggcaagcgcgaagaccaauggugugggagccugaucggccucaccucucgggcuacgugggcccagaauauuccgacagcgauccagcagguuagaagccugauuggaaacgaggaguuccuugauuacaugccuuccaugaaacgcuuucggaaggaggaggaaucugagggcgcuaucugguga

SEQ ID NO: 20638 - RNA, 9873 nt, Artificial Sequence
  derived and/or modified CDS sequence (opt5) from DENV-3__KJ189290__SS-prME
acaagccugugccucaugaugauccugcccgcggcucuugccuuccaccugacaucccgggacggcgagccucggaugauuguggggaagaaugaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccagaacuccagcuucaucauugauggaccuaauacacccgagugcccgucugcguccagagccuggaacgucugggaaguggaggacuauggcuuuggcguguucaccacgaauaucuggcuccgccugcgggaagucuacacacaacugugugaccacagacuuaugagcgcugccguuaaagaugagcgcgccgugcaugcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccaccggcccggauaucacacccagacggcuggcccuuggcaucuugggaaacuggagcucgacuuuaauuacugcgagggaacaaccgugguuauuacagaaaacuguggcaccagaggccccucucugcgcacaaccacgguguccgggaagcugauccacgaguggugcugucggagcugcacccuuccgccucucagauauaugggagaagauggcuguugguacgggauggagauccggcccauuucugaaaaagaggagaauauggucaagucccuggugagcgccggaucuggcaaaguugacaacuucacaaugggggugcugugccucgccauccuguuugaagaggucaugcgcggaaaguucggcaagaaacauaugauugcuggcguguucuuuaccuucguucuucugcucagcgggcaaaucacauggagaaauauggcccacacccugauuaugaucggauccaacgcgagcgaucggaugggcaugggggugacguaucuggcucuuauugccacauuuaagauccagcccuuccuggcccucggauuuuuccugagaaaacucaccucucgcgaaaaucugcuucugggcgucgggcucgcuauggccacaacccugcagcugccugaggacaucgaacaaauggcuaacggaauugcccuuggccugauggcgcucaagcugaucacccaguuugagacauaccagcucuggacggcccugauuucccuuaccuguagcaauacaaucuucacccugacaguggcuuggcggaccgccacgcucauucuggcuggcgugucccugcuuccggucugccagucuagcuccaugagaaaaacagauuggcugcccauggccguugccgcuaugggggugccuccccucccucuguuuaucuucucucucaaggacacccugaagcgcagaagcuggccccuuaacgagggagugauggcggucggccugguguccauccuggccucuagccuccugcggaacgauguuccuauggcugggccccuuguggccggaggccugcucauugccuguuaugucaucaccgggacauccgcugaccugaccguggaaaaagccgcggauauuacaugggaggaagaggcugaacaaacgggaguuagccauaaucucaugaucaccguggacgacgauggcacaaugcgcauuaaggacgaugagaccgagaacauccugacaguccuucugaaaaccgcccugcucaucgugucuggcauuuuuccguacuccaucccugccacgcugcuugucuggcacaccuggcagaagcagacacagagaagcggggugcugugggacguucccucuccucccgaaacccaaaaagcugagcucgaagagggaguguaccggauuaagcagcagggcaucuucgggaaaacacaggucggagugggcguucaaaaggaggggguguuucacaccauguggcaugucacacgcggagccgugcugacguauaauggcaagagacucgaaccgaacugggcguccgugaaaaaggaucugauuagcuacggcgggggauggcggcuuucuacccaguggcagaaaggcgaggaaguucaagucaucgcuguggagccugggaagaaucccaaaaacuuccagacaaugccuggaaccuuccagaccacaacgggcgaaauuggggccaucgcccuggacuuuaagcccggaaccuccggcagccccaucauuaaucgcgagggcaagguggucgggcuguauggaaacggcgugguuaccaagaaugggggauacguguccggcaucgcucagaccaacgccgagccugaugggccgacacccgaacucgaggaagagauguucaagaaaagaaaucugaccauuauggaccuucacccuggcagcggaaagacgcggaaauaucugcccgcuaucguccgcgaagccauuaagagacggcucagaacacugauccucgcgccuacccgcgugguugccgcugagauggaggaagcccugaagggccuucccauccgguaccaaaccacagcuaccaaaucugagcauacagggagagaaauuguggaucugaugugccacgccaccuuuacgaugcgccugcucagcccuguccgggugccgaacuauaaucugaucauuauggacgaggcccauuucacagaucccgcuuccaucgcggccagaggauacauuucuacccgcguuggcaugggggaagcugccgccaucuuuaugacagcuaccccucccggaacggccgacgcguucccucagagcaacgcucccauccaggaugaggagcgggacauuccggaaagauccuggaacucuggcaacgaguggaucaccgacuuugccgggaagacagugugguucgucccuagcauuaaagccggcaacgauaucgcuaauugucuucgcaagaacggcaaaaaggugauucagcugucccggaagaccuuugacacagaauaccagaagacaaagcucaaugauugggacuucguggucacaaccgauaucucugagaugggagccaacuuuaaagcggacagaguuauugauccccggcgcugccugaagcccgugauccugacggacgggccugagagagugauccucgccggacccaugccugucacagcugccagcgcugcccagcggcgcggcagaguggggcggaauccgcagaaagaaaacgaucaguauauuuucaccggacaaccccuuaauaacgacgaggaucacgcucacuggaccgaagccaagaugcugcuggacaauaucaacacaccugagggcauuauccccgcccucuucgaaccugagagagagaaguccgccgcuauugacggggaauaccgccugaaaggcgagagccggaagaccuuuguugaacuuaugagacgcggagaucugcccguguggcucgcccauaaagucgcuucugagggcaucaaguauacagaccggaaauggugcuucgaugggcagagaaauaaccagauccuggaagagaauauggacguggagauuuggacgaaggaaggagagaaaaagaagcugcgcccgcgguggcucgaugccagaaccuacuccgacccucuugcccugaaagaauuuaaggauuucgcugcgggccgcaaaagcaucgcccuggaccucguuacagagauugggagagugcccucucaccuggcucaucggacccgcaacgcccuugauaaucuggucaugcuccacacauccgaacacggaggcagagccuaucggcaugcuguggaggagcugccugaaaccauggagacgcugcuccuucugggccugaugauccuccugaccgggggagccaugcuuuuucugauuagcggcaaggggaucggaaaaacauccaucggccucauuugugucaucgcgucuagcgggaugcuguggauggccgaaauuccccugcaguggaucgcuuccgccauugugcucgaguucuuuaugaugguucuucugaucccugagcccgaaaagcaacgcaccccgcaggacaaccagcuggcuuacguggugauuggaauccucacacuggccgcgaucauugccgcuaaugagaugggccuucuggaaaccacgaagagagaucucggcaugagcaaagagccuggggucguuucucccacauccuaucuggacguggaucugcaccccgccagcgcuuggacccucuacgccguggcuacaaccgucaucaccccuaugcuucggcauacaauugaaaacucuacggccaacgugagccuggcggccaucgcuaaucaagccguugugcugaugggacucgacaagggcuggccgauuuccaaaauggaccugggggucccccuucuggcucucggaugcuacucucaggugaacccucugacccugacagccgccguccuccuucugaucacccacuaugcgaucauuggccccgggcugcaggcuaaggccacaagagaggcucagaaacgcaccgccgccggaaucaugaagaauccuacgguggauggcauuaugacaaucgaccucgaucccguuauuuacgacagcaaguucgagaaacaacugggccaggugaugcuucugguccucugugcugugcagcugcugcucaugcggaccuccugggcccuuugcgaagcgcugacccuggccacagggccuaucaccacacucugggagggaucuccgggcaaguuuuggaacacgaccaucgcuguuagcauggccaauauuuucagaggguccuaucuggcuggagccggccuugcguuuagcaucaugaaaucuguggggacaggaaagcgcggcaccggcucccagggggaaacacugggagagaaauggaagaagaaacucaaccaacugagccggaaggaguucgaucuguacaaaagauccggcauuaccgaggucgaccggacggaggccaaggaagggcucaaacgcggagagaucacccaucacgcugugucuagaggcagcgccaaacuucagugguuuguggaacggaauaugguuauucccgaggggcgcgucaucgaucugggauguggcagaggcgggugguccuauuacugcgcuggacugaaaaaggugacagaagugcggggcuauaccaaagggggaccuggccacgaggagcccgucccuaugucuacauacggguggaacauuguuaaacucaugagcggaaaggacguguucuaccugcccccggaaaaaugugauacccuucugugcgacaucggcgaguccagcccuucucccacaguggaagagucccgcaccaucagaguccucaagaugguggagcccuggcugaaaaauaaccaguucuguauuaagguucugaauccuuauaugcccacggugaucgaacaucucgagcggcuucagcgcaagcacggcgggaugcuggucagaaacccucugagcagaaauucuacacaugaaauguacuggauuuccaacggaaccggcaauaucguggccagcguuaacauggugucuagacuccugcuuaaccgcuuuaccaugacacaccggagaccgacgauugagaaagaugucgaccugggggcuggaacccgccacgugaaugccgaacccgagacaccuaacauggaugugaucggcgagcggaucaagagaauuaaagaggaacacaauagcaccuggcacuaugacgaagagaaccccuacaagacaugggcguaucauggguccuacgaagucaaagccaccggaucugcuagcuccaugaucaauggcguugugaagcuccugacaaagccuugggacgugguccccauggugacccaaauggccaugacggauaccacaccguucggccagcagcgcguuuuuaaagagaagguggacacccggacaccuagaagcaugcccgggacccgccgggucaugggaauuacggcugaguggcuguggagaacacucggccgcaacaaaaagccucggcugugcaccagagaagaguucaccaaaaaggugcgcaccaaugccgccaugggggcgguuuuuacggaagagaaccaaugggauuccgcuaaggccgccguggaagacgaggauuucuggaaacuugucgacagagagcgggaacugcacaagcucggaaaauguggcucuugcguguauaauaugauggggaagcgcgagaaaaagcugggcgaauuuggaaaagcuaagggcagcagagccaucugguacauguggcuuggggcucgguaccuggaguucgaggcccucggauuucugaacgaagaucauugguucuccagagaaaauucuuauagcggcguugaaggggagggacugcacaagcucggcuacauucugcgggacaucuccaaaauccccgggggcgcgauguaugccgaugacaccgcuggaugggauacacgcauuaccgaagacgaccuucacaacgaggagaagaucacacagcagauggauccugaacauagacagcuggccaaugcuauuuuuaaacucaccuaccaaaacaagguggucaaagugcagcggcccacaccgaccggcacggucauggacaucauuucucgcaaggaucagagagggagcggacaggugggcacauaugggcugaauaccuucaccaacauggaggcccaacuuauccggcagauggaaggagagggcguucuguccaaggcggaccucgaaaacccucaucugcccgagaaaaagaucacacaguggcuggagaccaaagggguggaacgccucaagagaauggccauuagcggcgaugacugcgucgugaaacccaucgaugaccgguuugcuaaugcccugcuugcucugaacgauaugggaaaggugcgcaaggacauuccucaguggcaaccgucuaaaggcuggcaugauuggcagcagguucccuucuguucccaccacuuccaugagcucaucaugaaggacgggagaaaacugguggucccuugccggccccaggaugaacuuauuggacgcgccagaaucagccaaggcgcuggguggucucugcgggagacagccugucucggaaaggcguacgcccagauguggucccugauguauuuucaccgcagagaccugcggcucgcuagcaaugccauuugcucugccgugccuguucauugggugcccacguccagaaccacauggagcauccacgcucaucaccaguggaugaccacagaagacaugcugaccgucuggaaccgcguguggaucgaggauaauccuuggauggaggacaaaacgcccgucaccacaugggaagaugugccguaccuuggcaagcgggaggaccaauggugugggucccugauuggccucaccagcagagccacaugggcgcagaacaucccuaccgcuauucagcagguucgcucucugaucggaaaugaagaguuccuugauuacaugcccagcaugaagcgguuuagaaaagaggaagaguccgaaggcgccauuugguga

SEQ ID NO: 20639 - RNA, 9873 nt, Artificial Sequence
  derived and/or modified CDS sequence (opt5) from DENV-3__KJ189291__SS-prME
acaagccugugccucaugaugauccugcccgcggcucuugccuuccaccugacaucccgggacggcgagccucggaugauuguggggaagaaugaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccagaacuccagcuucaucauugauggaccuaauacacccgagugcccgucugcguccagagccuggaacgucugggaaguggaggacuauggcuuuggcguguucaccacgaauaucuggcuccgccugcgggaagucuacacacaacugugugaccacagacuuaugagcgcugccguuaaagaugagcgcgccgugcaugcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccaccggcccggauaucacacccagacggcuggcccuuggcaucuugggaaacuggagcucgacuuuaauuacugcgagggaacaaccgugguuauuacagaaaacuguggcaccagaggccccucucugcgcacaaccacgguguccgggaagcugauccacgaguggugcugucggagcugcacccuuccgccucucagauauaugggagaagauggcuguugguacgggauggagauccggcccauuucugaaaaagaggagaauauggucaagucccuggugagcgccggaucuggcaaaguugacaacuucacaaugggggugcugugccucgccauccuguuugaagaggucaugcgcggaaaguucggcaagaaacauaugauugcuggcguguucuuuaccuucguucuucugcucagcgggcaaaucacauggagaaauauggcccacacccugauuaugaucggauccaacgcgagcgaucggaugggcaugggggugacguaucuggcucuuauugccacauuuaagauccagcccuuccuggcccucggauuuuuccugagaaaacucaccucucgcgaaaaucugcuucugggcgucgggcucgcuauggccacaacccugcagcugccugaggacaucgaacaaauggcuaacggaauugcccuuggccugauggcgcucaagcugaucacccaguuugagacauaccagcucuggacggcccugauuucccuuaccuguagcaauacaaucuucacccugacaguggcuuggcggaccgccacgcucauucuggcuggcgugucccugcuuccggucugccagucuagcuccaugagaaaaacagauuggcugcccauggccguugccgcuaugggggugccuccccucccucuguuuaucuucucucucaaggacacccugaagcgcagaagcuggccccuuaacgagggagugauggcggucggccugguguccauccuggccucuagccuccugcggaacgauguuccuauggcugggccccuuguggccggaggccugcucauugccuguuaugucaucaccgggacauccgcugaccugaccguggaaaaagccgcggauauuacaugggaggaagaggcugaacaaacgggaguuagccauaaucucaugaucaccguggacgacgauggcacaaugcgcauuaaggacgaugagaccgagaacauccugacaguccuucugaaaaccgcccugcucaucgugucuggcauuuuuccguacuccaucccugccacgcugcuugucuggcacaccuggcagaagcagacacagagaagcggggugcugugggacguucccucuccucccgaaacccaaaaagcugagcucgaagagggaguguaccggauuaagcagcagggcaucuucgggaaaacacaggucggagugggcguucaaaaggaggggguguuucacaccauguggcaugucacacgcggagccgugcugacguauaauggcaagagacucgaaccgaacugggcguccgugaaaaaggaucugauuagcuacggcgggggauggcggcuuucuacccaguggcagaaaggcgaggaaguucaagucaucgcuguggagccugggaagaaucccaaaaacuuccagacaaugccuggaaccuuccagaccacaacgggcgaaauuggggccaucgcccuggacuuuaagcccggaaccuccggcagccccaucauuaaucgcgagggcaagguggucgggcuguauggaaacggcgugguuaccaagaaugggggauacguguccggcaucgcucagaccaacgccgagccugaugggccgacacccgaacucgaggaagagauguucaagaaaagaaaucugaccauuauggaccuucacccuggcagcggaaagacgcggaaauaucugcccgcuaucguccgcgaagccauuaagagacggcucagaacacugauccucgcgccuacccgcgugguugccgcugagauggaggaagcccugaagggccuucccauccgguaccaaaccacagcuaccaaaucugagcauacagggagagaaauuguggaucugaugugccacgccaccuuuacgaugcgccugcucagcccuguccgggugccgaacuauaaucugaucauuauggacgaggcccauuucacagaucccgcuuccaucgcggccagaggauacauuucuacccgcguuggcaugggggaagcugccgccaucuuuaugacagcuaccccucccggaacggccgacgcguucccucagagcaacgcucccauccaggaugaggagcgggacauuccggaaagauccuggaacucuggcaacgaguggaucaccgacuuugccgggaagacagugugguucgucccuagcauuaaagccggcaacgauaucgcuaauugucuucgcaagaacggcaaaaaggugauucagcugucccggaagaccuuugacacagaauaccagaagacaaagcucaaugauugggacuucguggucacaaccgauaucucugagaugggagccaacuuuaaagcggacagaguuauugauccccggcgcugccugaagcccgugauccugacggacgggccugagagagugauccucgccggacccaugccugucacagcugccagcgcugcccagcggcgcggcagaguggggcggaauccgcagaaagaaaacgaucaguauauuuucaccggacaaccccuuaauaacgacgaggaucacgcucacuggaccgaagccaagaugcugcuggacaauaucaacacaccugagggcauuauccccgcccucuucgaaccugagagagagaaguccgccgcuauugacggggaauaccgccugaaaggcgagagccggaagaccuuuguugaacuuaugagacgcggagaucugcccguguggcucgcccauaaagucgcuucugagggcaucaaguauacagaccggaaauggugcuucgaugggcagagaaauaaccagauccuggaagagaauauggacguggagauuuggacgaaggaaggagagaaaaagaagcugcgcccgcgguggcucgaugccagaaccuacuccgacccucuugcccugaaagaauuuaaggauuucgcugcgggccgcaaaagcaucgcccuggaccucguuacagagauugggagagugcccucucaccuggcucaucggacccgcaacgcccuugauaaucuggucaugcuccacacauccgaacacggaggcagagccuaucggcaugcuguggaggagcugccugaaaccauggagacgcugcuccuucugggccugaugauccuccugaccgggggagccaugcuuuuucugauuagcggcaaggggaucggaaaaacauccaucggccucauuugugucaucgcgucuagcgggaugcuguggauggccgaaauuccccugcaguggaucgcuuccgccauugugcucgaguucuuuaugaugguucuucugaucccugagcccgaaaagcaacgcaccccgcaggacaaccagcuggcuuacguggugauuggaauccucacacuggccgcgaucauugccgcuaaugagaugggccuucuggaaaccacgaagagagaucucggcaugagcaaagagccuggggucguuucucccacauccuaucuggacguggaucugcaccccgccagcgcuuggacccucuacgccguggcuacaaccgucaucaccccuaugcuucggcauacaauugaaaacucuacggccaacgugagccuggcggccaucgcuaaucaagccguugugcugaugggacucgacaagggcuggccgauuuccaaaauggaccugggggucccccuucuggcucucggaugcuacucucaggugaacccucugacccugacagccgccguccuccuucugaucacccacuaugcgaucauuggccccgggcugcaggcuaaggccacaagagaggcucagaaacgcaccgccgccggaaucaugaagaauccuacgguggauggcauuaugacaaucgaccucgaucccguuauuuacgacagcaaguucgagaaacaacugggccaggugaugcuucugguccucugugcugugcagcugcugcucaugcggaccuccugggcccuuugcgaagcgcugacccuggccacagggccuaucaccacacucugggagggaucuccgggcaaguuuuggaacacgaccaucgcuguuagcauggccaauauuuucagaggguccuaucuggcuggagccggccuugcguuuagcaucaugaaaucuguggggacaggaaagcgcggcaccggcucccagggggaaacacugggagagaaauggaagaagaaacucaaccaacugagccggaaggaguucgaucuguacaaaagauccggcauuaccgaggucgaccggacggaggccaaggaagggcucaaacgcggagagaucacccaucacgcugugucuagaggcagcgccaaacuucagugguuuguggaacggaauaugguuauucccgaggggcgcgucaucgaucugggauguggcagaggcgggugguccuauuacugcgcuggacugaaaaaggugacagaagugcggggcuauaccaaagggggaccuggccacgaggagcccgucccuaugucuacauacggguggaacauuguuaaacucaugagcggaaaggacguguucuaccugcccccggaaaaaugugauacccuucugugcgacaucggcgaguccagcccuucucccacaguggaagagucccgcaccaucagaguccucaagaugguggagcccuggcugaaaaauaaccaguucuguauuaagguucugaauccuuauaugcccacggugaucgaacaucucgagcggcuucagcgcaagcacggcgggaugcuggucagaaacccucugagcagaaauucuacacaugaaauguacuggauuuccaacggaaccggcaauaucguggccagcguuaacauggugucuagacuccugcuuaaccgcuuuaccaugacacaccggagaccgacgauugagaaagaugucgaccugggggcuggaacccgccacgugaaugccgaacccgagacaccuaacauggaugugaucggcgagcggaucaagagaauuaaagaggaacacaauagcaccuggcacuaugacgaagagaaccccuacaagacaugggcguaucauggguccuacgaagucaaagccaccggaucugcuagcuccaugaucaauggcguugugaagcuccugacaaagccuugggacgugguccccauggugacccaaauggccaugacggauaccacaccguucggccagcagcgcguuuuuaaagagaagguggacacccggacaccuagaagcaugcccgggacccgccgggucaugggaauuacggcugaguggcuguggagaacacucggccgcaacaaaaagccucggcugugcaccagagaagaguucaccaaaaaggugcgcaccaaugccgccaugggggcgguuuuuacggaagagaaccaaugggauuccgcuaaggccgccguggaagacgaggauuucuggaaacuugucgacagagagcgggaacugcacaagcucggaaaauguggcucuugcguguauaauaugauggggaagcgcgagaaaaagcugggcgaauuuggaaaagcuaagggcagcagagccaucugguacauguggcuuggggcucgguaccuggaguucgaggcccucggauuucugaacgaagaucauugguucuccagagaaaauucuuauagcggcguugaaggggagggacugcacaagcucggcuacauucugcgggacaucuccaaaauccccgggggcgcgauguaugccgaugacaccgcuggaugggauacacgcauuaccgaagacgaccuucacaacgaggagaagaucacacagcagauggauccugaacauagacagcuggccaaugcuauuuuuaaacucaccuaccaaaacaagguggucaaagugcagcggcccacaccgaccggcacggucauggacaucauuucucgcaaggaucagagagggagcggacaggugggcacauaugggcugaauaccuucaccaacauggaggcccaacuuauccggcagauggaaggagagggcguucuguccaaggcggaccucgaaaacccucaucugcccgagaaaaagaucacacaguggcuggagaccaaagggguggaacgccucaagagaauggccauuagcggcgaugacugcgucgugaaacccaucgaugaccgguuugcuaaugcccugcuugcucugaacgauaugggaaaggugcgcaaggacauuccucaguggcaaccgucuaaaggcuggcaugauuggcagcagguucccuucuguucccaccacuuccaugagcucaucaugaaggacgggagaaaacugguggucccuugccggccccaggaugaacuuauuggacgcgccagaaucagccaaggcgcuggguggucucugcgggagacagccugucucggaaaggcguacgcccagauguggacgcugauguauuuucaccgcagagaccugcggcucgcuuccaaugccauuugcagcgccgugccuguucauugggugcccaccucuagaacaaccugguccauccacgcucaucaccaguggaugacaaccgaagacaugcugacggucuggaaccgcguguggaucgaggauaauccuuggauggaggacaaaacccccgucacaaccugggaagaugugccguaccuuggcaagcgggaggaccaauggugugggagccugauuggccucacauccagagccaccugggcgcagaacaucccuacggcuauucagcagguucgcagccugaucggaaaugaagaguuccuugauuacaugcccucuaugaagcgguuuagaaaagaggaagagagcgaaggcgccauuugguga

SEQ ID NO: 20640 - RNA, 9873 nt, Artificial Sequence
  derived and/or modified CDS sequence (opt5) from DENV-3__KJ189292__SS-prME
accagccugugccucaugaugauccugcccgccgcucuugccuuccaccugaccucccgggacggagaaccucggaugauuguggggaagaacgaacgcggaaaaucucuccuguuuaagacggcgagcggcaucaauauguguacccuuauugcuauggaucugggggaaaugugcgacgauaccgucaccuacaaauguccgcauaucacagaagccgagcccgaagacauugauugcugguguaaccucaccuccacauggguuaccuauggaacgugcaaucaggccggcgagcacagacgggacaagcgcucuguggcucuggccccucauguggggaugggacuggauaccagaacacagaccuggaugagcgcugagggcgccuggcggcaggucgaaaaaguggagacaugggcgcuccgccaccccggcuucaccauccuggcccuuuuucuggcucauuacaucgggacgucccucacacagaagguugugauuuucauccugcuuaugcuggucaccccuucuaugacaaugagaugugugggaguuggcaaccgggacuuuguggaagggcucagcggagccaccugggucgauguggugcuggagcacggcgggugcgucaccacaauggcuaagaauaaacccacgcuggacauugagcuccagaagaccgaagccacacaacuggcgacccuucgcaaacuguguaucgagggaaagauuacaaacaucaccacggauuccagaugcccuacacagggcgaagccguucucccggaggaacaggaccagaauuauguguguaaacacaccuacguggaucggggcugggggaacggaugcggccuguucgggaagggaagccuugucacaugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccacccugcccgaauauggcacgcuggggcucgagugcuccccucgcaccggacuggacuucaaugagaugauccuucugacaaugaaaaacaaggccuggauggugcauagacagugguuuuucgaucucccccugccguggaccagcggcgcuacaaccgaaacgccuacauggaaucggaaagagcuucuggucaccuuuaagaacgcgcacgccaaaaagcaagaaguggucgugcucgggucucaggagggagcuaugcacacagcccugaccggcgccaccgaaauucaaaauuccgggggcacaagcaucuucgcuggacaucugaagugucgccucaaaauggacaagcuggagcuuaaaggcaugucuuacgccaugugcacgaacaccuuuguucugaagaaagagguguccgaaacacagcacgggaccauucucaucaaggucgaguacaagggagaagaugcgcccuguaaaaucccuuucagcacagaggacggccaugggaaggcucacaacggaagacugauuaccgccaaucccgugguuacgaaaaaggaggaacccgugaacaucgaggccgaaccuccguucggcgaguccaauauuaugaucgggauuggcgauaacgcucugaaaaucaauugguauaagaagggaucuagcaucggcaaaauguuugaagccacagcuagaggggcgagacgcauggcgauucuuggagacaccgccugggauuucggcuccgucgggggagugcucaacagccugggcaagauggugcaucaaaucuuugggucugcuuacaccgcccuguucuccggcguuagcugggucaugaaaauuggaaucggcgugcuccugacauggauugggcuuaauucuaagaacaccagcauguccuuuucuugcaucgcuauuggaaucaucacacuguaucucggcgccgugguccaggcggacaugggguguauuaucaauuggaaaggaaaggagcugaagugcggcagcgggauuuucgugacgaacgagguucacaccuggacagaacaguacaaauuucaggccgauucccccaagcggcuggcuaccgccaucgcuggcgccugggagaauggaguguguggcauuagaagcacaacccgcauggaaaaccuucucuggaaacaaaucgccaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggcuaagaucgucacagcggaaacccagaacuccagcuucauuaucgauggaccuaauacacccgagugcccgucugccuccagagcuuggaacgugugggaaguugaggacuauggcuuuggcguguucaccacgaauaucuggcuccgccugcgggaagucuacacacaacugugugaccacagacuuaugagcgccgccgugaaagaugagcgcgcugugcaugccgacaugggguacuggauugagucccagaagaacggaucuuggaaacucgaaaaggcgagccugaucgaggucaaaaccugcaccuggccuaagucccacacacuguggucuaauggcguucucgaaagcgauaugauuauccccaagucccuggcugggccuauuagccagcauaaccaccggcccggauaucacacccagacggccggcccuuggcaucuugggaaacuggagcucgacuuuaauuacugcgagggaacaaccguggugaucacagaaaacuguggcaccagaggccccucucugcgcacaaccacggucuccgggaagcugauccacgaguggugcugucggagcugcacccuuccgccucucagauauaugggagaagauggcuguugguacgggauggagauucggcccaucucugaaaaagaggagaauauggugaagucccugguuagcgccggaucuggcaaaguggacaacuucacaauggggguccugugccucgcuauucuguuugaagaggugaugcgcggaaaguucggcaagaaacauaugaucgccggcguuuucuuuaccuucgugcuucugcucagcgggcaaauuacauggagagauauggcgcacacccugaucaugauuggauccaaugcuagcgaccggaugggcaugggggucacguaucuggcccuuaucgccacauuuaagauccagcccuuccuggcucucggauuuuuccugagaaaacucaccucucgcgaaaaccugcuucugggcguggggcucgccauggcuacaacccugcagcugccugaggauauugaacaaauggccaauggaaucgcgcuuggccugauggcccucaagcugauuacccaguuugagacauaccagcucuggacggcucugaucucccuuaccuguagcaacacaauuuucacccugacaguugccuggcggaccgcuacgcucauccuggccggcgugucccugcuuccggucugccagucuagcuccaugagaaaaacagacuggcugcccauggccguggcugcgaugggggugccuccccucccucuguuuaucuucucucucaaggauacccugaagcgcagaagcuggccccuuaaugagggagucauggccguuggccugguguccauucuggcuucuagccuccugcggaacgacgugccuauggccgggccccuugucgccggaggccugcucaucgcuuguuaugugauuaccgggacauccgccgaucugaccguugaaaaagcggcugacaucacaugggaggaagaggccgaacaaacgggagugagccauaaccucaugauuaccgucgacgaugacggcacaaugcgcaucaaggaugacgagaccgagaauauccugacagugcuucugaaaaccgcccugcucauuguuucuggcaucuuuccguacuccauuccugcuacgcugcuuguguggcacaccuggcagaagcagacacagagaagcgggguccugugggaugugcccucuccucccgaaacccaaaaagccgagcucgaagagggagucuaccggaucaagcagcagggcauuuucgggaaaacacaggugggaguuggcgugcaaaaggagggggucuuucacaccauguggcaugugacacgcggagcgguucugacguauaacggcaagagacucgaaccgaauugggcuuccgugaaaaaggaccugaucagcuacggcgggggauggcggcuuucuacccaguggcagaaaggcgaggaaguccaagugauugccguggagccugggaagaaccccaaaaauuuccagacaaucccuggaaccuuccagaccacaacgggcgaaaucggggccauugcucuggauuuuaagcccggaaccuccggcagccccaucauuaaccgcgagggcaagguugucgggcuguauggaaauggcguggugaccaagaacgggggauacgucuccggcaucgcccagaccaaugcugagccugacgggagcacaccggaacucgaggaagagauguucaagaaaagaaaccugaccauuauggaucuucaccccggcucuggaaagacgcggaaauaucugccugccaucgugcgcgaagcgaucaagagacggcucagaacacugauucucgcccccacccgcguuguggcugccgagauggaggaagcucugaagggccuuccuauccgguaccaaaccacagccaccaaaagcgagcauacagggagagaaauugucgaccugaugugccacgccaccuuuacgaugcgccugcucucccccgugcggguuccuaauuauaaccugaucauuauggaugaggcucauuucacagacccggcgucuaucgccgcuagaggauacaucagcacccgcgugggcaugggggaagccgccgcuauuuuuaugacagccacacccccuggaacggcggaugcuuucccccaguccaaugccccuauccaggacgaggagcgggacauucccgaaagaucuuggaacagcggcaaugaguggaucaccgauuuugccgggaagacagucugguucgugccguccauuaaagcuggcaacgacaucgccaacugucuucgcaagaauggcaaaaagguuauucagcugucucggaagaccuuugauacagaauaccagaaaaccaagcucaacgacugggauuucguggucacaaccgacaucagcgagaugggagcgaauuuuaaagccgauagagugaucgacccucggcgcugccugaagcccgugauucugacggaugggcccgagagagucauccucgcuggaccuaugcccguuacaguggccuccgcugcccagcggcgcggcagaguggggcggaacccucagaaagaaaaugaccaguauauuuucaccggacaaccgcuuaacaaugaugaggaccacgcucacuggaccgaagccaagaugcugcuggacaacaucaauacacccgagggcauuaucccugcccucuucgaacccgagagagaaaagagcgccgcuaucgauggggaauaccgccugaaaggcgagucucggaagaccuuugucgaacuuaugagacgcggagaccugccuguguggcucgcccauaaaguugcuuccgagggcauuaaguauacagaucggaaauggugcuucgacgggcagagaaacaaucagauccuggaagagaacauggauguggagauuuggacgaaggaaggagagaaaaagaagcugcgcccccgguggcucgacgccagaaccuacagcgauccgcuugcccugaaagaauuuaaggacuucgcugcgggccgcaaaucuaucgcccuggaucucgucacagagauugggagagugccuucccaccuggcucaucggacccgcaaugcccuugacaaccugguuaugcuccacacaagcgaacacggaggcagagccuaucggcaugcuguggaggagcugcccgaaaccauggagacgcugcuccuucugggccugaugauccuccugaccgggggagccaugcuuuuucugaucuccggcaaggggauuggaaaaacaucuaucggccucauuugugucaucgcgagcuccgggaugcuguggauggccgaaauuccucugcaguggaucgcuagcgccauugugcucgaguucuuuaugaugguccuucugauccccgagccugaaaagcaacgcacaccccaggauaaucagcuggcuuacgugguuaucggcauucucacacuggccgcgaucauugccgcuaacgagaugggccuucuggaaaccacgaagagagaccucggcaugucuaaagagccgggggugguguccccuacaagcuaucuggaugucgaccugcaccccgccucugcuuggacccucuacgccguugcuacaaccgugaucacccccaugcuucggcauacaauugaaaauagcacggccaacgugucccuggcggccaucgcuaaccaagccgucgugcugaugggacucgacaagggcuggccuaucucuaaaauggaucuggggguuccgcuucuggcucucggaugcuacagccaggugaauccccugacccugacagccgccguccuccuucugauuacccacuaugcgaucauuggcccugggcugcaggcuaaggccacaagagaggcucagaaacgcaccgccgccggaaucaugaagaaccccacgguggacggcauuaugacaaucgaucucgacccugucaucuacgauuccaaguucgagaaacaacugggccaggugaugcuucugguucucugugcugugcagcugcugcucaugcggaccucuugggcccuuugcgaagcgcugacccuggccacagggcccauuaccacacucugggagggaagcccuggcaaguuuuggaauacgaccaucgcugucuccauggccaacauuuucagagggagcuaucuggcuggagccggccuugcguuuucuaucaugaaauccguggggacaggaaagcgcggcaccggcagccagggggaaacacugggagagaaauggaagaagaaacucaaucaacugucccggaaggaguucgaccuguacaaaaagucuggcauuaccgagguugauagaacggaggccaaagaagggcucaagcggggagagaucacccaucacgcugugagccgcggcuccgccaaacuucagugguuugucgaaagaaacauggugauuccggaggggcgggugaucgaccugggauguggccgcggcggguggucuuauuacugcgcuggacugaagaagguuacagaagucagaggcuauaccaaagggggacccggccacgaggagccugugcccaugagcacauacggguggaauaucgugaagcucauguccggaaaagaugucuucuaccugccucccgaaaagugugacacccuucugugcgauauuggcgagagcucuccguccccuacaguugaagagagccggaccauccgcgugcucaaaaugguggagcccuggcugaagaacaaucaguucuguauuaagguccugaaccccuauaugccuacggugaucgaacaucucgagagacuucagcggaaacacggcgggaugcugguucgcaauccccugucuagaaacuccacacaugaaauguacuggauuagcaauggaaccggcaacaucguggccucugucaauauggugagccggcuccugcuuaacagauuuaccaugacacaccgccggccuacgaucgagaaggacguugaucugggggcuggaaccagacacgugaacgccgaaccggagacacccaauauggacgucauuggcgagcgcaucaaacggauuaaggaagaacacaacuccaccuggcacuaugacgaugaaaauccuuacaaaacaugggcguaucaugggucuuacgaggugaaggccaccggaagcgcuuccagcaugaucaacggcguggucaagcuccugacaaaacccugggacguugugccuauggugacccaaauggccaugacggauaccacacccuucggccagcagagagucuuuaaggaaaaaguggacacccgcacaccgcgguccaugccugggaccagacgcguuaugggaauuacggcugaguggcuguggcggacacucggcagaaauaagaaaccccgccugugcacccgggaggaguucacaaagaaggugagaaccaacgccgccaugggggcggucuuuacggaggaaaaucaaugggauucugcuaaagccgccguggaggacgaagauuucuggaaacuuguugaccgcgagagagagcugcacaaacucggaaaguguggcagcugcguguauaacaugauggggaaacgggaaaagaaacugggcgaguuuggaaaggcuaagggcucccgcgccaucugguacauguggcuuggggcuagauaccuggaguucgaggcccucggauuucugaaugaggaucauugguucucucgggaaaacagcuauuccggcgucgagggggaaggacugcacaaacucggcuacauccugagagacauuucuaagaucccugggggcgcgauguaugccgaugacaccgcuggaugggacacacggauuaccgaggaugaccuucacaaugaagagaaaaucacacagcagauggaucccgagcaucgccagcuggccaacgcuauuuuuaagcucaccuaccaaaauaaagugguuaaggugcagagaccuacacccaccggcacggucauggacaucaucagccggaaggaucagcgcggguccggacaggugggcacauaugggcugaacaccuucaccaauauggaaguccaacuuauuagacagauggagggagaaggcgugcugagcaaagccgaccucgagaacccgcaucugccugaaaagaaaaucacacaguggcuggagaccaaggggguugagcggcucaaacgcauggcgauuucuggcgaugacugcguggucaagcccaucgaugacagauuugccaacgcucugcuugcccugaaugauaugggaaagauucggaaagacaucccccaguggcaaccuuccaagggcuggcaugauuggcaacaggugccguucuguagccaccacuuccaugaacucauuaugaaagacgggcgcaagcuggugguucccugcagaccucaggacgagcuuaucggacgggcucgcaucucucaaggcgccggguggucccugagagaaacagcuugucucggaaaagccuacgcgcagauguggagccugauguauuuucaccggcgcgaucugagacucgccucuaacgcuauuugcuccgccgugcccguccauugggugccuacgagccggaccacaugguccauccacgcccaucaccaguggaugaccacagaggacaugcugaccguuuggaauagaguguggauugaagauaaccccuggauggaggacaagacgccugucaccacaugggaggaugugcccuaccuuggcaagcgcgaagaccaauggugugggagccugaucggccucaccucucgggcuacaugggcccagaauauuccgaccgcgauccagcaggucagaagccugaucggaaacgaggaguuccuugauuacaugccuuccaugaaacgcuuucggaaggaggaggaaucugagggcgcuauuugguga

SEQ ID NO: 20641 - RNA, 9873 nt, Artificial Sequence
  derived and/or modified CDS sequence (opt5) from DENV-3__KJ189293__SS-prME
accagccugugccucaugaugauccugcccgcggcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccagaacuccagcuucaucauugauggaccuaauacacccgagugcccgucugcguccagagccuggaacgucugggaaguggaggacuauggcuuuggcguguucaccacgaauaucuggcuccgccugcgggaagucuacacacaacugugugaccacagacuuaugagcgcugccguuaaagaugagcgcgccgugcaugcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccaccggcccggauaucacacccagacggcuggcccuuggcaucuugggaaacuggagcucgacuuuaauuacugcgagggaacaaccgugguuauuacagaaaacuguggcaccagaggccccucucugcgcacaaccacgguguccgggaagcugauccacgaguggugcugucggagcugcacccuuccgccucucagauauaugggagaagauggcuguugguacgggauggagauccggcccauuucugaaaaagaggagaauauggucaagucccuggugagcgccggaucuggcaaaguugacaacuucacaaugggggugcugugccucgccauccuguuugaagaggucaugcgcggaaaguucggcaagaaacauaugauugcuggcguguucuuuaccuucguucuucugcucagcgggcaaaucacauggagagauauggcccacacccugauuaugaucggauccaaugcgagcgaccggaugggcaugggggugacguaucuggcucuuauugccacauuuaagauccagcccuuccuggcccucggauuuuuccugagaaaacucaccucucgcgaaaaccugcuucugggcgucgggcucgcuauggccacaacccugcagcugccugaggauaucgaacaaauggcuaauggaauugcccuuggccugauggcgcucaagcugaucacccaguuugagacauaccagcucuggacggcccugauuucccuuaccuguagcaacacaaucuucacccugacaguggcuuggcggaccgccacgcucauucuggcuggcgugucccugcuuccggucugccagucuagcuccaugagaaaaacagacuggcugcccauggccguugccgcuaugggggugccuccccucccucuguuuaucuucucucucaaggauacccugaagcgcagaagcuggccccuuaaugagggagugauggcggucggccugguguccauccuggccucuagccuccugcggaacgacguuccuauggcugggccccuuguggccggaggccugcucauugccuguuaugucaucaccgggacauccgcugaucugaccguggaaaaagccgcggacauuacaugggaggaagaggcugaacaaacgggaguuagccauaaccucaugaucaccguggacgaugacggcacaaugcgcauuaaggaugacgagaccgagaauauccugacaguccuucugaaaaccgcccugcucaucgugucuggcauuuuuccguacuccaucccugccacgcugcuugucuggcacaccuggcagaagcagacacagagaagcggggugcugugggauguucccucuccucccgaaacccaaaaagcugagcucgaagagggaguguaccggauuaagcagcagggcaucuucgggaaaacacaggucggagugggcguucaaaaggaggggguguuucacaccauguggcaugucacacgcggagccgugcugacguauaacggcaagagacucgaaccgaauugggcguccgugaaaaaggaccugauuagcuacggcgggggauggcggcuuucuacccaguggcagaaaggcgaggaaguucaagucaucgcuguggagccugggaagaaccccaaaaauuuccagacaaugccuggaaccuuccagaccacaacgggcgaaauuggggccaucgcccuggauuuuaagcccggaaccuccggcagccccaucauuaaccgcgagggcaagguggucgggcuguauggaaauggcgugguuaccaagaacgggggauacguguccggcaucgcucagaccaaugccgagccugacgggccgacacccgaacucgaggaagagauguucaagaaaagaaaccugaccauuauggaucuucacccuggcagcggaaagacgcggaaauaucugcccgcuaucguccgcgaagccauuaagagacggcucagaacacugauccucgcgccuacccgcgugguugccgcugagauggaggaagcccugaagggccuucccauccgguaccaaaccacagcuaccaaaucugagcauacagggagagaaauuguggaccugaugugccacgccaccuuuacgaugcgccugcucagcccuguccgggugccgaauuauaaccugaucauuauggaugaggcccauuucacagaccccgcuuccaucgcggccagaggauacauuucuacccgcguuggcaugggggaagcugccgccaucuuuaugacagcuaccccucccggaacggccgaugcguucccucagagcaaugcucccauccaggacgaggagcgggacauuccggaaagauccuggaacucuggcaaugaguggaucaccgauuuugccgggaagacagugugguucgucccuagcauuaaagccggcaacgacaucgcuaacugucuucgcaagaauggcaaaaaggugauucagcugucccggaagaccuuugauacagaauaccagaaaacaaagcucaacgacugggauuucguggucacaaccgacaucucugagaugggagccaauuuuaaagcggauagaguuauugacccccggcgcugccugaagcccgugauccugacggaugggccugagagagugauccucgccggacccaugccugucacagcugccagcgcugcccagcggcgcggcagaguggggcggaacccgcagaaagaaaaugaccaguauauuuucaccggacaaccccuuaacaaugaugaggaccacgcucacuggaccgaagccaagaugcugcuggacaacaucaauacaccugagggcauuauccccgcccucuucgaaccugagagagagaaguccgccgcuauugauggggaauaccgccugaaaggcgagagccggaagaccuuuguugaacuuaugagacgcggagaccugcccguguggcucgcccauaaagucgcuucugagggcaucaaguauacagaucggaaauggugcuucgacgggcagagaaacaaucagauccuggaagagaacauggauguggagauuuggacgaaggaaggagagaaaaagaagcugcgcccgcgguggcucgacgccagaaccuacuccgauccucuugcccugaaagaauuuaaggacuucgcugcgggccgcaaaagcaucgcccuggaucucguuacagagauugggagagugcccucucaccuggcucaucggacccgcaaugcccuugacaaccuggucaugcuccacacauccgaacacggaggcagagccuaucggcaugcuguggaggagcugccugaaaccauggagacgcugcuccuucugggccugaugauccuccugaccgggggagccaugcuuuuucugauuagcggcaaggggaucggaaaaacauccaucggccucauuugugucaucgcgucuagcgggaugcuguggauggccgaaauuccccugcaguggaucgcuuccgccauugugcucgaguucuuuaugaugguucuucugaucccugagcccgaaaagcaacgcaccccgcaggauaaucagcuggcuuacguggugauuggaauccucacacuggccgcgaucauugccgcuaacgagaugggccuucuggaaaccacgaagagagaccucggcaugagcaaagagccuggggucguuucucccacauccuaucuggauguggaccugcaccccgccagcgcuuggacccucuacgccguggcuacaaccgucaucaccccuaugcuucggcauacaauugaaaauucuacggccaacgugagccuggcggccaucgcuaaccaagccguugugcugaugggacucgacaagggcuggccgauuuccaaaauggaucugggggucccccuucuggcucucggaugcuacucucaggugaauccucugacccugacagccgccguccuccuucugaucacccacuaugcgaucauuggccccgggcugcaggcuaaggccacaagagaggcucagaaacgcaccgccgccggaaucaugaagaacccuacgguggacggcauuaugacaaucgaucucgaccccguuauuuacgauagcaaguucgagaaacaacugggccaggugaugcuucugguccucugugcugugcagcugcugcucaugcggaccuccugggcccuuugcgaagcgcugacccuggccacagggccuaucaccacacucugggagggaucuccgggcaaguuuuggaauacgaccaucgcuguuagcauggccaacauuuucagaggguccuaucuggcuggagccggccuugcguuuagcaucaugaaaucuguggggacaggaaagcgcggcaccggcucccagggggaaacacugggagagaaauggaagaagaaacucaaucaacugagccggaaggaguucgaccuguacaaaaaguccggcauuaccgaggucgauagaacggaggccaaagaagggcucaagcggggagagaucacccaucacgcugugucucgcggcagcgccaaacuucagugguuuguggaaagaaacaugguuauucccgaggggcgggucaucgaccugggauguggccgcggcgggugguccuauuacugcgcuggacugaagaaggugacagaagugagaggcuauaccaaagggggaccuggccacgaggagcccgucccuaugucuacauacggguggaauauuguuaagcucaugagcggaaaagauguguucuaccugcccccggaaaagugugacacccuucugugcgauaucggcgaguccagcccuucucccacaguggaagagucccggaccauccgcguccucaaaaugguggagcccuggcugaagaacaaucaguucuguauuaagguucugaacccuuauaugcccacggugaucgaacaucucgagagacuucagcggaaacacggcgggaugcugguccgcaauccucugagcagaaacucuacacaugaaauguacuggauuuccaauggaaccggcaacaucguggccagcguuaauauggugucucggcuccugcuuaacagauuuaccaugacacaccgccggccgacgauugagaaggacgucgaucugggggcuggaaccagacacgugaacgccgaacccgagacaccuaauauggacgugaucggcgagcgcaucaaacggauuaaggaagaacacaacagcaccuggcacuaugacgaugaaaaucccuacaaaacaugggcguaucauggguccuacgaggucaaggccaccggaucugcuagcuccaugaucaacggcguugugaagcuccugacaaaaccuugggacgugguccccauggugacccaaauggccaugacggauaccacaccguucggccagcagagaguuuuuaaggaaaaaguggacacccgcacaccucggagcaugcccgggaccagacgcgucaugggaauuacggcugaguggcuguggcggacacucggcagaaauaagaaaccucgccugugcacccgggaggaguucacaaagaaggugagaaccaacgccgccaugggggcgguuuuuacggaggaaaaucaaugggauuccgcuaaagccgccguggaggacgaagauuucuggaaacuugucgaccgcgagagagagcugcacaaacucggaaaguguggcucuugcguguauaacaugauggggaaacgggaaaagaaacugggcgaguuuggaaaggcuaagggcagccgcgccaucugguacauguggcuuggggcuagauaccuggaguucgaggcccucggauuucugaaugaggaucauugguucucccgggaaaacucuuauagcggcguugagggggaaggacugcacaaacucggcuacauucugagagacaucuccaagauccccgggggcgcgauguaugccgaugacaccgcuggaugggacacacggauuaccgaggaugaccuucacaaugaagagaaaaucacacagcagauggauccugagcaucgccagcuggccaacgcuauuuuuaagcucaccuaccaaaauaaaguggucaaggugcagagacccacaccgaccggcacggucauggacaucauuucucggaaggaucagcgcgggagcggacaggugggcacauaugggcugaacaccuucaccaauauggaagcccaacuuaucagacagauggagggagaaggcguucuguccaaagcggaccucgagaacccucaucugcccgaaaagaaaaucacacaguggcuggagaccaaggggguggagcggcucaaacgcauggccauuagcggcgaugacugcgucgugaagcccaucgaugacagauuugcuaacgcccugcuugcucugaaugauaugggaaaggugcggaaagacauuccucaguggcaaccgucuaagggcuggcaugauuggcagcagguucccuucuguucccaccacuuccaugaacucaucaugaaagacgggcgcaagcugguggucccuugcagaccccaggacgagcuuauuggacgggcccgcaucagccaaggcgcuggguggucucugagagaaacagccugucucggaaaagcguacgcccagauguggucccugauguauuuucaccggcgcgaucugagacucgcuagcaacgccauuugcucugccgugccuguucauugggugcccacgucccggaccacauggagcauccacgcucaucaccaguggaugaccacagaggacaugcugaccgucuggaauagaguguggaucgaagauaacccuuggauggaggacaagacgcccgucaccacaugggaggaugugccguaccuuggcaagcgcgaagaccaauggugugggucccugauuggccucaccagccgggccacaugggcgcagaauaucccuaccgcuauucagcagguuagaucucugaucggaaacgaggaguuccuugauuacaugcccagcaugaaacgcuuucggaaggaggaggaauccgagggcgccauuugguga

SEQ ID NO: 20642 - RNA, 9873 nt, Artificial Sequence
  derived and/or modified CDS sequence (opt5) from DENV-3__KJ189294__SS-prME
accagccugugccucaugaugauccugcccgcggcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggcauucuggagcagggcaaacggacccuuacaccucagcccauggagcugaaguacucuuggaaaaccugggggaaggccaagaucguuacagcugaaacccagaacuccagcuucauuaucgauggaccuaauacacccgagugcccgucugcguccagagccuggaacgugugggaagucgaggacuauggcuuuggcguguucaccacgaauaucuggcuccgccugcgggaaguguacacacaacugugugaccacagacuuaugagcgcugccgucaaagaugagcgcgccguucaugcugacaugggguacuggauugagucccagaagaacggaucuuggaaacucgaaaaggccagccugaucgaggugaaaaccugcaccuggccuaagucccacacacuguggucuaauggcgugcucgaaagcgauaugauuauccccaagucccuggcggggccuauuagccagcauaaccaccggcccggauaucacacccagacggcuggcccuuggcaucuugggaaacuggagcucgacuuuaauuacugcgagggaacaaccgucgugaucacagaaaacuguggcaccagaggccccucucugcgcacaaccacgguuuccgggaagcugauccacgaguggugcugucggagcugcacccuuccgccucucagauauaugggagaagauggcuguugguacgggauggagauucggcccaucucugaaaaagaggagaauauggugaagucccuggucagcgccggaucuggcaaaguggacaacuucacaauggggguucugugccucgccauucuguuugaagaggugaugcgcggaaaguucggcaagaaacauaugaucgcuggcgucuucuuuaccuucgugcuucugcucagcgggcaaauuacauggagagauauggcccacacccugaucaugauuggauccaaugcgagcgaccggaugggcauggggguuacguaucuggcucuuaucgccacauuuaagauccagcccuuccuggcccucggauuuuuccugagaaaacucaccucucgcgaaaaccugcuucugggcguggggcucgcuauggccacaacccugcagcugccugaggauauugaacaaauggcuaauggaaucgcccuuggccugauggcgcucaagcugauuacccaguuugagacauaccagcucuggacggcccugaucucccuuaccuguagcaacacaauuuucacccugacagucgcuuggcggaccgccacgcucauccuggcuggcgugucccugcuuccggugugccagucuagcuccaugagaaaaacagacuggcugcccauggccgucgccgcuauggggguuccuccccucccucuguuuaucuucucucucaaggauacccugaagcgcagaagcuggccccuuaaugagggagugauggcggugggccuggucuccauucuggccucuagccuccugcggaacgacgugccuauggcugggccccuuguugccggaggccugcucaucgccuguuaugugauuaccgggacauccgcugaucugaccgucgaaaaagccgcggacaucacaugggaggaagaggcugaacaaacgggagugagccauaaccucaugauuaccguugacgaugacggcacaaugcgcaucaaggaugacgagaccgagaauauccugacagugcuucugaaaaccgcccugcucauugucucuggcaucuuuccguacuccauuccugccacgcugcuuguguggcacaccuggcagaagcagacacagagaagcgggguccugugggaugugcccucuccucccgaaacccaaaaagcugagcucgaagagggaguuuaccggaucaagcagcagggcauuuucgggaaaacacaggugggagucggcgugcaaaaggaggggguuuuucacaccauguggcaugugacacgcggagccguccugacguauaacggcaagagacucgaaccgaauugggcguccgugaaaaaggaccugaucagcuacggcgggggauggcggcuuucuacccaguggcagaaaggcgaggaagugcaaguuauugcugucgagccugggaagaaccccaaaaauuuccagacaaugccuggaaccuuccagaccacaacgggcgaaaucggggccaucgcccuggauuuuaagcccggaaccuccggcagccccauuaucaaccgcgagggcaaggugguggggcuguauggaaauggcgucgugaccaagaacgggggauacguuuccggcauugcucagaccaaugccgagccugacgggccgacacccgaacucgaggaagagauguucaagaaaagaaaccugaccaucauggaucuucacccuggcagcggaaagacgcggaaauaucugcccgcuauugugcgcgaagccaucaagagacggcucagaacacugauccucgcgccuacccgcgucguggccgcugagauggaggaagcccugaagggccuucccauucgguaccaaaccacagcuaccaaaucugagcauacagggagagaaaucguugaccugaugugccacgccaccuuuacgaugcgccugcucagcccugugcgggucccgaauuauaaccugauuaucauggaugaggcccauuucacagaccccgcuuccauugcggccagaggauacaucucuacccgcgugggcaugggggaagcugccgccaucuuuaugacagcuaccccucccggaacggccgaugcguucccucagagcaaugcucccauucaggacgaggagcgggacaucccggaaagauccuggaacucuggcaaugaguggauuaccgauuuugccgggaagacaguuugguucgugccuagcaucaaagccggcaacgacauugcuaacugucuucgcaagaauggcaaaaaggucauccagcugucccggaagaccuuugauacagaauaccagaaaacaaagcucaacgacugggauuucguggugacaaccgacauuucugagaugggagccaauuuuaaagcggauagagucaucgacccccggcgcugccugaagcccguuauccugacggaugggccugagagagugauucucgccggacccaugccugugacagcugccagcgcugcccagcggcgcggcagagucgggcggaacccgcagaaagaaaaugaccaguauaucuucaccggacaaccccuuaacaaugaugaggaccacgcucacuggaccgaagccaagaugcugcuggacaacauuaauacaccugagggcaucauucccgcccucuucgaaccugagagagagaaguccgccgcuaucgauggggaauaccgccugaaaggcgagagccggaagaccuuuguggaacuuaugagacgcggagaccugcccguuuggcucgcccauaaaguggcuucugagggcaucaaguauacagaucggaaauggugcuucgacgggcagagaaacaaucagauucuggaagagaacauggaugucgagaucuggacgaaggaaggagagaaaaagaagcugcgcccgcgguggcucgacgccagaaccuacuccgauccucuugcccugaaagaauuuaaggacuucgcugcgggccgcaaaagcauugcccuggaucucgugacagagaucgggagaguucccucucaccuggcucaucggacccgcaaugcccuugacaaccuggugaugcuccacacauccgaacacggaggcagagccuaucggcaugcugucgaggagcugccugaaaccauggagacgcugcuccuucugggccugaugauucuccugaccgggggagccaugcuuuuucugaucagcggcaaggggaucggaaaaacauccauuggccucaucugugugauugcgucuagcgggaugcuguggauggccgaaaucccccugcaguggauugcuuccgccaucguccucgaguucuuuaugauggugcuucugauuccugagcccgaaaagcaacgcaccccgcaggauaaucagcuggcuuacguugugaucggaauccucacacuggccgcgauuaucgccgcuaacgagaugggccuucuggaaaccacgaagagagaccucggcaugagcaaagagccugggguggucucucccacauccuaucuggauguugaccugcaccccgccagcgcuuggacccucuacgccguggcuacaaccgugauuaccccuaugcuucggcauacaaucgaaaauucuacggccaacgucagccuggcggccauugcuaaccaagccgugguucugaugggacucgacaagggcuggccgaucuccaaaauggaucugggggugccccuucuggcucucggaugcuacucucaggucaauccucugacccugacagccgccgugcuccuucugaucacccacuaugcgauuaucggccccgggcugcaggcuaaggccacaagagaggcucagaaacgcaccgccgccggaauuaugaagaacccuacggucgacggcaucaugacaauugaucucgaccccgugaucuacgauagcaaguucgagaaacaacugggccagguuaugcuucuggugcucugugcuguccagcugcugcucaugcggaccuccugggcccuuugcgaagcgcugacccuggccacagggccuaucaccacacucugggagggaucuccgggcaaguuuuggaauacgaccauugcugugagcauggccaacaucuucagaggguccuaucuggcuggagccggccuugcguuuagcauuaugaaaucuguugggacaggaaagcgcggcaccggcucccagggggaaacacugggagagaaauggaagaagaaacucaaucaacugagccggaaggaguucgaccuguacaaaaaguccggcaucaccgagguggauagaacggaggccaaagaagggcucaagcggggagagauuacccaucacgcugucucucgcggcagcgccaaacuucagugguuuguggaaagaaacauggugauccccgaggggcggguuauugaccugggauguggccgcggcgggugguccuauuacugcgcuggacugaagaaggucacagaagugagaggcuauaccaaagggggaccuggccacgaggagcccgugccuaugucuacauacggguggaauaucgucaagcucaugagcggaaaagauguuuucuaccugcccccggaaaagugugacacccuucugugcgauaucggcgaguccagcccuucucccacaguggaagagucccggaccauucgcgugcucaaaauggucgagcccuggcugaagaacaaucaguucuguaucaaggugcugaacccuuauaugcccacgguuauugaacaucucgagagacuucagcggaaacacggcgggaugcuggugcgcaauccucugagcagaaacucuacacaugaaauguacuggaucuccaauggaaccggcaacauugucgccagcgugaauaugguuucucggcuccugcuuaacagauuuaccaugacacaccgccggccgacgaucgagaaggacguggaucugggggcuggaaccagacacgucaacgccgaacccgagacaccuaauauggacgugaucggcgagcgcauuaaacggaucaaggaagaacacaacagcaccuggcacuaugacgaugaaaaucccuacaaaacaugggcguaucauggguccuacgaggugaaggccaccggaucugcuagcuccaugauuaacggcgucguuaagcuccugacaaaaccuugggacguggugcccauggucacccaaauggccaugacggauaccacaccguucggccagcagagaguguuuaaggaaaaaguugacacccgcacaccucggagcaugcccgggaccagacgcgugaugggaaucacggcugaguggcuguggcggacacucggcagaaauaagaaaccucgccugugcacccgggaggaguucacaaagaaggucagaaccaacgccgccaugggggcgguguuuacggaggaaaaucaaugggauuccgcuaaagccgccguugaggacgaagauuucuggaaacuuguggaccgcgagagagagcugcacaaacucggaaaguguggcucuugcgucuauaacaugauggggaaacgggaaaagaaacugggcgaguuuggaaaggcuaagggcagccgcgccauuugguacauguggcuuggggcuagauaccuggaguucgaggcccucggauuucugaaugaggaucauugguucucccgggaaaacucuuauagcggcguggagggggaaggacugcacaaacucggcuacauccugagagacaucuccaagauucccgggggcgcgauguaugccgaugacaccgcuggaugggacacacggaucaccgaggaugaccuucacaaugaagagaaaauuacacagcagauggauccugagcaucgccagcuggccaacgcuaucuuuaagcucaccuaccaaaauaaaguugugaagguccagagacccacaccgaccggcacggugauggacauuaucucucggaaggaucagcgcgggagcggacaggucggcacauaugggcugaacaccuucaccaauauggaagcccaacuuaucagacagauggagggagaaggcgugcuguccaaagcggaccucgagaacccucaucugcccgaaaagaaaauuacacaguggcuggagaccaaggggguugagcggcucaaacgcauggccaucagcggcgaugacugcguggucaagcccauugaugacagauuugcuaacgcccugcuugcucugaaugauaugggaaaggugcggaaagacaucccucaguggcaaccgucuaagggcuggcaugauuggcaacaggugcccuucuguucccaccacuuccaugaacucauuaugaaagacgggcgcaagcugguugugccuugcagaccccaggacgagcuuaucggacgggcccgcauuagccaaggcgcuggguggucucugagagaaacagccugucucggaaaagcguacgcccagauguggucccugauguauuuucaccggcgcgaucugagacucgcuagcaacgccaucugcucugccgucccugugcauuggguucccacgucccggaccacauggagcauccacgcucaucaccaguggaugaccacagaggacaugcugaccguguggaauagagucuggauugaagauaacccuuggauggaggacaagacgcccgugaccacaugggaggaugucccguaccuuggcaagcgcgaagaccaauggugugggucccugaucggccucaccagccgggccacaugggcgcagaauauuccuaccgcuauccaacaggugagaucucugauuggaaacgaggaguuccuugauuacaugcccagcaugaaacgcuuucggaaggaggaggaauccgagggcgccaucugguga

SEQ ID NO: 20643 - RNA, 9873 nt, Artificial Sequence
  derived and/or modified CDS sequence (opt5) from DENV-3__KJ189295__SS-prME
accagccugugccucaugaugauccugcccgcggcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccagaacuccagcuucaucauugauggaccuaauacacccgagugcccgucugcguccagagccuggaacgucugggaaguggaggacuauggcuuuggcguguucaccacgaauaucuggcuccgccugcgggaagucuacacacaacugugugaccacagacuuaugagcgcugccguuaaagaugagcgcgccgugcaugcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccaccggcccggauaucacacccagacggcuggcccuuggcaucuugggaaacuggagcucgacuuuaauuacugcgagggaacaaccgugguuauuacagaaaacuguggcaccagaggccccucucugcgcacaaccacgguguccgggaagcugauccacgaguggugcugucggagcugcacccuuccgccucucagauauaugggagaagauggcuguugguacgggauggagauccggcccauuucugaaaaagaggagaauauggucaagucccuggugagcgccggaucuggcaaaguugacaacuucacaaugggggugcugugccucgccauccuguuugaagaggucaugcgcggaaaguucggcaagaaacauaugauugcuggcguguucuuuaccuucguucuucugcucagcgggcaaaucacauggagagauauggcccacacccugauuaugaucggauccaaugcgagcgaccggaugggcaugggggugacguaucuggcucuuauugccacauuuaagauccagcccuuccuggcccucggauuuuuccugagaaaacucaccucucgcgaaaaccugcuucugggcgucgggcucgcuauggccacaacccugcagcugccugaggauaucgaacaaauggcuaauggaauugcccuuggccugauggcgcucaagcugaucacccaguuugagacauaccagcucuggacggcccugauuucccuuaccuguagcaacacaaucuucacccugacaguggcuuggcggaccgccacgcucauucuggcuggcgugucccugcuuccggucugccagucuagcuccaugagaaaaacagacuggcugcccauggccguugccgcuaugggggugccuccccucccucuguuuaucuucucucucaaggauacccugaagcgcagaagcuggccccuuaaugagggagugauggcggucggccugguguccauccuggccucuagccuccugcggaacgacguuccuauggcugggccccuuguggccggaggccugcucauugccuguuaugucaucaccgggacauccgcugaucugaccguggaaaaagccgcggacauuacaugggaggaagaggcugaacaaacgggaguuagccauaaccucaugaucaccguggacgaugacggcacaaugcgcauuaaggaugacgagaccgagaauauccugacaguccuucugaaaaccgcccugcucaucgugucuggcauuuuuccguacuccaucccugccacgcugcuugucuggcacaccuggcagaagcagacacagagaagcggggugcugugggauguucccucuccucccgaaacccaaaaagcugagcucgaagagggaguguaccggauuaagcagcagggcaucuucgggaaaacacaggucggagugggcguucaaaaggaggggguguuucacaccauguggcaugucacacgcggagccgugcugacguauaacggcaagagacucgaaccgaauugggcguccgugaaaaaggaccugauuagcuacggcgggggauggcggcuuucuacccaguggcagaaaggcgaggaaguucaagucaucgcuguggagccugggaagaaccccaaaaauuuccagacaaugccuggaaccuuccagaccacaacgggcgaaauuggggccaucgcccuggauuuuaagcccggaaccuccggcagccccaucauuaaccgcgagggcaagguggucgggcuguauggaaauggcgugguuaccaagaacgggggauacguguccggcaucgcucagaccaaugccgagccugacgggccgacacccgaacucgaggaagagauguucaagaaaagaaaccugaccauuauggaucuucacccuggcagcggaaagacgcggaaauaucugcccgcuaucguccgcgaagccauuaagagacggcucagaacacugauccucgcgccuacccgcgugguugccgcugagauggaggaagcccugaagggccuucccauccgguaccaaaccacagcuaccaaaucugagcauacagggagagaaauuguggaccugaugugccacgccaccuuuacgaugcgccugcucagcccuguccgggugccgaauuauaaccugaucauuauggaugaggcccauuucacagaccccgcuuccaucgcggccagaggauacauuucuacccgcguuggcaugggggaagcugccgccaucuuuaugacagcuaccccucccggaacggccgaugcguucccucagagcaaugcucccauccaggacgaggagcgggacauuccggaaagauccuggaacucuggcaaugaguggaucaccgauuuugccgggaagacagugugguucgucccuagcauuaaagccggcaacgacaucgcuaacugucuucgcaagaauggcaaaaaggugauucagcugucccggaagaccuuugauacagaauaccagaagacaaagcucaacgacugggauuucguggucacaaccgacaucucugagaugggagccaauuuuaaagcggauagaguuauugacccccggcgcugccugaagcccgugauccugacggaugggccugagagagugauccucgccggacccaugccugucacagcugccagcgcugcccagcggcgcggcagaguggggcggaacccgcagaaagaaaaugaccaguauauuuucaccggacaaccccuuaacaaugaugaggaccacgcucacuggaccgaagccaagaugcugcuggacaacaucaauacaccugagggcauuauccccgcccucuucgaaccugagagagagaaguccgccgcuauugauggggaauaccgccugaaaggcgagagccggaagaccuuuguugaacuuaugagacgcggagaccugcccguguggcucgcccauaaagucgcuucugagggcaucaaguauacagaucggaaauggugcuucgacgggcagagaaacaaucagauccuggaagagaacauggauguggagauuuggacgaaggaaggagagaaaaagaagcugcgcccgcgguggcucgacgccagaaccuacuccgauccucuugcccugaaagaauuuaaggacuucgcugcgggccgcaaaagcaucgcccuggaucucguuacagagauugggagagugcccucucaccuggcucaucggacccgcaaugcccuugacaaccuggucaugcuccacacauccgaacacggaggcagagccuaucggcaugcuguggaggagcugccugaaaccauggagacgcugcuccuucugggccugaugauccuccugaccgggggagccaugcuuuuucugauuagcggcaaggggaucggaaaaacauccaucggccucauuugugucaucgcgucuagcgggaugcuguggauggccgaaauuccccugcaguggaucgcuuccgccauugugcucgaguucuuuaugaugguucuucugaucccugagcccgaaaagcaacgcaccccgcaggauaaucagcuggcuuacguggugauuggaauccucacacuggccgcgaucauugccgcuaacgagaugggccuucuggaaaccacgaagagagaccucggcaugagcaaagagccuggggucguuucucccacauccuaucuggauguggaccugcaccccgccagcgcuuggacccucuacgccguggcuacaaccgucaucaccccuaugcuucggcauacaauugaaaauucuacggccaacgugagccuggcggccaucgcuaaccaagccguugugcugaugggacucgacaagggcuggccgauuuccaaaauggaucugggggucccccuucuggcucucggaugcuacucucaggugaauccucugacccugacagccgccguccuccuucugaucacccacuaugcgaucauuggccccgggcugcaggcuaaggccacaagagaggcucagaaacgcaccgccgccggaaucaugaagaacccuacgguggacggcauuaugacaaucgaucucgaccccguuauuuacgauagcaaguucgagaaacaacugggccaggugaugcuucugguccucugugcugugcagcugcugcucaugcggaccuccugggcccuuugcgaagcgcugacccuggccacagggccuaucaccacacucugggagggaucuccgggcaaguuuuggaauacgaccaucgcuguuagcauggccaacauuuucagaggguccuaucuggcuggagccggccuugcguuuagcaucaugaaaucuguggggacaggaaagcgcggcaccggcucccagggggaaacacugggagagaaauggaagaagaaacucaaucaacugagccggaaggaguucgaccuguacaaaaaguccggcauuaccgaggucgauagaacggaggccaaagaagggcucaagcggggagagaucacccaucacgcugugucucgcggcagcgccaaacuucagugguuuguggaaagaaacaugguuauucccgaggggcgggucaucgaccugggauguggccgcggcgggugguccuauuacugcgcuggacugaagaaggugacagaagugagaggcuauaccaaagggggaccuggccacgaggagcccgucccuaugucuacauacggguggaauauuguuaagcucaugagcggaaaagauguguucuaccugcccccggaaaagugugacacccuucugugcgauaucggcgaguccagcccuucucccacaguggaagagucccggaccauccgcguccucaaaaugguggagcccuggcugaagaacaaucaguucuguauuaagguucugaacccuuauaugcccacggugaucgaacaucucgagagacuucagcggaaacacggcgggaugcugguccgcaauccucugagcagaaacucuacacaugaaauguacuggauuuccaauggaaccggcaacaucguggccagcguuaauauggugucucggcuccugcuuaacagauuuaccaugacacaccgccggccgacgauugagaaggacgucgaucugggggcuggaaccagacacgugaacgccgaacccgagacaccuaauauggacgugaucggcgagcgcaucaaacggauuaaggaagaacacaacagcaccuggcacuaugacgaugaaaaucccuacaaaacaugggcguaucauggguccuacgaggucaaggccaccggaucugcuagcuccaugaucaacggcguugugaagcuccugacaaaaccuugggacgugguccccauggugacccaaauggccaugacggauaccacaccguucggccagcagagaguuuuuaaggaaaaaguggacacccgcacaccucggagcaugcccgggaccagacgcgucaugggaauuacggcugaguggcuguggcggacacucggcagaaauaagaaaccucgccugugcacccgggaggaguucacaaagaaggugagaaccaacgccgccaugggggcgguuuuuacggaggaaaaucaaugggauuccgcuaaagccgccguggaggacgaagauuucuggaaacuugucgaccgcgagagagagcugcacaaacucggaaaguguggcucuugcguguauaacaugauggggaaacgggaaaagaaacugggcgaguuuggaaaggcuaagggcagccgcgccaucugguacauguggcuuggggcuagauaccuggaguucgaggcccucggauuucugaaugaggaucauugguucucccgggaaaacucuuauagcggcguugagggggaaggacugcacaaacucggcuacauucugagagacaucuccaagauccccgggggcgcgauguaugccgaugacaccgcuggaugggacacacggauuaccgaggaugaccuucacaaugaagagaaaaucacacagcagauggauccugagcaucgccagcuggccaacgcuauuuuuaagcucaccuaccaaaauaaaguggucaaggugcagagacccacaccgaccggcacggucauggacaucauuucucggaaggaucagcgcgggagcggacaggugggcacauaugggcugaacaccuucaccaauauggaagcccaacuuaucagacagauggagggagaaggcguucugcucaaagcggaccuggagaacccucaucugcccgaaaagaaaaucacacaguggcucgagaccaaggggguggagcggcugaaacgcauggccauuuccggcgaugacugcgucgugaagcccaucgaugacagauuugcuaacgcccuucuggcucucaaugauaugggaaaggugcggaaagacauuccucaguggcaaccgagcaagggcuggcaugauuggcagcagguucccuucuguucucaccacuuccaugaacugaucaugaaagacgggcgcaaacuuguggucccuugcagaccccaggacgagcugauuggacgggcccgcaucucccaaggcgcuggguggagccucagagaaacagccugucugggaaaagcguacgcccagauguggucucugauguauuuucaccggcgcgaucucagacuggcuuccaacgccauuugcagcgccgugccuguucauugggugcccacgucucggaccacaugguccauccacgcucaucaccaguggaugaccacagaggacaugcuuaccgucuggaauagaguguggaucgaagauaacccuuggauggaggaccgcacgcccgucaccacaugggaggaugugccguaccugggcaagcgggaagaccaauggugugggagccucauuggccugaccuccagagccacaugggcgcagaauaucccuaccgcuauucagcagguucgcagccuuaucggaaacgaggaguuccuggauuacaugcccucuaugaagcgguuuagaaaagaggaggaaagcgagggcgccauuugguga

SEQ ID NO: 20644 - RNA, 9873 nt, Artificial Sequence
  derived and/or modified CDS sequence (opt5) from DENV-3__KJ189297__SS-prME
accagccugugccucaugaugauccugcccgcggcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccagaacuccagcuucaucauugauggaccuaauacacccgagugcccgucugcguccagagccuggaacgucugggaaguggaggacuauggcuuuggcguguucaccacgaauaucuggcuccgccugcgggaagucuacacacaacugugugaccacagacuuaugagcgcugccguuaaagaugagcgcgccgugcaugcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccaccggcccggauaucacacccagacggcuggcccuuggcaucuugggaaacuggagcucgacuuuaauuacugcgagggaacaaccgugguuauuacagaaaacuguggcaccagaggccccucucugcgcacaaccacgguguccgggaagcugauccacgaguggugcugucggagcugcacccuuccgccucucagauauaugggagaagauggcuguugguacgggauggagauccggcccauuucugaaaaagaggagaauauggucaagucccuggugagcgccggaucuggcaaaguugacaacuucacaaugggggugcugugccucgccauccuguuugaagaggucaugcgcggaaaguucggcaagaaacauaugauugcuggcguguucuuuaccuucguucuucugcucagcgggcaaaucacauggagagauauggcccacacccugauuaugaucggauccaaugcgagcgaccggaugggcaugggggugacguaucuggcucuuauugccacauuuaagauccagcccuuccuggcccucggauuuuuccugagaaaacucaccucucgcgaaaaccugcuucugggcgucgggcucgcuauggccacaacccugcagcugccugaggauaucgaacaaauggcuaauggaauugcccuuggccugauggcgcucaagcugaucacccaguuugagacauaccagcucuggacggcccugauuucccuuaccuguagcaacacaaucuucacccugacaguggcuuggcggaccgccacgcucauucuggcuggcgugucccugcuuccggucugccagucuagcuccaugagaaaaacagacuggcugcccauggccguugccgcuaugggggugccuccccucccucuguuuaucuucucucucaaggauacccugaagcgcagaagcuggccccuuaaugagggagugauggcggucggccugguguccauccuggccucuagccuccugcggaacgacguuccuauggcugggccccuuguggccggaggccugcucauugccuguuaugucaucaccgggacauccgcugaucugaccguggaaaaagccgcggacauuacaugggaggaagaggcugaacaaacgggaguuagccauaaccucaugaucaccguggacgaugacggcacaaugcgcauuaaggaugacgagaccgagaauauccugacaguccuucugaaaaccgcccugcucaucgugucuggcauuuuuccguacuccaucccugccacgcugcuugucuggcacaccuggcagaagcagacacagagaagcggggugcugugggauguucccucuccucccgaaacccaaaaagcugagcucgaagagggaguguaccggauuaagcagcagggcaucuucgggaaaacacaggucggagugggcguucaaaaggaggggguguuucacaccauguggcaugucacacgcggagccgugcugacguauaacggcaagagacucgaaccgaauugggcguccgugaaaaaggaccugauuagcuacggcgggggauggcggcuuucuacccaguggcagaaaggcgaggaaguucaagucaucgcuguggagccugggaagaaccccaaaaauuuccagacaaugccuggaaccuuccagaccacaacgggcgaaauuggggccaucgcccuggauuuuaagcccggaaccuccggcagccccaucauuaaccgcgagggcaagguggucgggcuguauggaaauggcgugguuaccaagaacgggggauacguguccggcaucgcucagaccaaugccgagccugacgggccgacacccgaacucgaggaagagauguucaagaaaagaaaccugaccauuauggaucuucacccuggcagcggaaagacgcggaaauaucugcccgcuaucguccgcgaagccauuaagagacggcucagaacacugauccucgcgccuacccgcgugguugccgcugagauggaggaagcccugaagggccuucccauccgguaccaaaccacagcuaccaaaucugagcauacagggagagaaauuguggaccugaugugccacgccaccuuuacgaugcgccugcucagcccuguccgggugccgaauuauaaccugaucauuauggaugaggcccauuucacagaccccgcuuccaucgcggccagaggauacauuucuacccgcguuggcaugggggaagcugccgccaucuuuaugacagcuaccccucccggaacggccgaugcguucccucagagcaaugcucccauccaggacgaggagcgggacauuccggaaagauccuggaacucuggcaaugaguggaucaccgauuuugccgggaagacagugugguucgucccuagcauuaaagccggcaacgacaucgcuaacugucuucgcaagaauggcaaaaaggugauucagcugucccggaagaccuuugauacagaauaccagaaaacaaagcucaacgacugggauuucguggucacaaccgacaucucugagaugggagccaauuuuaaagcggauagaguuauugacccccggcgcugccugaagcccgugauccugacggaugggccugagagagugauccucgccggacccaugccugucacagcugccagcgcugcccagcggcgcggcagaguggggcggaacccgcagaaagaaaaugaccaguauauuuucaccggacaaccccuuaacaaugaugaggaccacgcucacuggaccgaagccaagaugcugcuggacaacaucaauacaccugagggcauuauccccgcccucuucgaaccugagagagagaaguccgccgcuauugauggggaauaccgccugaaaggcgagagccggaagaccuuuguugaacuuaugagacgcggagaccugcccguguggcucgcccauaaagucgcuucugagggcaucaaguauacagaucggaaauggugcuucgacgggcagagaaacaaucagauccuggaagagaacauggauguggagauuuggacgaaggaaggagagaaaaagaagcugcgcccgcgguggcucgacgccagaaccuacuccgauccucuugcccugaaagaauuuaaggacuucgcugcgggccgcaaaagcaucgcccuggaucucguuacagagauugggagagugcccucucaccuggcucaucggacccgcaaugcccuugacaaccuggucaugcuccacacauccgaacacggaggcagagccuaucggcaugcuguggaggagcugccugaaaccauggagacgcugcuccuucugggccugaugauccuccugaccgggggagccaugcuuuuucugauuagcggcaaggggaucggaaaaacauccaucggccucauuugugucaucgcgucuagcgggaugcuguggauggccgaaauuccccugcaguggaucgcuuccgccauugugcucgaguucuuuaugaugguucuucugaucccugagcccgaaaagcaacgcaccccgcaggauaaucagcuggcuuacguggugauuggaauccucacacuggccgcgaucauugccgcuaacgagaugggccuucuggaaaccacgaagagagaccucggcaugagcaaagagccuggggucguuucucccacauccuaucuggauguggaccugcaccccgccagcgcuuggacccucuacgccguggcuacaaccgucaucaccccuaugcuucggcauacaauugaaaauucuacggccaacgugagccuggcggccaucgcuaaccaagccguugugcugaugggacucgacaagggcuggccgauuuccaaaauggaucugggggucccccuucuggcucucggaugcuacucucaggugaauccucugacccugacagccgccguccuccuucugaucacccacuaugcgaucauuggccccgggcugcaggcuaaggccacaagagaggcucagaaacgcaccgccgccggaaucaugaagaacccuacgguggacggcauuaugacaaucgaucucgaccccguuauuuacgauagcaaguucgagaaacaacugggccaggugaugcuucugguccucugugcugugcagcugcugcucaugcggaccuccugggcccuuugcgaagcgcugacccuggccacagggccuaucaccacacucugggagggaucuccgggcaaguuuuggaauacgaccaucgcuguuagcauggccaacauuuucagaggguccuaucuggcuggagccggccuugcguuuagcaucaugaaaucuguggggacaggaaagcgcggcaccggcucccagggggaaacacugggagagaaauggaagaagaaacucaaucaacugagccggaaggaguucgaccuguacaaaaaguccggcauuaccgaggucgauagaacggaggccaaagaagggcucaagcggggagagaucacccaucacgcugugucucgcggcagcgccaaacuucagugguuuguggaaagaaacaugguuauucccgaggggcgggucaucgaccugggauguggccgcggcgggugguccuauuacugcgcuggacugaagaaggugacagaagugagaggcuauaccaaagggggaccuggccacgaggagcccgucccuaugucuacauacggguggaauauuguuaagcucaugagcggaaaagauguguucuaccugcccccggaaaagugugacacccuucugugcgauaucggcgaguccagcccuucucccacaguggaagagucccggaccauccgcguccucaaaaugguggagcccuggcugaagaacaaucaguucuguauuaagguucugaacccuuauaugcccacggugaucgaacaucucgagagacuucagcggaaacacggcgggaugcugguccgcaauccucugagcagaaacucuacacaugaaauguacuggauuuccaauggaaccggcaacaucguggccagcguuaauauggugucucggcuccugcuuaacagauuuaccaugacacaccgccggccgacgauugagaaggacgucgaucugggggcuggaaccagacacgugaacgccgaacccgagacaccuaauauggacgugaucggcgagcgcaucaaacggauuaaggaagaacacaacagcaccuggcacuaugacgaugaaaaucccuacaaaacaugggcguaucauggguccuacgaggucaaggccaccggaucugcuagcuccaugaucaacggcguugugaagcuccugacaaaaccuugggacgugguccccauggugacccaaauggccaugacggauaccacaccguucggccagcagagaguuuuuaaggaaaaaguggacacccgcacaccucggagcaugcccgggaccagacgcgucaugggaauuacggcugaguggcuguggcggacacucggcagaaauaagaaaccucgccugugcacccgggaggaguucacaaagaaggugagaaccaacgccgccaugggggcgguuuuuacggaggaaaaucaaugggauuccgcuaaagccgccguggaggacgaagauuucuggaaacuugucgaccgcgagagagagcugcacaaacucggaaaguguggcucuugcguguauaacaugauggggaaacgggaaaagaaacugggcgaguuuggaaaggcuaagggcagccgcgccaucugguacauguggcuuggggcuagauaccuggaguucgaggcccucggauuucugaaugaggaucauugguucucccgggaaaacucuuauagcggcguugagggggaaggacugcacaaacucggcuacauucugagagacaucucccagauccccgggggcgcgauguaugccgaugacaccgcuggaugggacacacggauuaccgaggaugaccuucacaaugaagagaagaucacacagcagauggauccugagcaucgccaacuggccaacgcuauuuuuaaacucaccuaccagaauaagguggucaaagugcagagacccacaccgaccggcacggucauggacaucauuucucggaaggaucagcgcgggagcggacaagugggcacauaugggcugaacaccuucaccaauauggaagcccagcuuaucagacagauggagggagaaggcguucuguccaaggcggaccucgagaacccucaucugcccgagaaaaagaucacacaguggcuggagaccaaagggguggagcggcucaagcgcauggccauuagcggcgaugacugcgucgugaaacccaucgaugacagauuugcuaacgcccugcuugcucugaaugauaugggaaaggugcggaaggacauuccucaauggcagccgucuaaaggcuggcaugauuggcagcagguucccuucuguucccaccacuuccaugaacucaucaugaaggacgggcgcaaacugguggucccuugcagaccccaagacgagcuuauuggacgggcccgcaucagccagggcgcuggguggucucugagagaaacagccugucucggaaaggcguacgcccagauguggucccugauguauuuucaccggcgcgaucugagacucgcuagcaacgccauuugcucugccgugccuguucauugggugcccacgucccggaccacauggagcauccacgcucaucaccaauggaugaccacagaggacaugcugaccgucuggaauagaguguggaucgaagauaacccuuggauggaggacaaaacgcccgucaccacaugggaggaugugccguaccuuggcaagcgcgaagaccaguggugugggucccugauuggccucaccagccgggccacaugggcgcagaauaucccuaccgcuauucagcaaguuagaucucugaucggaaacgaggaguuccuugauuacaugcccagcaugaagcgcuuucggaaagaggaggaauccgagggcgccauuugguga

SEQ ID NO: 20645 - RNA, 9873 nt, Artificial Sequence
  derived and/or modified CDS sequence (opt5) from DENV-3__KJ189298__SS-prME
accagccugugccucaugaugauccugcccgcggcucuugccuuccaccugacaucccgggacggcgagccucggaugauuguggggaagaaugaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuacccugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagaugcccccuguaaaaucccuuucagcacagaggacggccaugggaaggcgcacaacggaagacugauuaccgcuaaucccguugugacgaaaaaggaggaacccgucaacaucgaggccgaaccuccguucggcgaguccaauauugugaucgggauuggcgauaacgcccugaaaaucaauugguauaagaagggaucuagcaucggcaaaauguuugaagcuacagccagaggggcuagacgcauggccauucuuggagacaccgcgugggauuucggcuccgucgggggaguucucaacagccugggcaagaugguccaucaaaucuuugggucugccuacaccgcucuguucuccggcgugagcugggugaugaaaauuggaaucggcguccuccugacauggauugggcuuaauucuaagaacaccagcauguccuuuucuugcaucgccauuggaaucaucacacuguaucucggcgcugugguucaggccgacauggggugugugauuaauuggaaaggaaaggagcugaagugcggcagcgggaucuucgucacgaacgaggugcacaccuggacagaacaguacaaauuucaggcggauucccccaagcggcuggccaccgcuauugccggcgcuugggagaauggaguuuguggcaucagaagcacaacccgcauggaaaaccuucucuggaaacaaauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggccaagauugugacagcugaaacccagaacuccagcuucaucauugauggaccuaauacacccgagugcccgucugcguccagagccuggaacgucugggaaguggaggacuauggcuuuggcguguucaccacgaauaucuggcuccgccugcgggaagucuacacacaacugugugaccacagacuuaugagcgcugccguuaaagaugagcgcgccgugcaugcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccaccggcccggauaucacacccagacggcuggcccuuggcaucuugggaaacuggagcucgacuuuaauuacugcgagggaacaaccgugguuauuacagaaaacuguggcaccagaggccccucucugcgcacaaccacgguguccgggaagcugauccacgaguggugcugucggagcugcacccuuccgccucucagauauaugggagaagauggcuguugguacgggauggagauccggcccauuucugaaaaagaggagaauauggucaagucccuggugagcgccggaucuggcaaaguugacaacuucacaaugggggugcugugccucgccauccuguuugaagaggucaugcgcggaaaguucggcaagaaacauaugauugcuggcguguucuuuaccuucguucuucugcucagcgggcaaaucacauggagaaauauggcccacacccugauuaugaucggauccaacgcgagcgaucggaugggcaugggggugacguaucuggcucuuauugccacauuuaagauccagcccuuccuggcccucggauuuuuccugagaaaacucaccucucgcgaaaaucugcuucugggcgucgggcucgcuauggccacaacccugcagcugccugaggacaucgaacaaauggcuaacggaauugcccuuggccugauggcgcucaagcugaucacccaguuugagacauaccagcucuggacggcccugauuucccuuaccuguagcaauacaaucuucacccugacaguggcuuggcggaccgccacgcucauucuggcuggcgugucccugcuuccggucugccagucuagcuccaugagaaaaacagauuggcugcccauggccguugccgcuaugggggugccuccccucccucuguuuaucuucucucucaaggacacccugaagcgcagaagcuggccccuuaacgagggagugauggcggucggccugguguccauccuggccucuagccuccugcggaacgauguuccuauggcugggccccuuguggccggaggccugcucauugccuguuaugucaucaccgggacauccgcugaccugaccguggaaaaagccgcggauauuacaugggaggaagaggcugaacaaacgggaguuagccauaaucucaugaucaccguggacgacgauggcacaaugcgcauuaaggacgaugagaccgagaacauccugacaguccuucugaaaaccgcccugcucaucgugucuggcauuuuuccguacuccaucccugccacgcugcuugucuggcacaccuggcagaagcagacacagagaagcggggugcugugggacguucccucuccucccgaaacccaaaaagcugagcucgaagagggaguguaccggauuaagcagcagggcaucuucgggaaaacacaggucggagugggcguucaaaaggaggggguguuucacaccauguggcaugucacacgcggagccgugcugacguauaauggcaagagacucgaaccgaacugggcguccgugaaaaaggaucugauuagcuacggcgggggauggcggcuuucuacccaguggcagaaaggcgaggaaguucaagucaucgcuguggagccugggaagaaucccaaaaacuuccagacaaugccuggaaccuuccagaccacaacgggcgaaauuggggccaucgcccuggacuuuaagcccggaaccuccggcagccccaucauuaaucgcgagggcaagguggucgggcuguauggaaacggcgugguuaccaagaaugggggauacguguccggcaucgcucagaccaacgccgagccugaugggccgacacccgaacucgaggaagagauguucaagaaaagaaaucugaccauuauggaccuucacccuggcagcggaaagacgcggaaauaucugcccgcuaucguccgcgaagccauuaagagacggcucagaacacugauccucgcgccuacccgcgugguugccgcugagauggaggaagcccugaagggccuucccauccgguaccaaaccacagcuaccaaaucugagcauacagggagagaaauuguggaucugaugugccacgccaccuuuacgaugcgccugcucagcccuguccgggugccgaacuauaaucugaucauuauggacgaggcccauuucacagaucccgcuuccaucgcggccagaggauacauuucuacccgcguuggcaugggggaagcugccgccaucuuuaugacagcuaccccucccggaacggccgacgcguucccucagagcaacgcucccauccaggaugaggagcgggacauuccggaaagauccuggaacucuggcaacgaguggaucaccgacuuugccgggaagacagugugguucgucccuagcauuaaagccggcaacgauaucgcuaauugucuucgcaagaacggcaaaaaggugauucagcugucccggaagaccuuugacacagaauaccagaaaacaaagcucaaugauugggacuucguggucacaaccgauaucucugagaugggagccaacuuuaaagcggacagaguuauugauccccggcgcugccugaagcccgugauccugacggacgggccugagagagugauccucgccggacccaugccugucacagcugccagcgcugcccagcggcgcggcagaguggggcggaauccgcagaaagaaaacgaucaguauauuuucaccggacaaccccuuaauaacgacgaggaucacgcucacuggaccgaagccaagaugcugcuggacaauaucaacacaccugagggcauuauccccgcccucuucgaaccugagagagagaaguccgccgcuauugacggggaauaccgccugaaaggcgagagccggaagaccuuuguugaacuuaugagacgcggagaucugcccguguggcucgcccauaaagucgcuucugagggcaucaaguauacagaccggaaauggugcuucgaugggcagagaaauaaccagauccuggaagagaauauggacguggagauuuggacgaaggaaggagagaaaaagaagcugcgcccgcgguggcucgaugccagaaccuacuccgacccucuugcccugaaagaauuuaaggauuucgcugcgggccgcaaaagcaucgcccuggaccucguuacagagauugggagagugcccucucaccuggcucaucggacccgcaacgcccuugauaaucuggucaugcuccacacauccgaacacggaggcagagccuaucggcaugcuguggaggagcugccugaaaccauggagacgcugcuccuucugggccugaugauccuccugaccgggggagccaugcuuuuucugauuagcggcaaggggaucggaaaaacauccaucggccucauuugugucaucgcgucuagcgggaugcuguggauggccgaaauuccccugcaguggaucgcuuccgccauugugcucgaguucuuuaugaugguucuucugaucccugagcccgaaaagcaacgcaccccgcaggacaaccagcuggcuuacguggugauuggaauccucacacuggccgcgaucauugccgcuaaugagaugggccuucuggaaaccacgaagagagaucucggcaugagcaaagagccuggggucguuucucccacauccuaucuggacguggaucugcaccccgccagcgcuuggacccucuacgccguggcuacaaccgucaucaccccuaugcuucggcauacaauugaaaacucuacggccaacgugagccuggcggccaucgcuaaucaagccguugugcugaugggacucgacaagggcuggccgauuuccaaaauggaccugggggucccccuucuggcucucggaugcuacucucaggugaacccucugacccugacagccgccguccuccuucugaucacccacuaugcgaucauuggccccgggcugcaggcuaaggccacaagagaggcucagaaacgcaccgccgccggaaucaugaagaauccuacgguggauggcauuaugacaaucgaccucgaucccguuauuuacgacagcaaguucgagaaacaacugggccaggugaugcuucugguccucugugcugugcagcugcugcucaugcggaccuccugggcccuuugcgaagcgcugacccuggccacagggccuaucaccacacucugggagggaucuccgggcaaguuuuggaacacgaccaucgcuguuagcauggccaauauuuucagaggguccuaucuggcuggagccggccuugcguuuagcaucaugaaaucuguggggacaggaaagcgcggcaccggcucccagggggaaacacugggagagaaauggaagaagaaacucaaccaacugagccggaaggaguucgaucuguacaaaaaguccggcauuaccgaggucgacagaacggaggccaaagaagggcucaagcggggagagaucacccaucacgcugugucucgcggcagcgccaaacuucagugguuuguggaaagaaauaugguuauucccgaggggcgggucaucgaucugggauguggccgcggcgggugguccuauuacugcgcuggacugaagaaggugacagaagugagaggcuauaccaaagggggaccuggccacgaggagcccgucccuaugucuacauacggguggaacauuguuaagcucaugagcggaaaagacguguucuaccugcccccggaaaagugugauacccuucugugcgacaucggcgaguccagcccuucucccacaguggaagagucccggaccauccgcguccucaaaaugguggagcccuggcugaagaauaaccaguucuguauuaagguucugaauccuuauaugcccacggugaucgaacaucucgagagacuucagcggaaacacggcgggaugcugguccgcaacccucugagcagaaauucuacacaugaaauguacuggauuuccaacggaaccggcaauaucguggccagcguuaacauggugucucggcuccugcuuaacagauuuaccaugacacaccgccggccgacgauugagaaggaugucgaccugggggcuggaaccagacacgugaaugccgaacccgagacaccuaacauggaugugaucggcgagcgcaucaaacggauuaaggaggaacacaauagcaccuggcacuaugacgaagagaaccccuacaaaacaugggcguaucauggguccuacgaagucaaggccaccggaucugcuagcuccaugaucaauggcguugugaagcuccugacaaaaccuugggacgugguccccauggugacccaaauggccaugacggauaccacaccguucggccagcagagaguuuuuaaggagaaaguggacacccgcacaccucggagcaugcccgggaccagacgcgucaugggaauuacggcugaguggcuguggcggacacucggcagaaacaagaaaccucgccugugcacccgggaagaguucacaaagaaggugagaaccaaugccgccaugggggcgguuuuuacggaagagaaccaaugggauuccgcuaaagccgccguggaagacgaggauuucuggaaacuugucgaccgcgagagagaacugcacaaacucggaaaguguggcucuugcguguauaauaugauggggaaacgggagaagaaacugggcgaauuuggaaaggcuaagggcagccgcgccaucugguacauguggcuuggggcuagauaccuggaguucgaggcccucggauuucugaacgaagaucauugguucucccgggaaaauucuuauagcggcguugaaggggagggacugcacaaacucggcuacauucugagagacaucuccaagauccccgggggcgcgauguaugccgaugacaccgcuggaugggauacacggauuaccgaagacgaccuucacaacgaggagaaaaucacacagcagauggauccugaacaucgccagcuggccaaugcuauuuuuaagcucaccuaccaaaacaaaguggucaaggugcagagacccacaccgaccggcacggucauggacaucauuucucggaaggaucagcgcgggagcggacaggugggcacauaugggcugaauaccuucaccaacauggaggcccaacuuaucagacagauggaaggagagggcguucuguccaaagcggaccucgaaaacccucaucugcccgagaagaaaaucacacaguggcuggagaccaaggggguggaacggcucaaacgcauggccauuagcggcgaugacugcgucgugaagcccaucgaugacagauuugcuaaugcccugcuugcucugaacgauaugggaaaggugcggaaagacauuccucaguggcaaccgucuaagggcuggcaugauuggcagcagguucccuucuguucccaccacuuccaugagcucaucaugaaagacgggcgcaagcugguggucccuugcagaccccaggaugaacuuauuggacgggcccgcaucagccaaggcgcuggguggucucugagagagacagccugucucggaaaagcguacgcccagauguggucccugauguauuuucaccggcgcgaccugagacucgcuagcaaugccauuugcucugccgugccuguucauugggugcccacgucccggaccacauggagcauccacgcucaucaccaguggaugaccacagaagacaugcugaccgucuggaacagaguguggaucgaggauaauccuuggauggaggacaagacgcccgucaccacaugggaagaugugccguaccuuggcaagcgcgaggaccaauggugugggucccugauuggccucaccagccgggccacaugggcgcagaacaucccuaccgcuauucagcagguuagaucucugaucggaaaugaagaguuccuugauuacaugcccagcaugaaacgcuuucggaaggaggaagaguccgaaggcgccauuugguga

SEQ ID NO: 20646 - RNA, 9873 nt, Artificial Sequence
  derived and/or modified CDS sequence (opt5) from DENV-3__KJ189301__SS-prME
acaagccugugccucaugaugauccugcccgccgcucuugccuuccaccugacaucccgggacggagaaccucggaugauuguggggaagaacgaacgcggaaaaucucuccuguuuaagacggcgagcggcaccaauauguguacacuuaucgcuauggaucugggggaaaugugcgacgauaccgugacauacaaauguccgcauauuaccgaaguugaacccgaagacaucgauugcugguguaaccucacauccaccugggugacguauggaaccugcaaucaggccggcgaacaccggcgggacaagcgcucuguggcccuggcuccucaugucgggaugggacuggauacaagaacccagacauggaugagcgccgagggcgcuuggagacagguggaaaaaguugagaccugggcccuccgccaccccggcuucacgauucuggcgcuuuuucuggcccauuacaucgggacaucccucacccagaagguggucaucuucauucugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccagcuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucaaugucuggagcccaucgagggcaaaguugugcaguaugaaaaucucaaguacaccgucauuaucacagugcauacgggggaccagcaccagguuggaaacgagacccaaggcgugacagcugaaaucaccccucaggccucuacaaccgaggcuacgcugcccgaauauggcacccuggggcucgagugcuccccucgcacaggacuggacuucaaugagaugauucuucugaccaugaaaaacaaggccuggaugguccauagacagugguuuuucgaucucccccugccguggacaagcggcgccaccacggaaacaccuaccuggaaucggaaagagcuucuggugacauuuaagaacgcucacgcgaaaaagcaagaagucgugguucucgggucucaggagggagccaugcacaccgcucugaccggcgccacagaaauccaaaauuccgggggcacgagcauuuucgccggacaucugaagugucgccucaaaauggacaagcuggagcuuaaaggcaugucuuacgcuaugugcaccaacacauuugugcugaagaaagaggucuccgaaacccagcacgggacaauccucauuaagguggaguacaagggagaagaugcccccuguaaaaucccuuucagcaccgaggacggccaugggaaggcgcacaacggaagacugaucacggcuaaucccguugugaccaagaaggaggaacccgucaacauugaggccgaaccuccguucggcgaguccaauaucgugauugggaucggcgauaacgcccugaaaauuaauugguauaagaagggaucuagcaucggcaaaauguuugaagcuaccgccagaggggcuagacgcauggccauccuuggagacaccgcgugggauuucggcuccgucgggggaguucucaacagccugggcaagaugguccaucaaauuuuugggucugccuacacagcucuguucuccggcgugagcugggugaugaaaaucggaauuggcguccuccugaccuggaucgggcuuaauucuaagaacacaagcauguccuuuucuugcauugccaucggaauuaucacgcuguaucucggcgcugugguucaggccgacauggggugugugaucaauuggaaaggaaaggagcugaagugcggcagcgggauuuucgucaccaacgaggugcacacauggaccgaacaguacaaauuucaggcggauucccccaagcggcuggccacagcuaucgccggcgcuugggagaauggaguuuguggcauuagaagcaccacgcgcauggaaaaccuucucuggaaacaaaucgccaaugagcugaacuauauucugugggaaaauaacgugaagcucaccgucgugguuggggacaucaucggagugcuggagcggggcaaaagaacacuuaccccucagcccauggagcugaaguacucuuggaaaacaugggggaaggccaagauugucaccgcugaaacacagaacuccagcuucaucauugauggaccuaauacccccgagugcccgucugcgucccgcgccuggaacgugugggaaguggaggacuauggcuuuggcgucuucacgacaaauaucuggcuccggcugagagaggcuuacacccagcugugugaccaccgccuuaugagcgccgccguuaaagaugagcgggcugugcaugccgacaugggguacuggauugagucccaaaagaacggaucuuggaaacucgaaaaggcgagccugaucgaggugaaaaccugcacauggccuaagucccacacccuguggucuaauggcguccucgaaagcgauaugaucauucccaagucccuggcugggccuaucagccagcauaaccacagacccggauaucacacgcagacagccggcccuuggcaucuugggaaacuggagcucgacuuuaauuacugcgagggaaccacagugguuauuaccgaaaacuguggcacacgcggccccucucugcggaccacgaccguguccgggaagcugauccacgaguggugcuguagaagcugcacacuuccgccucuccgguauaugggagaagauggcuguugguacgggauggagauucgccccaucucugaaaaagaggagaauauggucaagucccuggugagcgccggaucuggcaaaguugacaacuucaccaugggggugcugugccucgcuauccuguuugaagaggucaugagaggaaaguucggcaagaaacauaugauugccggcguguucuuuacauucguucuucugcucagcgggcagaucaccuggcgggauauggcgcacacgcugauuaugaucggauccaaugcuagcgacagaaugggcaugggggugacauaucuggcccuuauugccaccuuuaagauccaacccuuccuggcucucggauuuuuccugcgcaaacucacaucucgggaaaaccugcuucugggcgucgggcucgccauggcuaccacccugcagcugccugaggauauugaacagauggccaauggaaucgcgcuuggccugauggcccucaagcugaucacacaauuugagacguaccagcucuggaccgcucugauuucccuuacauguagcaacaccaucuucacacugaccguggccuggagaacggcuacacucauucuggccggcgugucccugcuuccggucugccagucuagcuccaugcgcaaaaccgacuggcugcccauggccguugcugcgaugggggugccuccccucccucuguuuaucuucucucucaaggauacccugaagagacggagcuggccccuuaaugagggagugauggccgucggccugguguccauucuggcuucuagccuccugcgcaacgacguuccuauggccgggccccuuguggccggaggccugcucaucgcuuguuaugucaucacagggaccuccgccgaucugacaguggaaaaagcggcugacauuacgugggaggaagaggccgaacagaccggaguuagccauaaccucaugaucacaguggacgaugacggcaccaugagaauuaaggaugacgagacagagaauauccugaccguccuucugaaaacggcccugcucauugugucuggcaucuuuccguacuccaucccugcuacccugcuugucuggcacacauggcaaaagcagacccagcggagcggggugcugugggauguucccucuccucccgaaacacagaaagccgagcucgaagagggaguguaccgcauuaagcaacagggcaucuucgggaaaacccaggucggagugggcguucagaaggaggggguguuucacacaauguggcaugucacgagaggagcggugcugaccuauaacggcaagcggcucgaaccgaauugggcuuccgugaaaaaggaccugauuagcuacggcgggggauggcgccuuucuacacaauggcagaaaggcgaggaaguucaggucaucgccguggagccugggaagaaccccaaaaauuuccaaaccaugccuggaaccuuccagacaacgaccggcgaaauuggggccaucgcucuggauuuuaagcccggaacauccggcagccccauuaucaacagagagggcaagguggucgggcuguauggaaauggcgugguuaccaaaaacgggggauacguguccggcaucgcccagacaaaugcugagccugacgggccgacccccgaacucgaggaagagauguucaagaaacggaaccugacgauuauggaucuucacccuggcagcggaaagacacgcaaauaucugcccgccaucgucagagaagcgauuaagcggagacuccgcacccugauccucgccccuacccgggugguugcugccgagauggaggaagcucugaagggccuucccauuagauaccagacaaccgccacaaaaucugagcauaccgggcgcgaaaucguggaccugaugugccacgccacguuuacaaugcggcugcucagcccugucagagugccgaauuauaaccugaucauuauggaugaggcucauuucaccgaccccgcguccaucgccgcucgcggauacauuucuacacggguuggcaugggggaagccgccgcuaucuuuaugaccgccacgccucccggaaccgcggaugcuuucccucaaagcaaugcccccauucaggacgaggagagagacaucccggaacgcuccuggaacucuggcaaugaguggaucacagauuuugccgggaagaccgugugguucgucccuagcauuaaagcuggcaacgacaucgccaacugucuucggaagaauggcaaaaaggugauucagcuguccagaaagacauuugauaccgaauaccagaaaacaaagcucaacgacugggauuucguggucaccacggacaucucugagaugggagcgaauuuuaaagccgaucggguuauugacccccgcagaugccugaagcccgugauccugacagaugggccugagcgggugauucucgcuggacccaugccugucaccgccgcuagcgccgcucaacgcagaggccggguggggagaaacccgcagaaagaaaaugaccaguauaucuucaccggacagccccuuaacaaugaugaggaccacgcccacuggacagaagcgaagaugcugcuggacaacaucaauaccccugagggcauuauccccgcccucuucgaaccugagcgcgagaaguccgcugccauugauggggaauaccggcugaaaggcgagagcagaaagacauuuguugaacuuaugcgccggggagaccugcccguguggcucgcucauaaagucgccucugagggcaucaaguauacggauagaaaauggugcuucgacgggcaacgcaacaaucagauucuggaagagaacauggauguggagaucuggaccaaggaaggagagaaaaagaagcugcggccgagauggcucgacgcccgcacauacuccgauccucuugcucugaaagaauuuaaggacuucgcggccggcagaaaaagcaucgcucuggaucucguuaccgagauugggcgggugcccucucaccuggcccaucgcacaagaaaugcccuugacaaccuggucaugcuccacaccuccgaacacggaggccgggcuuaucgccaugccguggaggagcugccugaaacgauggagacccugcuccuucugggccugaugauccuccugacagggggagcgaugcuuuuucugauuagcggcaaggggaucggaaaaaccuccauuggccucaucugugucaucgccucuagcgggaugcuguggauggcugaaauuccccugcaguggaucgccuccgcuauugugcucgaguucuuuaugaugguucuucuggugccugagcccgaaaagcagagaacaccgcaagauaaucagcuggccuacguggucaucggcauucucacccuggcggccaucauugcugccaacgagaugggccuucuggaaacgacaaagcgggaccucggcaugagcaaagagccugggguugugucucccaccuccuaucuggauguggaccugcaccccgcuagcgccuggacacucuacgcugucgccaccaccgugaucacaccuaugcuuagacauacgaucgaaaauucuaccgcgaacguuagccuggccgcuauugccaaccaggcugugguccugaugggacucgacaagggcuggccgaucuccaaaauggaucugggggugccccuucuggcccucggaugcuacucucaagucaauccucugacacugaccgccgcggugcuccuucugauuacacacuaugcuaucauuggccccgggcugcaggccaaggcuacccgcgaggcccagaaacggacggccgcuggaaucaugaagaacccuacaguugacggcaucaugaccauugaucucgaccccgugaucuacgauagcaaguucgagaaacagcugggccaagucaugcuucuggugcucugugccguucagcugcugcucaugagaaccuccugggcgcuuugcgaagcccugacacuggcuaccgggccuauuacaacgcucugggagggaucuccgggcaaguuuuggaauaccacaaucgccgugagcauggcuaacauuuuccgcggguccuaucuggccggagcgggccuugccuuuagcaucaugaaaucugucgggaccggaaagcggggcacaggcucccagggggaaacccugggagagaaauggaagaagaaacucaaucagcugagcagaaaggaguucgaccuguacaaaaaguccggcaucacggagguggaucggaccgaggcuaaagaagggcucaagcgcggagagauuacacaucacgccgugucuagaggcagcgcuaaacuucaaugguuuguugaacggaacauggucauccccgaggggcgcgugauugaccugggauguggcagaggcgggugguccuauuacugcgccggacugaagaaggugaccgaaguccggggcuauacaaaagggggaccuggccacgaggagcccguuccuaugucuaccuacggguggaauaucgugaagcucaugagcggaaaagauguguucuaccugcccccggaaaagugugacacacuucugugcgauauuggcgaguccagcccuucucccaccgucgaagagucccgcacgaucagagugcucaaaaugguugagcccuggcugaagaacaaucaguucuguauuaaggugcugaacccuuauaugcccacagucaucgaacaucucgagcggcuucagcgcaaacacggcgggaugcuggugagaaauccucugagccggaacucuacccaugaaauguacuggaucuccaauggaaccggcaacauuguugcuagcgugaauauggucucuagacuccugcuuaaccgcuuuacaaugacgcaccggagaccgaccaucgagaaggacguggaucugggggccggaacacgccacgugaacgcggaacccgagaccccuaauauggacgucauuggcgagcggaucaaaagaauuaaggaagaacacaacagcacauggcacuaugacgaugaaaaucccuacaaaaccugggccuaucauggguccuacgagguuaaggcuacaggaucugccagcuccaugaucaacggcguggugaagcuccugaccaaaccuugggacgucgugcccaugguuacgcagauggcuaugaccgauacaaccccguucggccaacagcgcguguuuaaggaaaaagucgacacacggaccccuagaagcaugcccgggacgcgccgggugaugggaaucacagccgaguggcuguggagaacccucggccgcaauaagaaaccucggcugugcacaagagaggaguucaccaagaagguucgcacgaacgccgcgaugggggcuguguuuaccgaggaaaaucagugggauuccgccaaagccgcugucgaggacgaagauuucuggaaacuuguggacagagagcgggagcugcacaaacucggaaaguguggcucuugcguuuauaacaugauggggaaacgcgaaaagaaacugggcgaguuuggaaaggccaagggcagcagagcuauuugguacauguggcuuggggcccgguaccuggaguucgaggcgcucggauuucugaaugaggaucauugguucuccagagaaaacucuuauagcggcguggagggggaaggacugcacaaacucggcuacauccugcgggacauuuccaagauccccgggggcgccauguaugcugaugacacagccggaugggacacccgcauuacagaggaugaccuucacaaugaagagaaaaucacccaacagauggauccugagcauagacagcuggcuaacgccaucuuuaagcucacauaccagaauaaagucgugaagguccaacggcccaccccgacgggcacagugauggacauuaucucucgcaaggaucagagagggagcggacagguuggcaccuaugggcugaacaccuucacaaauauggaagcgcagcuuauucggcaaauggagggagaaggcgugcuguccaaagccgaccucgagaacccucaucugcccgaaaagaaaaucacccaguggcuggagacaaagggggucgagcgccucaaaagaauggcuauuagcggcgaugacugcguggugaagcccaucgaugaccgguuugccaacgcucugcuugcccugaaugauaugggaaagguucgcaaagacaucccucaguggcagccgucuaagggcuggcaugauuggcaacaggugcccuucuguucccaccacuuccaugaacucauuaugaaagacgggagaaagcuggucgugccuugccggccccaggacgagcuuaucggacgcgcuagaauuagccagggcgccggguggucucugcgggaaacggcgugucucggaaaagccuacgcucaaauguggucccugauguauuuucaccgcagagaucugcggcucgccagcaacgccaucugcucugcuguuccugugcauuggguccccaccuccagaacaaccuggagcauucacgcccaucaccaguggaugacaaccgaggacaugcugacgguguggaaucgcgucuggaucgaagauaacccuuggauggaggacaagacccccgugacaaccugggaggauguuccguaccuuggcaagcgggaagaccaguggugugggucccugauuggccucacaagcagagcgaccugggcucaaaauaucccuacggccauccaacaggugcgcucucugauuggaaacgaggaguuccuugauuacaugcccagcaugaaacgguuuagaaaggaggaggaauccgagggcgccaucugguga

SEQ ID NO: 20647 - RNA, 9873 nt, Artificial Sequence
  derived and/or modified CDS sequence (opt5) from DENV-3__KF955456__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucgugcugcuuaugcugguuacaccuucuaugaccaugagaugugugggagucggcaaccgggacuuuguggaagggcucagcggagccacauggguggaugucguucuggagcacggcgggugcgugaccaccauggcuaagaauaaacccacacuggacaucgagcuccagaagacggaagccacccaacuggcgacacuucgcaaacuguguauugagggaaagaucaccaacauuacaaccgauuccagaugcccuacgcagggcgaagccgugcucccggaggaacaggaccagaauuaugucuguaaacacacauacguggaucggggcugggggaacggaugcggccuguucgggaagggaagccuuguuaccugcgcuaaguuucaaugucuggagcccaucgagggcaaagugguccaguaugaaaaucucaaguacaccgugauuaucacaguucauaccggggaccagcaccaggugggaaacgagacacaaggcgucacggccgaaaucaccccucaggcuucuacaaccgaggccauucugcccgaauauggcacacuggggcucgagugcuccccucgcaccggacuggacuucaaugagaugauccuucugacgaugaaaaacaaggccuggauggugcauagacagugguuuuucgaucucccccugccguggaccagcggcgcuacaaccgaaacaccuaccuggaaucggaaagagcuucuggucacguuuaagaacgcgcacgccaaaaagcaagaagugguugugcucgggucucaggagggagcuaugcacacagcccugaccggcgccacagaaauucagaauuccgggggcaccagcaucuucgcuggacaucugaagugucgccucaaaauggacaagcuggagcuuaaaggcaugucuuacgccaugugcaccaacacauuuguccugaagaaagagguguccgaaacgcagcacgggaccauucucaucaagguugaguacaagggagaagaugcgcccuguaaaaucccuuucagcacagaggacggccaagggaaggcucauaacggaagacugauuaccgccaaucccguggucacaaaaaaggaggaacccgugaacaucgaggccgaaccuccguucggcgaguccaauauugugaucgggauuggcgauaacgcucugaaaaucaauugguauaagaagggaucuagcaucggcaaaauguuugaagccaccgcucggggggccagacgcauggcgauucuuggagacacggccugggauuucggcuccguugggggaguccucaacagccugggcaagauggugcaccagaucuuugggucugcuuacacagcccuguucuccggcgugagcugggucaugaaaauuggaaucggcgugcuccugaccuggauugggcuuaauucuaagaacaccagcauguccuuuucuugcaucgcuauuggaaucaucacacuguaucucggcgccguugugcaggcggacaccgggugugucauuaauuggaaaggaaaggagcugaagugcggcagcgggaucuucgugacaaacgagguucauacguggaccgaacaguacaaauuucaagccgauucccccaagcggcuggcuacagccauugcuggcgccugggagaauggaguguguggcaucagaagcaccacacgcauggaaaaccuucucuggaaacaggucgccaaugagcugaacuauauucugugggaaaauaacaucaagcucaccgugguugugggggacaucauuggaguccuggagcagggcaaacggacgcuuaccccucagcccauggagcugaaguacucuuggaaaacaugggggaaggcuaagaucgugaccgcggaaacacaaaacuccagcuucauuaucgauggaccuaauacccccgagugcccgucugccuccagagcuuggaacgugugggaagucgaggacuauggcuuuggcguuuucacaaccaauauuuggcucaaacugcgcgaaguguacacgcagcugugugaccaccggcuuaugagcgccgccgugaaggaugagagagcuguccacgccgacaugggguacuggaucgagucccagaaaaacggaucuuggaagcucgaaaaagcgagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauucacgaguggugcugucgcagcugcacgcuuccgccucuccgguacaugggagaagauggcuguugguaugggauggagaucagacccaucucugaaaaggaggagaauaugguuaaaucccuggugagcgccggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcgcacacacuggugaugaucggauccaaugcuagcgacagaaugggcaugggggugaccuaccuggcccuuauugccacguuuaaaauccagcccuuccuggcucucggauuuuuccugcggaagcucacaucuagagaaaaccugcuucugggcgucgggcucgccauggcuaccacacugcaacugccugaggauauugaacagauggccaauggaaucgcgcuuggccugauggcccucaaacugaucacccaguuugagaccuaucagcucuggacagcucugauuucccuuacguguagcaacaccaucuucacacugaccguugccuggcgcacagcuacccucauucuggccggcgugucccugcuuccggugugccaaucuagcuccaugcggaagucugacuggcugcccaugacggucgccgcuaugggggugccuccccucccucuguuuaucuucagccucaaggauacacugaaaagacgcuccuggccccuuaaugagggaguuauggcggugggccuggucucuauucuggccagcucccuccugagaaacgacgugccuauggcugggccccuuguugccggaggccugcucaucgccuguuacgugaucaccgggaccagcgcugaucugacagucgaaaaggccgcggacgugaccugggaggaagaggcugaacagacaggagucucucauaaccucaugauuacgguggacgaugacggcaccaugcggaucaaagaugacgagacagagaauauucugaccguucuucugaagacagcccugcucaucguguccggcauuuuuccguacagcaucccugccacccugcuugucuggcacacguggcagaaacagacccgcagaucuggggugcugugggauguucccuccccucccgaaacacaaaaggcugagcucgaagagggaguguaucggaucaaacagcagggcauuuucgggaagacccaggucggagugggcgugcaaaaggaggggguuuuucauacaauguggcacgucacccgcggagccgugcugacauacaacggcaaaagacucgaaccgaauugggcgagcgugaagaaagaccugaucucuuauggcgggggauggcggcuuuccgcucaguggcagaagggcgaggaaguccaagugauugccguugagccugggaaaaaccccaagaauuuccagacgaugccuggaaccuuccagacaaccaccggcgaaaucggggccauugcucuggauuuuaagcccggaacaagcggcucccccaucauuaaccgcgagggcaaaguggucgggcuguacggaaauggcgugguuacgaagaacgggggauaugugagcggcaucgcccagaccaaugcugagccugacgggccgacacccgaacucgaggaagagauguucaaaaagagaaaccugaccaucauggaucuucacccuggcucuggaaaaacacggaaguaccugcccgccauuguccgcgaagcgaucaagagacggcucagaacccugauucucgccccuacgcgcgugguugcugccgagauggaggaagcucugaaaggccuucccauccgguaucaaacaaccgccaccaagagcgagcauacagggagagaaauuguggaccugaugugccacgccaccuuuacaaugcgccugcucuccccuguccgggugccgaauuacaaccugaucaucauggaugaggcucauuucaccgaccccgcgucuauugccgcuagaggauacaucagcacgcgcgugggcaugggggaagccgccgcuauuuuuaugacagccaccccucccggaacagcggaugcuuucccucaguccaaugcccccauccaggacgaggagcgggacauuccggaaagaucuuggaacagcggcaaugaguggaucaccgauuuugccgggaaaacggucugguucguuccuuccaucaaggcuggcaacgacauugccaacugucuucgcaaaaauggaaagaaggugauccagcugucucggaaaaccuuugauacagaauaucaaaagaccaaacucaacgacugggauuucguggucacaaccgacauuagcgagaugggcgcgaauuuuaaggccgauagagugaucgacccccggcgcugccugaaacccguuauucugacagaugggccugagagagugauccucgcuggacccaugccugucaccgccgcuuccgccgcucagcggcgcggcagaguggggcggaacccgcagaaggaaaaugaccaguacauuuucacgggacaaccccuuaacaaugaugaggaccacgcccauuggacagaagcgaagaugcugcuggacaacaucaauaccccugagggcaucauucccgcccucuucgaaccugagagagagaaaagcgcugccaucgauggggaauaucgccugaagggcgagucucggaaaaccuuuguugaacuuaugagacgcggagaccugcccguguggcucgcucacaaggucgccuccgagggcauuaaauacacagaucggaaguggugcuucgacgggcagagaaacaaucagauccuggaagagaacauggauguggagauuuggaccaaagaaggagagaagaagaaacugcgcccgcgguggcucgacgccagaacauauagcgauccucuugcucugaaggaauuuaaagacuucgcggccggccgcaagucuaucgcucuggaucucgucacggagaucgggagagugcccucccaccuggcccaucggacccgcaaugcccuugacaaccugguuaugcuccacacaagcgaacauggaggcaaagcuuacagacacgccguggaggagcugccugaaaccauggagacacugcuccuucugggccugaugauucuccugaccgggggagcgaugcuuuuucugaucuccggcaaggggauuggaaagacgucuaucggccucauuugugugaucgccagcuccgggaugcuguggauggcugaaaucccccugcaguggauugccagcgcuaucguccucgaguucuuuaugaugguucuucugauuccugagcccgaaaaacaacggaccccgcaggauaaucagcuggccuauguggugaucggaauucucacacuggcggccaucauugcugccaacgagaugggccuucuggaaaccacaaagcgcgaccucggcaugucuaaagagccuggggucgugucccccaccagcuaccuggauguugaccugcaccccgcuucugccuggacgcucuacgcuguggccacaaccgucaucacaccuaugcuuagacauaccaucgaaaauagcaccgcgaacgugucccuggccgcuauugccaaccaagcugucgugcugaugggacucgacaagggcuggccgaucucuaaaauggaucuggggguuccccuucuggcccucggaugcuauagccaggugaauccucugacacugacggccgcgguccuccuucugauuacccacuacgcuaucauuggccccgggcugcaggccaaggcuacacgggaggcccagaagagaaccgccgcuggaaucaugaaaaacccuacaguggacggcaucaugaccauugaucucgaccccguuaucuaugauuccaaguucgagaaacaacugggccaggugaugcuucugguccucugugccauucagcugcugcucaugcgcacgucuugggcgcuuugcgaagcccugacacuggcuaccgggccuaucaccacacucugggagggaagcccgggcaaguuuuggaauaccacaauugccguguccauggcuaacaucuuccgggggagcuaccuggccggagcgggccuugccuuuucuaucaugaaauccguggggacgggaaagagaggcaccggcagccagggggaaacacugggagagaaguggaaaaagaaacucaaucaacugucccgcaaggaauucgaccuguauaaaaagucuggcauuaccgagguugaucggacagaggcuaaagaagggcucaagagaggagagaucacccaucacgccgucagccggggcuccgcuaagcuucagugguuuguggaacgcaacauggugauucccgaggggagagucaucgaccugggauguggccggggcggguggucuuacuauugcgccggacugaaaaagguuacggaagugcgcggcuacaccaaagggggaccuggccaugaggagcccgugccuaugagcacauacggguggaauauugucaagcucauguccggaaaagauguguucuaucugcccccggaaaagugugacacccuucugugcgauaucggcgagagcucuccuucccccacaguugaagagagcagaaccauucgggugcucaagauggucgagcccuggcugaaaaacaaucaguucuguaucaaggugcugaacccuuacaugcccacaguuaucgaacaccucgagcgccuucagagaaaauauggcgggaugcuggugcggaauccucugucucgcaacuccacccacgaaauguacuggauuagcaauggaacgggcaacaucgucgcuucugugaauauggugagcagacuccugcuuaaccgguuuacaaugacccauagacgcccgaccauugagaaggacgucgaucugggggccggaacacggcacguuaacgcggaacccgagacgccuaauauggacgugaucggcgagagaauuaaacgcaucaaggaagagcauaacuccaccuggcacuaugacgaugaaaaucccuacaagacaugggccuaucacgggucuuacgaggugaaagcuaccggaagcgccuccagcaugaucaacggcgucgugaagcuccugacaaaaccuugggacguugugcccauggucacccaaauggcuaugacagauaccacgccguucggccagcagcggguguuuaaggaaaaaguugacaccagaacaccucgcuccaugcccgggacccggagagugaugggaauuacagccgaguggcuguggcgcacccucggccggaauaagaagccuagacugugcacgcgcgaggaauucacaaaaaagguccggaccaacgccgcgaugggggcuguguuuacagaggaaaaucaaugggauucugccaaagccgcuguugaggacgaagauuucuggaagcuuguggacagagagcgcgagcugcauaaacucggaaaguguggcagcugcgucuacaacaugauggggaaaagagaaaagaagcugggcgaguuuggaaaagccaagggcucccgggcuaucugguauauguggcuuggggcccgcuaccuggaauucgaggcgcucggauuucugaaugaggaucacugguucucuagagaaaacagcuauuccggcguggagggggaaggacugcauaaacucggcuacauucugcgggacaucucuaagauucccgggggcgccauguaugcugaugacaccgccggaugggacacgagaaucaccgaggaugaccuucacaaugaagagaaaaucacacagcagauggauccugagcaucggcagcuggcuaacgccauuuuuaagcucaccuaccaaaauaaggucgugaaaguucagcgccccacaccgaccggcacagugauggacaucauuagcagaaaggaucagcggggguccggacaggucggcaccuaugggcugaacacguucacaaauauggaagcgcaacuuauccgccagauggagggagaaggcgugcugaccaaagccgaccucgagaacccucaccugagcgaaaagaaaauuacccaguggcuggagacaaaggggguggagagacucaagcggauggcuaucucuggcgaugacugcguugugaaacccaucgaugaccgcuuugccaacgcucugcuugcccugaaugauaugggaaaggucagaaaagacauuccccaguggcaaccuuccaagggcuggcacgauuggcagcaggugccguucuguagccaucacuuccaugaacucaucaugaaagacgggcggaagcugguugugcccugccgcccucaggacgagcuuauuggaagagcucggaucucucaaggcgccggguggucccugcgcgaaaccgcgugucucggaaaggccuacgcucagauguggagccugauguacuuucacagacgggaucugcgccucgccucuaacgccauuugcuccgcuguccccgugcacugggucccuacaagcagaacgaccugguccauccaugcccaccaucaguggaugacaaccgaggacaugcugacaguguggaaucggguuuggauugaagauaaccccuggauggaggacaaaaccccugugacgaccugggagaauguccccuaucuuggcaagagagaagaucaauggugugggagccugaucggccucacaucucgcgcgaccugggcucagaacaucccgacagccauucagcaggugcggagccugaucggaaaugaggaauuccuugacuacaugccuuccaugaaaagauuucgcaaggaggaggaaucugagggcgccauuugguga

SEQ ID NO: 20648 - RNA, 9873 nt, Artificial Sequence
  derived and/or modified CDS sequence (opt5) from DENV-3__KF955465__SS-prME
accagccugugcaucaugaugauucuccccgccgcucuggccuuccaccuuacgucccgggacggcgaaccucggaugaucguggggaagaacgaacgcggaaaaucucugcucuuuaagacggcgagcggcauuaauauguguacccugaucgcuauggaucuuggggaaaugugcgacgauacagucaccuacaaauguccgcauauuacagaaguugaacccgaagacaucgauugcugguguaaccugaccuccacaugggugaccuauggaacgugcaaucaggccggcgaacaccggcgggacaagcgcucuguggcccucgcuccucaugucgggaugggacuggauaccagaacacagaccuggaugagcgccgaaggcgcuuggagacagguggaaaaaguugagacaugggcccugcgccaccccggcuucaccauccucgcgcuguuucuugcccauuacauugggacgucccugacacagaagguggucaucuucauucuccugaugcuugugaccccuucuaugacaaugagauguguuggagugggcaaccgggacuuugucgaagggcugagcggagcuaccuggguggaugugguccucgagcacggcgggugcguuaccacaauggccaagaauaaacccacgcuggacaucgagcugcagaagaccgaagcuacacaacucgccacccugcgcaaacuuuguauugagggaaagaucacaaacauuaccacggauuccagaugcccuacacagggcgaagcggugcugccggaggaacaggaccagaauuauguguguaaacacaccuacgucgaucggggcugggggaacggaugcggccucuucgggaagggaagccuggugaccugcgccaaguuucaaugucuugagcccaucgagggcaaaguugugcaguaugaaaaucugaaguacacagucaucauuaccgugcauacaggggaccagcaccagguuggaaacgagacgcaaggcgugaccgcugaaaucacaccucaggccucuaccacagaggcuauucuccccgaauauggcacccuggggcuggagugcuccccucgcacgggacucgacuucaaugagaugguccugcuuaccaugaaaaacaaggccuggauggugcauagacagugguuuuucgaucugccccucccguggacaagcggcgccaccacagaaaccccuacguggaaucggaaagagcugcuugucacauuuaagaacgcucacgcgaaaaagcaagaagugguugugcuggggucucaggagggagccaugcacaccgcucucacaggcgccaccgaaauccaaaauuccgggggcaccagcauuuucgccggacaucugaagugucgccugaaaauggacaagcucgagcugaaaggcaugucuuacgcuaugugcacaaacacguuuguccuuaagaaagagguguccgaaacccagcacgggacaauccugaucaagguugaguacaagggagaagaugugcccuguaaaauuccuuucagcaccgaggacggccaagggaaggcccauaacggaagacucaucacagcgaaucccgucgugaccaaaaaggaggaacccgugaacauugaggcugaaccuccguucggcgaguccaauaucguuauugggaucggcgauaacgcccugaaaaucaauugguauaagaagggaucuagcauuggcaaaauguuugaagccacggcuagaggggccagacgcauggcuauccugggagacacagccugggauuucggcuccgucgggggagugcuuaacagccucggcaagauggugcaccagauuuuugggucugcguacaccgcccuguucuccggcgucagcugggugaugaaaaucggaauuggcguucugcucaccuggaucgggcucaauucuaagaacacaagcauguccuuuucuugcauugugaucggaaucauuacccuuuaucugggcgcugucgugcaggccgacaugggguguguuaucaauuggaaaggaaaggagcucaagugcggcagcgggauuuucgugacaaacgagguccauacguggaccgaacaguacaaauuucaagcugauucccccaagcggcuggccacagcgaucgccggcgcuugggagaauggaguguguggcauuagaagcaccacacgcauggaaaaccugcuuuggaaacagaucgccaaugagcucaacuauauccugugggaaaauaacauuaagcugaccguuguggucggggacaucauuggagugcucgagcagggcaaacggacgcugaccccucagcccauggagcuuaaguacucuuggaaaacaugggggaaggcuaagaucgugaccgccgaaacacaaaacuccagcuucauuaucgauggaccuaauacccccgagugcccgucugccuccagagcuuggaacgucugggaaguugaggacuauggcuuuggcguguucacaaccaauaucuggcugaaacuccgcgaaguguacacgcagcugugugaccaccggcugaugagcgcggccgucaaggaugagagagcugugcacgccgacaugggguacuggauugagucccagaaaaacggaucuuggaaacuugaaaaagccagccucaucgagguuaagacaugcaccuggccuaagucccauacccuguggucuaauggcgugcuggaaagcgauaugauuauccccaaaucccucgcugggccuauuagccagcacaacuaucgccccggauaccauacacaaaccgccggcccuuggcaccuggggaaacuugagcuggacuuuaauuauugcgagggaacgacagucgugaucaccgaaaacuguggcacacggggccccucucucagaaccacaaccguuuccgggaaacugauccacgaguggugcugucgcagcugcacgcugccgccucuucgguacaugggagaagauggcuguugguaugggauggagauuagacccaucucugaaaaggaggagaauauggugaaaucccucgucagcgcgggaucuggcaagguggacaacuucaccauggggguucugugccuggcuauucucuuugaagaggugaugcggggaaaguucggcaaaaagcauaugaucgccggcgucuucuuuacauucgugcugcuucugagcgggcagauuaccuggcgcgauauggcccacacacucaucaugauuggauccaaugcuagcgacagaaugggcaugggggugaccuaccuggcccugaucgcgacguuuaaaauccagcccuuccuugcucugggauuuuuccuccggaagcugacaucuagagaaaaccuccugcuuggcgucgggcuggccauggccaccacacuccaacugccugaggauauugaacagauggcuaauggaaucgcccugggccuuauggcucugaaacucauuacccaguuugagaccuaucagcuguggacagcccucaucucccugacguguagcaacaccauuuucacacuuaccguugcguggcgcacagccacccugauccucgcuggcgugucccugcugccggugugccaaucuagcuccaugcggaagacggacuggcuucccaugacagucgccgcuaugggggugccuccccugccucucuuuaucuucucucugaaggauacccucaaaagacgcagcuggccccugaaugagggaguuauggccgugggccuugucuccauucuggccucuagccugcucagaaacgacgugccuauggcugggccccugguugcgggaggccuucugaucgccuguuacgugauuaccgggacauccgcugaucucaccgucgaaaaggccgccgacgugacaugggaggaagaggcugaacagacgggagucagccauaaccugaugaucaccguggacgaugacggcacaaugcggauuaaagaugacgagaccgagaauauccucacaguucugcuuaagaccgcccugcugaucgugucuggcauuuuuccguacuccaucccugcgacgcuccuggucuggcacaccuggcagaaacagacacaacgcagcggggugcuuugggauguucccucuccucccgaaacccagaaggcugagcuggaagagggaguguauagaauuaaacagcagggcaucuucgggaagacacaagucggagugggcgugcagaaggaggggguuuuucauaccauguggcacgucacacggggagccgugcucacguacaacggcaaacgccuggaaccgaauugggccuccgugaagaaagaccucauuagcuauggcgggggauggagacugucugcucaguggcaaaagggcgaggaaguccaggugaucgccguugagccugggaaaaaccccaagaauuuccagaccaugccuggaacauuccagaccaccacaggcgaaauuggggcgaucgcucuugauuuuaagcccggaacguccggcagccccaucauuaaccgggagggcaaaguggucgggcuguacggaaauggcgugguuaccaagaacgggggauauguguccggcaucgcccaaacaaaugccgagccugacgggccgacccccgaacuggaggaagagauguucaaaaagcgcaaccucacaauuauggaucugcacccuggcagcggaaaaaccagaaaguaccuucccgcuaucguccgggaagccauuaagcgcagacugcggacgcucauccuggcuccuacaagagugguugccgcggagauggaggaagcccucaaaggccugcccauccgcuaucagaccaccgcuacaaagucugagcauaccgggcgggaaauuguggaccuuaugugccacgccacauuuaccaugagacugcugagcccuguccgcgugccgaauuacaaccucaucauuauggaugaggcucauuucacggaccccgccuccaucgccgcucggggauacauuucuacaagagugggcaugggggaagcggccgcuaucuuuaugaccgccacaccucccggaaccgccgaugcuuucccucagagcaaugcccccauccaggacgaggagcgcgacauuccggaacgguccuggaacucuggcaaugaguggaucacggauuuugcggggaaaaccgucugguucguuccuagcauuaaggcuggcaacgacaucgccaacugucugcgcaaaaauggaaagaaggugauucaacuuuccagaaaaacauuugauaccgaauaucagaagacaaaacugaacgacugggauuucguggucaccacagacaucucugagaugggcgccaauuuuaaggcugaucgggugauugaccccagacggugccucaaacccguuauccugaccgaugggccugagcgcgugauccuggccggacccaugccugucacggcggccagcgcugcccagagacggggccgcguggggagaaacccgcagaaggaaaaugaccaauacauuuucacaggacagccccucaacaaugaugaggaccacgcucauuggaccgaagccaagaugcuucuggacaacaucaauaccccugagggcauuauccccgcucuguucgaaccugagcgggagaaauccgccgcgauugauggggaauauagacucaagggcgagagccgcaaaacauuuguugaacugaugcggagaggagaccuucccguguggcuggcccacaaggucgcuucugagggcaucaaauacaccgaucgcaaguggugcuucgacgggcagcggaacaaucagauccucgaagagaacauggauguggagauuuggacaaaagaaggagagaagaagaaacugagaccgcgcuggcuggacgcccggacguauuccgauccucucgcucuuaaggaauuuaaagacuucgccgccggcagaaagagcaucgcucuggaucuggucaccgagauugggcgcgugcccucucaccucgcgcauagaacacggaaugcccuggacaaccuuguuaugcugcacaccuccgaacauggaggcaaggcuuaccgccacgccguggaggagcucccugaaacaauggagacccugcugcuccuuggccugaugauccugcucacagggggagccaugcuguuucuuauuagcggcaaggggaucggaaagaccuccaucggccugauuugugugaucgcuucuagcgggaugcucuggauggccgaaauuccccugcaauggaucgcguccgccauuguccuggaguucuuuaugaugguucuccuuaucccugagcccgaaaaacagagaacaccgcaggauaaucaacuggcuuauguggugauuggaauccugacccucgccgcuaucauugccgcgaacgagaugggccugcuugaaacaaccaagcgggaccugggcaugagcaaagagccuggggucgugucucccacguccuaccucgauguugaccugcaccccgccagcgcuuggacacuguacgccguggcuaccacagucaucaccccuaugcuccgccauaccauugaaaauucuacagccaacgugagccuugcugccaucgcgaaccaggccgucgugcugaugggacuggacaagggcuggccgauuuccaaaauggaucucgggguuccccugcuugcucugggaugcuauucucaggugaauccucucacgcugaccgccgcuguccugcuccuuaucacacacuacgccaucauuggccccgggcugcaggccaaggcgaccagagaggcucaaaagcggacagccgcuggaaucaugaaaaacccuaccguggacggcauuaugacgaucgaucuggaccccguuauuuaugauagcaaguucgagaaacagcucggccaggugaugcugcuuguccugugugccgugcagcuccugcugaugagaacauccugggcccucugcgaagcucuuacccuggccaccgggccuaucacaacccugugggagggaucuccgggcaaguuuuggaauacaacgaucgcggugagcauggccaacauuuuccgcggguccuaccucgcuggagccggccuggcuuuuagcaucaugaaaucuguugggaccggaaagcggggcacaggcucccaaggggaaacccuuggagagaaguggaaaaagaaacugaaucagcucagcagaaaggaguucgaccuguauaaaaaguccggcauuacagaggucgaucgcaccgaggccaaagaagggcugaagcggggagagaucacgcaucacgcggugucuagaggcagcgccaagcuccagugguuuguggaacggaacauggucauucccgaggggcgcguuaucgaccuuggauguggcagaggcgggugguccuacuauugcgcuggacugaaaaaggugaccgaagugcggggcuacacaaaagggggaccuggccaugaggagcccgucccuaugucuaccuacggguggaauauugugaagcugaugagcggaaaagauguuuucuaucugcccccggaaaagugugacacacugcuuugcgauaucggcgaguccagcccuucucccaccguggaagagucccgcacaaucagaguccugaagaugguggagcccuggcucaaaaacaaucaguucuguauuaagguucugaacccuuacaugcccaccgugaucgaacaccuggagcggcuccaacgcaaacacggcgggaugcuugucagaaauccucugagccggaacucuacgcaugaaauguauuggauuuccaauggaacaggcaacaucguggccagcgugaauauggucucucgccugcuccugaacagauuuaccaugacccaccggagaccgacaauugagaaggacguugaucuuggggcuggaacgcgccaugugaacgccgaacccgagaccccuaauauggacgugaucggcgagcggaucaaaagaauuaaggaagaacacaacagcacauggcacuacgacgaugaaaaucccuauaagaccugggcuuaccauggguccuaugaggucaaagccacaggaucugcgagcuccaugaucaacggcgugguuaagcugcucaccaaaccuugggacgugguccccauggugacacagauggccaugaccgauacgaccccguucggccagcaacgcguuuuuaaggaaaaaguggacacacggaccccuagaagcaugcccgggacacgccgggucaugggaauuaccgcugaguggcuguggagaacgcugggccgcaauaagaagccucggcucugcacaagagaggaguucaccaaaaaggugcgcacaaacgccgcuaugggggccguuuuuaccgaggaaaaucagugggauuccgccaaagcggcuguggaggacgaagauuucuggauccuggucgaccgggagagagagcuucacaagcugggaaaauguggcucuugcguguacaacaugauggggaagcgcgagaagaagcucggcgaguuuggaaaggccaaaggcagcagagccauuugguacauguggcugggggcucgguaucuugaguucgaggcccugggauuucucaaugaggaucauugguucucccgcgaaaacucuuacagcggcgucgagggggaaggacugcacaagcugggcuauauccucagagacaucuccaaaauucccgggggcgcuauguacgccgaugacacggcgggaugggacacccggaucacagaggaugaccugcauaaugaagagaagauuacccagcagauggauccugagcacagacaacuugccaacgcuaucuuuaaacugacauaucagaauaaggugguuaaggugcagcggcccaccccgacaggcaccgucauggacauuaucucucgcaaagaucagagagggagcggacaagugggcacguacgggcucaacacauucaccaauauggaagcccagcugauccggcagauggagggagaaggcgugcuuuccaaggcugaccuggagaacccucaccuccccgagaaaaagauuacccaguggcuggagacaaaagggguugagcgccugaagagaauggccaucagcggcgaugacugcguggucaagcccauugaugaccgguuugcgaacgcccuccuggcucuuaaugauaugggaaaagugcgcaaggacaucccucaauggcagccgucuaaaggcuggcaugauuggcagcagguucccuucuguucccaccauuuccacgaacugauuaugaaggacgggagaaaacucguggucccuugccggccccaagacgagcugaucggacgcgccagaauuagccagggcgcuggguggucucuucgggaaaccgccugucugggaaaggcuuaugcccagauguggucccucauguacuuucaccgcagagaucugcggcuggcgagcaacgccaucugcucugcugugccuguccauugggugcccacaucccgcacgaccuggagcauccacgcccaucaccaauggaugacaaccgaggacaugcucacaguuuggaauagaguguggauugaagauaacccuuggauggaggacaagacccccgucacgaccugggagaaugugccguaccugggcaaacgggaagaucaguggugugggucccuuaucggccugacaagcagagccaccugggcucagaacauuccuacagccauccagcaaguucgcucucucauuggaaaugaggaguuccuggacuauaugcccagcaugaagcgguuuagaaaagaggaggaauccgagggcgcgaucugguga

SEQ ID NO: 20649 - RNA, 9873 nt, Artificial Sequence
  derived and/or modified CDS sequence (opt5) from DENV-3__KF955466__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauuguuaucggaaucauuacccuguaucucggcgcugugguccaggccgacauggggugugugaucaauuggaaaggaaaggagcugaagugcggcagcgggauuuucguuacaaacgaggugcauacguggaccgaacaguacaaauuucaagcugauucccccaagcggcuggccacagcgaucgccggcgcuugggagaauggagucuguggcauuagaagcaccacacgcauggaaaaccuucucuggaaacagaucgccaaugagcugaacuauauccugugggaaaauaacauuaagcucaccgugguugugggggacaucauuggaguccuggagcagggcaaacggacgcuuaccccucagcccauggagcugaaguacucuuggaaaacaugggggaaggcuaagaucgugaccgccgaaacacaaaacuccagcuucauuaucgauggaccuaauacccccgagugcccgucugccuccagagcuuggaacgugugggaagucgaggacuauggcuuuggcguuuucacaaccaauaucuggcucaaacugcgcgaaguguacacgcagcugugugaccaccggcuuaugagcgcggccgugaaggaugagagagcuguccacgccgacaugggguacuggauugagucccagaaaaacggaucuuggaagcucgaaaaagccagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauaugguuaaaucccuggugagcgcgggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcccacacacugaucaugauuggauccaaugcuagcgacagaaugggcaugggggugaccuaccuggcccuuaucgcgacguuuaaaauccagcccuuccuggcucucggauuuuuccugcggaagcucacaucuagagaaaaccugcuucugggcguggggcucgccauggccaccacacugcaacugccugaggauauugaacagauggcuaauggaaucgcccuuggccugauggcucucaaacugauuacccaguuugagaccuaucagcucuggacagcccugaucucccuuacguguagcaacaccauuuucacacugaccgucgcguggcgcacagccacccucauccuggcuggcguuucccugcuuccggugugccaaucuagcuccaugcggaagacggacuggcugcccaugacaguggccgcuaugggggucccuccccucccucuguuuaucuucucucucaaggauacccugaaaagacgcagcuggccccuuaaugagggagugauggccguuggccugguguccauucuggccucuagccuccugagaaacgacgucccuauggcugggccccuuguggcgggaggccugcucaucgccuguuacguuauuaccgggacauccgcugaucugaccguggaaaaggccgccgacgucacaugggaggaagaggcugaacagacgggagugagccauaaccucaugaucaccgucgacgaugacggcacaaugcggauuaaagaugacgagaccgagaauauccugacagugcuucugaagaccgcccugcucaucguuucuggcauuuuuccguacuccaucccugcgacgcugcuuguguggcacaccuggcagaaacagacacaacgcagcgggguccugugggaugugcccucuccucccgaaacccagaaggcugagcucgaagagggaguuuauagaauuaaacagcagggcaucuucgggaagacacaagugggagucggcgugcagaaggaggggguguuucauaccauguggcacguuacacggggagccguccugacguacaacggcaaacgccucgaaccgaauugggccuccgugaagaaagaccugauuagcuauggcgggggauggagacuuucugcucaguggcaaaagggcgaggaagugcaggucaucgccguggagccugggaaaaaccccaagaauuuccagaccaugccuggaacauuccagaccaccacaggcgaaauuggggcgaucgcucuggauuuuaagcccggaacguccggcagccccaucauuaaccgggagggcaaaguuguggggcuguacggaaauggcgucgugaccaagaacgggggauauguuuccggcaucgcccaaacaaaugccgagccugacgggccgacccccgaacucgaggaagagauguucaaaaagcgcaaccugacaauuauggaucuucacccuggcagcggaaaaaccagaaaguaccugcccgcuaucgugcgggaagccauuaagcgcagacuccggacgcugauccucgcuccuacaagagucguggccgcggagauggaggaagcccugaaaggccuucccauccgcuaucagaccaccgcuacaaagucugagcauaccgggcgggaaauuguugaccugaugugccacgccacauuuaccaugagacugcucagcccugugcgcgucccgaauuacaaccugaucauuauggaugaggcucauuucacggaccccgccuccaucgccgcucggggauacauuucuacaagagugggcaugggggaagcggccgcuaucuuuaugaccgccacaccucccggaaccgccgaugcuuucccucagagcaaugcccccauccaggacgaggagcgcgacauuccggaacgguccuggaacucuggcaaugaguggaucacggauuuugcggggaaaaccgugugguucgucccuagcauuaaggcuggcaacgacaucgccaacugucuucgcaaaaauggaaagaagguuauucaacuguccagaaaaacauuugauaccgaauaucagaagacaaaacucaacgacugggauuucguggugaccacagacaucucugagaugggcgccaauuuuaaggcugaucgggucauugaccccagacggugccugaaacccgugauccugaccgaugggccugagcgcguuauccucgccggacccaugccugugacggcggccagcgcugcccagagacggggccgcgucgggagaaacccgcagaaggaaaaugaccaauacauuuucacaggacagccccuuaacaaugaugaggaccacgcucauuggaccgaagccaagaugcugcuggacaacaucaauaccccugagggcauuauccccgcucucuucgaaccugagcgggagaaauccgccgcgauugauggggaauauagacugaagggcgagagccgcaaaacauuuguggaacuuaugcggagaggagaccugcccguuuggcucgcccacaagguggcuucugagggcaucaaauacaccgaucgcaaguggugcuucgacgggcagcggaacaaucagauccuggaagagaacauggaugucgagauuuggacaaaagaaggagagaagaagaaacugagaccgcgcuggcucgacgcccggacguauuccgauccucuugcucugaaggaauuuaaagacuucgccgccggcagaaagagcaucgcucuggaucucgugaccgagauugggcgcguccccucucaccuggcgcauagaacacggaaugcccuugacaaccuggugaugcuccacaccuccgaacauggaggcaaggcuuaccgccacgccguugaggagcugccugaaacaauggagacccugcuccuucugggccugaugauccuccugacagggggagccaugcuuuuucugauuagcggcaaggggaucggaaagaccuccaucggccucauuugugugaucgcuucuagcgggaugcuguggauggccgaaauuccccugcaauggaucgcguccgccauugugcucgaguucuuuaugaugguccuucugaucccugagcccgaaaaacagagaacaccgcaggauaaucaacuggcuuauguugugauuggaauccucacccuggccgcuaucauugccgcgaacgagaugggccuucuggaaacaaccaagcgggaccucggcaugagcaaagagccugggguggucucucccacguccuaccuggauguggaccugcaccccgccagcgcuuggacacucuacgccguugcuaccacagugaucaccccuaugcuucgccauaccauugaaaauucuacagccaacgucagccuggcugccaucgcgaaccaggccgugguccugaugggacucgacaagggcuggccgauuuccaaaauggaucugggggugccccuucuggcucucggaugcuauucucagguuaauccucugacgcugaccgccgcugugcuccuucugaucacacacuacgccaucauuggccccgggcugcaggccaaggcgaccagagaggcucaaaagcggacagccgcuggaaucaugaaaaacccuaccgucgacggcauuaugacgaucgaucucgaccccgugauuuaugauagcaaguucgagaaacagcugggccagguuaugcuucuggugcucugugccguccagcugcugcucaugagaacauccugggcccuuugcgaagcucugacccuggccaccgggccuaucacaacccucugggagggaucuccgggcaaguuuuggaauacaacgaucgcggugagcauggccaacauuuuccgcggguccuaccuggcuggagccggccuugcuuuuagcaucaugaaaucuguggggaccggaaagcggggcacaggcucccaaggggaaacccugggagagaaguggaaaaagaaacucaaucagcugagcagaaaggaguucgaccuguauaaaaaguccggcauuacagagguugaucgcaccgaggccaaagaagggcucaagcggggagagaucacgcaucacgcggucucuagaggcagcgccaaacuucagugguuuguggaacggaacauggugauucccgaggggcgcgucaucgaccugggauguggcagaggcgggugguccuacuauugcgcuggacugaaaaagguuaccgaagugcggggcuacacaaaagggggaccuggccaugaggagcccgugccuaugucuaccuacggguggaauauugucaagcucaugagcggaaaagauguguucuaucugcccccggaaaagugugacacacuucugugcgauaucggcgaguccagcccuucucccaccguugaagagucccgcacaaucagagugcucaagauggucgagcccuggcugaaaaacaaucaguucuguauuaaggugcugaacccuuacaugcccaccguuaucgaacaccucgagcggcuucaacgcaaacacggcgggaugcuggugagaaauccucugagccggaacucuacgcaugaaauguauuggauuuccaauggaacaggcaacaucgucgccagcgugaauauggugucucgccuccugcuuaacagauuuaccaugacccaccggagaccgacaauugagaaggacgucgaucugggggcuggaacgcgccauguuaacgccgaacccgagaccccuaauauggacgugaucggcgagcggaucaaaagaauuaaggaagaacacaacagcacauggcacuacgacgaugaaaaucccuauaagaccugggcuuaccauggguccuaugaggugaaagccacaggaucugcgagcuccaugaucaacggcgucgugaagcuccugaccaaaccuugggacguugugcccauggucacacagauggccaugaccgauacgaccccguucggccagcaacgcguguuuaaggaaaaaguugacacacggaccccuagaagcaugcccgggacacgccgggugaugggaauuaccgcugaguggcuguggagaacgcucggccgcaauaagaagccucggcugugcacaagagaggaguucaccaaaaagguccgcacaaacgccgcuaugggggccguguuuaccgaggaaaaucagugggauuccgccaaagcggcuguugaggacgaagauuucuggaugcuuguggaccgggagagagagcugcacaagcucggaaaauguggcucuugcgucuacaacaugauggggaagcgcgagaaaaagcugggcgaguuuggaaaggccaaaggcagcagagccaucugguacauguggcuuggggcucgguaucuggaguucgaggcccucggauuucugaaugaggaucauugguucucccgcgaaaacucuuacagcggcguggagggggaaggacugcacaagcucggcuauauucugagagacaucuccaaaauccccgggggcgcuauguacgccgaugacacggcgggaugggacacccggauuacagaggaugaccuucauaaugaagagaagaucacccagcagauggauccugagcacagacaacuggccaacgcuauuuuuaaacucacauaucagaauaaggucgugaagguucagcggcccaccccgacaggcaccgugauggacaucauuucucgcaaagaucagagagggagcggacaagucggcacguacgggcugaacacauucaccaauauggaagcccagcuuauccggcagauggagggagaaggcgugcuguccaaggcugaccucgagaacccucaucugcccgagaaaaagaucacccaguggcuggagacaaaagggguggagcgccucaagagaauggccauuagcggcgaugacugcguugugaagcccaucgaugaccgguuugcgaacgcccugcuugcucugaaugauaugggaaaaguccgcaaggacauuccucaauggcagccgucuaaaggcuggcaugauuggcaacaggugcccuucuguucccaccauuuccacgaacucaucaugaaggacgggagaaaacugguugugccuugccggccccaagacgagcuuauuggacgcgccagaaucagccagggcgcuggguggucucugcgggaaaccgccugucucggaaaggcuuaugcccagauguggucccugauguacuuucaccgcagagaucugcggcucgcgagcaacgccauuugcucugcugucccugugcauuggguccccacaucccgcacgaccuggagcauccacgcccaucaccaauggaugacaaccgaggacaugcugacaguguggaauagaguuuggaucgaagauaacccuuggauggaggacaagacccccgugacgaccugggagaaugucccguaccuuggcaaacgggaagaucaguggugugggucccugauuggccucacaagcagagccaccugggcucagaacaucccuacagccauucagcaagugcgcucucugaucggaaaugaggaguuccuugacuauaugcccagcaugaagcgguuuagaaaagaggaggaauccgagggcgcgauuugguga

SEQ ID NO: 20650 - RNA, 9873 nt, Artificial Sequence
  derived and/or modified CDS sequence (opt5) from DENV-3__KF955468__SS-prME
accagccugugccucaugaugauccugcccgccgcucuugccuuccaccugacgucccgggacggcgagccucggaugauuguggggaagaacgaacgcggaaagucucuccuguuuaagacggcgagcggcaucaauauguguacccuuauugcuauggaucugggggagaugugcgacgauacagucaccuacaaauguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauuguuaucggaaucauuacccuguaucucggcgcugugguccaggccgacauggggugugugaucaauuggaaaggaaaggagcugaagugcggcagcgggauuuucguuacaaacgaggugcauacguggaccgaacaguacaaauuucaagcugauucccccaagcggcuggccacagcgaucgccggcgcuugggagaauggagucuguggcauuagaagcaccacacgcauggaaaaccuucucuggaaacagaucgccaaugagcugaacuauauccugugggaaaauaacauuaagcucaccgugguugugggggacaucauuggaguccuggagcagggcaaacggacgcuuaccccucagcccauggagcugaaguacucuuggaaaacaugggggaaggcuaagaucgugaccgccgaaacacaaaacuccagcuucauuaucgauggaccuaauacccccgagugcccgucugccuccagagcuuggaacgugugggaagucgaggacuauggcuuuggcguuuucacaaccaauaucuggcucaaacugcgcgaaguguacacgcagcugugugaccaccggcuuaugagcgcggccgugaaggaugagagagcuguccacgccgacaugggguacuggauugagucccagaaaaacggaucuuggaagcucgaaaaagccagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauaugguuaaaucccuggugagcgcgggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcccacacacugaucaugauuggauccaaugcuagcgacagaaugggcaugggggugaccuaccuggcccuuaucgcgacguuuaaaauccagcccuuccuggcucucggauuuuuccugcggaagcucacaucuagagaaaaccugcuucugggcguggggcucgccauggccaccacacugcaacugccugaggauauugaacagauggcuaauggaaucgcccuuggccugauggcucucaaacugauuacccaguuugagaccuaucagcucuggacagcccugaucucccuuacguguagcaacaccauucugacacucaccgucgcguggcgcacagccacccugauccuggcuggcguuucccuucugccggugugccaaucuagcuccaugcggaagacggacuggcuccccaugacaguggccgcuaugggggucccuccccugccucucuucaucuuuucucugaaggauacccuuaaaagacgcagcuggccccugaaugagggagugauggccguuggccugguguccauucucgccucuagccugcuuagaaacgacgucccuauggcugggccccugguggcgggaggccuccugaucgccuguuacguuauuaccgggacauccgcugaucucaccguggaaaaggccgccgacgucacaugggaggaagaggcugaacagacgggagugagccauaaccugaugaucaccgucgacgaugacggcacaaugcggauuaaagaugacgagaccgagaauauccuuacagugcugcugaagaccgcccuccugaucguuucuggcauuuucccguacuccaucccugcgacgcuucugguguggcacaccuggcagaaacagacacaacgcagcgggguccucugggaugugcccucuccucccgaaacccagaaggcugagcuggaagagggaguuuauagaauuaaacagcagggcaucuuugggaagacacaagugggagucggcgugcagaaggaggggguguuccauaccauguggcacguuacacggggagccguccucacguacaacggcaaacgccuggaaccgaauugggccuccgugaagaaagaccuuauuagcuauggcgggggauggagacugucugcucaguggcaaaagggcgaggaagugcaggucaucgccguggagccugggaaaaaccccaagaauuuucagaccaugccuggaacauuccagaccaccacaggcgaaauuggggcgaucgcucuggauuucaagcccggaacguccggcagccccaucauuaaccgggagggccgcguuguggggcucuacggaaauggcgucgugaccaaaaacgggggauauguuuccggcaucgcccaaacaaaugccgagccugacgggccgacccccgaacuggaggaagagauguuuaagaaaagaaaccuuacaauuauggaucugcacccuggcagcggaaagacccggaaauaccuccccgcuaucgugcgcgaagccauuaagagacggcugagaacgcucauccuggcuccuacacgcgucguggccgcggagauggaggaagcccuuaagggccugcccauccgguaucagaccaccgcuacaaaaucugagcauaccgggagagaaauuguugaccugaugugccacgccacauucaccaugcgccuccugagcccugugcgggucccgaauuacaaccuuaucauuauggaugaggcucauuuuacggaccccgccuccaucgccgcuagaggauacauuucuacacgcgugggcaugggggaagcggccgcuaucuucaugaccgccacaccucccggaaccgccgaugcuuuuccucagagcaaugcccccauccaggacgaggagcgggacauuccggaaagauccuggaacucuggcaaugaguggaucacggauuucgcggggaagaccgugugguuugucccuagcauuaaagcuggcaacgacaucgccaacugucugcgcaagaauggcaaaaagguuauucaacucucccggaagacauucgauaccgaauaucagaaaacaaagcugaacgacugggauuuuguggugaccacagacaucucugagaugggagccaauuucaaagcugauagagucauugacccccggcgcugccugaagcccgugauccucaccgaugggccugagagaguuauccuugccggacccaugccugugacggcggccagcgcugcccagcggcgcggcagagucgggcggaacccgcagaaagaaaaugaccaauacauuuuuacaggacagccccugaacaaugaugaggaccacgcucauuggaccgaagccaagaugcugcucgacaacaucaauaccccugagggcauuauccccgcucuguucgaaccugagagagagaaguccgccgcgauugauggggaauaucgccuuaaaggcgagagccggaagacauucguggaacugaugagacgcggagaccuccccguuuggcuggcccacaaaguggcuucugagggcaucaaguacaccgaucggaaauggugcuuugacgggcagagaaacaaucagauccuggaagagaacauggaugucgagauuuggacaaaggaaggagagaaaaagaagcuccgcccgcgguggcuugacgccagaacguauuccgauccucuggcucugaaagaguucaaggacuuugccgccggccgcaaaagcaucgcucucgaucuggugaccgagauugggagaguccccucucaccuugcgcaucggacacgcaaugcccuggacaaccucgugaugcugcacaccuccgaacauggaggcaaggcuuacagacacgccguugaggagcugccugaaacaauggagacccuccuucugcugggccucaugauccugcuuacagggggagccaugcuguuccucauuagcggcaaagggaucggaaagaccuccaucggccugauuugugugaucgcuucuagcgggaugcuguggauggccgaaauuccccuccaauggaucgcguccgccauugugcuugaguuuuucaugaugguccugcugaucccugagcccgaaaagcagcggacaccgcaggauaaucaacucgcuuauguugugauuggaauccugacccuugccgcuaucauugccgcgaacgagaugggccugcucgaaacaaccaaacgcgaccugggcaugagcaaggagccugggguggucucucccacguccuaccuggauguggaccuccaccccgccagcgcuuggacacuuuacgccguugcuaccacagugaucaccccuaugcugagacauaccauugaaaauucuacagccaacgucagccuggcugccaucgcgaaccaggccgugguccucaugggacuggacaaaggcuggccgauuuccaagauggaucuuggggugccccugcucgcucugggaugcuauucucagguuaauccucugacgcucaccgccgcugugcuucugcugaucacacacuacgccaucauuggccccgggcuccaggccaaagcgacccgggaggcucaaaagagaacagccgcuggaaucaugaagaacccuaccgucgacggcauuaugacgaucgaucuggaccccgugauuuaugauagcaaauuugagaagcagcuuggccagguuaugcugcucgugcugugugccguccagcugcuccuuaugcgcacauccugggcccugugcgaagcucugacccucgccaccgggccuaucacaacccugugggagggaucuccgggcaaauucuggaauacaacgaucgcggugagcauggccaacauuuuucggggguccuaccuugcuggagccggccuggcuuucagcaucaugaagucuguggggaccggaaaaagaggcacaggcucccaaggggaaacccucggagagaaguggaagaaaaagcugaaucagcugagccgcaaagaauuugaccucuauaagaaauccggcauuacagagguugaucggaccgaggccaaggaagggcuuaaaagaggagagaucacgcaucacgcggucucucggggcagcgccaagcugcagugguucguggaacgcaacauggugauucccgaggggagagucaucgaccugggauguggccggggcgggugguccuacuauugcgcuggacucaagaaaguuaccgaagugcgcggcuacacaaaagggggaccuggccaugaggagcccgugccuaugucuaccuacggguggaauauugucaaacugaugagcggaaaggauguguuuuaucuucccccggaaaaaugugacacacugcucugcgauaucggcgaguccagcccuucucccaccguugaagaguccagaacaauccgggugcugaagauggucgagcccuggcugaagaacaaucaguucuguauuaaagugcucaacccuuacaugcccaccguuaucgaacaccuugagcgccugcaaagaaagcacggcgggaugcuggugcggaauccucucagccgcaacucuacgcaugaaauguauuggauuuccaauggaacaggcaacaucgucgccagcgugaauauggugucuagacugcuucugaaccgguucaccaugacccacagacgcccgacaauugagaaagacgucgaucucggggcuggaacgcggcauguuaacgccgaacccgagaccccuaauauggacgugaucggcgagagaaucaagcgcauuaaagaagaacacaacagcacauggcacuacgacgaugaaaaucccuauaagaccugggcuuaccauggguccuaugaggugaaggccacaggaucugcgagcuccaugaucaacggcgucgugaaacugcugaccaagccuugggacguugugcccauggucacacagauggccaugaccgauacgaccccguuuggccagcaacggguguucaaagaaaagguugacacaagaaccccucgcagcaugcccgggacacggagagugaugggaauuaccgcugaguggcucuggcgcacgcugggccggaauaaaaagccuagacuuugcacacgcgaggaauuuaccaagaaaguccggacaaacgccgcuaugggggccguguucaccgaggaaaaucagugggauuccgccaaggcggcuguugaggacgaagauuuuuggacgcugguggacagagagcgcgagcuccacaaacugggaaaguguggcucuugcgucuacaacaugauggggaaaagagaaaagaaacuuggcgaguucggaaaggccaagggcagccgggccaucugguacauguggcugggggcucgcuaucucgaauuugaggcccugggauuccugaaugaggaucauugguuuuccagagaaaacucuuacagcggcguggagggggaaggacuccacaaacugggcuauauucuucgggacaucuccaagauccccgggggcgcuauguacgccgaugacaccgcgggaugggacacaagaauuaccgaggaugaccugcauaaugaagagaaaaucacacagcagauggauccugagcaccggcaacucgccaacgcuauuuucaagcugaccuaucagaauaaagucgugaagguucagcgccccacaccgaccggcacggugauggacaucauuucuagaaaggaucagcgggggagcggacaagucggcacauacgggcuuaacaccuuuaccaauauggaagcccagcugauccgccagauggagggagaaggcgugcucuccaaagcugaccuggagaacccucaucugcccgaaaagaaaaucacacaguggcucgagaccaaggggguggagagacugaaacggauggccauuagcggcgaugacugcguugugaagcccaucgaugaccgcuucgcgaacgcccuucuggcucucaaugauaugggaaaggucagaaaagacauuccucaauggcagccgucuaagggcuggcaugauuggcaacaggugcccuuuuguucccaccauuuccacgaacugaucaugaaagacgggcggaaacuuguugugccuugccgcccccaagacgagcugauuggacgggcccggaucagccagggcgcuggguggucucuccgcgaaacagccugucugggaaaggcuuaugcccagauguggucccugauguacuuccacagacgggaucuccgccuggcgagcaacgccauuugcucugcugucccugugcauuggguccccacguccagaaccacauggagcauccacgcccaucaccaauggaugaccacagaggacaugcuuaccguguggaaucggguuuggaucgaagauaacccuuggauggaggacaagacgcccgugaccacaugggagaaugucccguaccugggcaagagagaagaucaguggugugggucccucauuggccugaccagccgcgccacaugggcucagaacaucccuaccgccauucagcaagugcggucucuuaucggaaaugaggaauuucuggacuauaugcccagcaugaaaagauuccgcaaggaggaggaauccgagggcgcgauuugguga

SEQ ID NO: 20651 - RNA, 9873 nt, Artificial Sequence
  derived and/or modified CDS sequence (opt5) from DENV-3__FJ744726__SS-prME
accagccugugccucaugaugaugcugcccgccacacuugcuuuccaccugacguccagagacggagaaccucggaugaucguggccaagaacgaacgcgggaaaucucuccuguuuaagaccgcgagcggaauuaauauguguacacuuaucgcuauggaucugggcgagaugugcgacgauaccgucacauacaaauguccgcucauugccgaaguugagcccgaagacaucgauugcugguguaaccugaccuccacaugggugaccuaugggacgugcaaucaggccggagagcauagacgggacaagcgcucuguggcucuggccccucacgucggcauggggcucgauaccagaacacagaccuggaugagcgcugagggagccuggagacagguggaaaaaguugagacaugggcgcugcgccaucccggcuucaccauucuugcccuguuucucgcucacuacaucggcacgucccugacacagaagguggucaucuucauucuucugaugcucgugaccccuucuaugacaaugagauguguuggggugggaaaccgggacuuugucgaaggccugagcggggccaccuggguggaugugguccuggagcauggaggcugcguuaccacaauggcuaagaauaaacccacgcucgacaucgagcugcagaagaccgaagccacacaacuugcgacccugcgcaaacucuguauugaggggaagaucacaaacauuaccacggauuccagaugcccuacacagggagaagccauccugccggaggaacaggaccagaauuauguguguaaacacaccuacguggaucggggcuggggcaacgggugcggacuuuucggcaaggggagccuggucacaugcgcuaaguuucaaugucucgagcccauugagggaaaagugguucagcacgaaaaucugaaguauacagugaucaucaccguccauacaggcgaccagcaccagguggggaacgacacgcaaggaguuaccguggagauuacaccucaggccucuaccgucgaagcuauccugcccgaguacggcacacucggccuggaaugcuccccucgcaccgggcuugauuucaaugagaugauucugcucacgaugaaaaacaaggccuggauggugcauagacagugguuuuucgaccugccccuuccguggaccagcggagccacaaccgagacaccuaccuggaaucggaaagaacugcucgucacguuuaagaacgcucacgcgaaaaagcaagaggugguugugcugggcucucaggaaggggccaugcacacagcucugaccggagccacagagauccaaaauuccggcgggaccagcauuuucgccggccaucucaagugucgccugaaaauggauaaacuugaacugaaaggaaugucuuaugcuaugugccucaacaccuuuguccugaagaaagagguguccgagacacagcacggcacgauccugaucaagguugaauacaagggggaggacgcccccuguaaaauuccuuucagcaccgaagauggacaaggcaaggcgcauaacgggagacuuaucacagcuaaucccguggucaccaaaaaggaggagcccgugaacauugaagccgagccuccguucggagaauccaauaucgugauuggcaucggggacaaagcccucaagaucaacugguacaagaaaggcucuagcauuggaaagauguuugaggcuacagcccggggcgcuagacgcauggccauccugggggauaccgcgugggacuucggauccguuggcgggguccugaauagccucggaaaaauggugcaccagauuuuuggcucugccuauacggcucuguucuccggggugagcuggaucaugaagauuggcaucggaguccuucugacauggauuggccucaacucuaaaaauaccagcauguccuuuucuugcaucgugaucgggauuaucacccuguaccugggagccguugugcaggcugauaugggcugugucauuaacuggaaggggaaggaacuuaaaugcggaagcggcaucuucgugacaaaugagguucauaccuggacagagcaguauaaguuucaagccgacucccccaaacggcucgcgacggccauugcuggggccugggaaaacggcguguguggaaucagaagcaccacacgcauggagaaucugcuguggaagcagaucgcuaacgaacucaauuacauucugugggagaacaauaucaaacuuaccgucgugguuggcgauauuaucggggugcuggaacagggaaagcggacacucaccccucagcccauggagcugaaauauucuuggaagacguggggcaaggccaaaauugucaccgccgagacacaaaacuccagcuucaucaucgacgggccuaacacccccgaaugcccgucugcuuccagagcguggaaugugugggagguggaagacuacggauuuggcgucuucacaaccaacauuuggcugaaacuucgcgagguuuauacacagagcugugaucaccggcucauguccgccgcuaucaaagacgaaagagccgugcacgccgauaugggcuacuggauugagucucagaagaaugggagcuggaaacuggagaaggcuuccuuuaucgaagugaagaccugcacguggccuaaaucucauacacuguggagcaacggaguccucgaguccgacaugauuauccccaagagccuggccggcccuaucucucagcacaaucaucgccccggguaccacacccaaaccgcgggaccuuggcaccuuggcaaacuggaacucgauuucaacuauugcgaggggacaaccgugguuauuacggagaauuguggaacacggggccccucccugagaaccacaaccgugagcggcaagcugauccaugaauggugcugucgcucuugcacacuuccgccucuccgguacaugggggaggacggauguugguauggcauggaaauuagacccaucaacgagaaagaagagaauauggucaagucccuggugagcgcugggucuggaaagauggauaacuuuaccaugggcauucugugccucgccauccuguucgaggaaguuaugcgggggaaauucggaaagaaacacaugauugccggcgugcuuuuuacguucguccugcuccugagcggccagaucaccuggcgcgacauggcucauacacugaucaugauuggguccaaugccagcgauagaaugggaaugggcgugaccuaccuugcgcugaucgcuacauuuaagauucagcccuuccucgcccugggguuuuuccuccggaaacugaccucuagagagaaccuucugcucggaguuggccuggccauggcuacgacacugcaacuuccugaagacaucgagcagauggccaaugggauugcucugggacucaugacccugaagcucaucacacaguuugaaaccuaucagcuguggaccgcccuugugucccugacauguagcaacacgaucuucacccucacagucgcguggcgcaccgccacacugauucuggcuggcgugucccuucugccgcucugccaaucuagcuccaugcggaagaccgauuggcugcccaugacgguggccgcuaugggcgucccuccccucccucuguuuaucuucucucuuaaagacacacccaagagacgcagcuggccucugaaugaggggguuauggccgugggacugguguccauucucgccucuagccugcuuagaaacgauguccccauggcuggcccgcugguggccgggggacuccugaucgccuguuacguuauuaccggcaccuccgcugaccucacaguggagaaagccgccgacgucaccugggaagaggaagcugagcagacaggggugagccacaaccugaugaucacgguugaugacgauggaaccaugcggaucaaggacgaugaaacagagaauauucuuaccgugcugcugaaaacagcccuccugaucgucucuggcauuuuuccuuauuccauccccgcgacccuucugguguggcauacguggcagaagcagacccaacgcagcggcguccucugggacgugccuucucccccggagacacagaaagcugaacuggaggaagggguuuacagaauuaagcagcagggaaucuucggcaagacccaagugggggucggagugcagaaagagggcguuuuucacacaauguggcacgugacccgcggggcgguccucacacauaacggaaagcggcuggagccuaauugggccuccgugaaaaaggaucuuauuagcuacggcggcggguggagacugucugcucaguggcaaaaaggagaagaggugcagguuaucgccgucgaacccggcaagaacccuaagaauuuccagacgaugcccgggaucuuccagaccacaaccggagagauuggcgcgaucgcucuggacuuuaaacccgggaccuccggaagcccuauuaucaaccgggaaggcaagguggugggccucuaugggaauggagucgugaccaagaacggcggguacguuuccggaauugcccaaacgaaugccgagccggauggccccaccccugagcuggaagaggaaauguucaagaaacgcaaccuuacaaucauggaccugcaccccgggagcggcaagaccagaaaguaucucccugcuaucgugcgggaggccauuaaacgcagacugcggacacucauccuggcucccaccagagucguggccgcggaaauggaggaggcccuuaagggacugccuauucgcuaccagacgacagcuaucaaaucugaacauaccggccgggagauuguugaucugaugugccacgccaccuuuacaaugagacuccugagcccggugcgcguccccaauuauaaccuuaucaucauggacgaagcucauuucaccgauccugccuccauugccgcucggggguacaucucuacaagagugggaaugggcgaggcggccgcuauuuuuaugaccgccacgcccccugggacagccgaggcuuucccccagagcaaugccccgauccaggacgaggagaaggacauuccugaacgcuccuggaacucuggaaaugaguggaucaccgauuuuguuggcaaaacagugugguucguccccagcauuaaggcggggaacgacaucgcuaacugucugcggaagaauggcaaaaaggugauccaacucuccagaaaaaccuuugauacggaauaucagaagacccgccugaacgacugggauuucguggucacaaccgacauuucugagaugggagccaauuuuaaagccgaucggguuaucgaccccagacggugccugaagccugugauucucacagauggccccgagcgcgugauccuugcugggccuaugccggucaccgccgcgagcgccgcucagagacggggacgcgugggcagaaacccccagaaggaaaaugaccaauacauuuucacagggcagccucugaacaaugaugaggaccacgcccacuggaccgaagcuaaaaugcugcucgacaacaucaauacgcccgagggaaucauuccugcccuguucgaacccgagcgggagaaguccgcugccaucgauggcgaauacagacuuaaaggggagagccgcaagacauuuguugaacugaugcggagaggcgaccucccgguguggcuggcgcauaaagucgccucugagggaauuaaguauaccgaucgcaaauggugcuucgacggcgaacggaacaaucagauccuggaggagaacauggauguggaaauuuggaccaaggagggggaaagaaagaaacuccgcccucgguggcuugacgcuagaacauacuccgauccccuggcccugaaggaguuuaaagacuucgcugccggacgcaagagcaucgcccucgaucugguuaccgaaaucggcagagugccuucucaccuugcucaucggacacgcaaugcgcuggacaaccucgucaugcugcacacguccgagcacgggggccgggccuaucggcaugcuguggaggaacugcccgagaccauggaaacacuccuucugcugggccucaugauucugcuuaccggcggggccaugcuguuucucaucagcggaaaaggcauugggaagacauccaucggacugauuugugucaucgugucuagcggcaugcuguggauggccgauguuccucuccaguggauugcuuccgccaucgugcuugaguucuuuaugauggugcugcugauccccgagccggaaaagcaacgcaccccucaggacaaucagcucgcguacgucguuauugggauccugacgcuugccgcuauugugaccgccaacgagaugggacugcucgaaacaaccaaaagagaucugggcaugagcaaggagcccggcguggucucucccacauccuaucuggacguggaccuccacccugcuagcgccuggacccuuuacgcgguugccacgacagugaucaccccgaugcugcggcauacaauugaaaauucuaccgcuaacgucagccuggccgcuaucgccaaccaagcugugguccucauggggcuggauaaaggauggcccaucuccaagauggaccuuggcgugccucugcucgcccuggggugcuauucucagguuaauccccugacccucacagcggccgugcuucugcuggucacgcacuacgcuauuaucggaccuggccuccaggccaaagcuaccagagaggcccagaagcgcacagccgcggggauuaugaagaaccccaccguggauggaaucaugacaauugaccuggauccuguuaucuacgacagcaaauucgagaagcaacuuggccaggugaugcugcucguccugugugcugugcagcugcuccuuaugcggaccuccugggcccugugcgaagcucugacgcucgccacaggcccgaucaccacccugugggaggggucucccggaaaauuuuggaauacaaccauugccgugagcauggcuaacaucuucagaggcuccuaucuugccggggcgggacuggccuuuagcauuaugaagucuguuggcacagggaaacgcggaacgggcucccagggcgaaacccucggggagaaguggaagaaaaagcugaaucaacugagccggaaagaguucgaucucuacaagaaauccggaaucacagaggucgacagaaccgaggcuaaggaaggccuuaaacgcggggaaacaacccaucacgccgugucucggggaagcgcuaagcugcagugguuuguggaaagaaacauggucauuccugagggccggguuaucgaucugggguguggacgcggcggcugguccuauuacugcgccgggcucaagaaagugacggaagugagaggauauaccaagggcgggcccggacacgaggagccuguccccaugucuacauacggcuggaauauugugaaacugaugagcgggaaggacguuuucuaucuuccgccugaaaaaugugauacccugcucugcgacaucggagaguccagccccucucccacaguggaagagucccggaccauccgcguccugaagaugguggagccuuggcugaagaacaaucaguucuguauuaaaguucucaaccccuacaugccuacagugaucgaacaucuugagagacugcagcggaagcacggcggcaugcugguccgcaauccgcucagcagaaacucuacccaugaaauguacuggauuuccaaugggacgggaaacaucgugagcucugugaauauggucagccggcugcuucugaacagauuuacaaugacccaccgccggcccaccauugagaaagauguugaccucggcgcggggacaagacacgugaacgccgaaccugagacgcccaauauggacgugaucggagagcgcaucaagcggauuaaagaagaacacuccucuaccuggcacuaugaugacgaaaacccuuacaagacaugggcuuaucauggcagcuacgaggucaaggccaccggguccgcuagcuccaugaucaauggagugguuaaacugcugacaaagcccugggauguggucccgauggugacccaaauggccaugacagacaccacgccuuucggccagcagagaguuuuuaaagaaaagguggauacccgcacaccccggccuaugcccggcaccagaaaagucauggagauuacagcugaguggcucuggcgcacccuggggcggaacaagagaccucgccuuugcacgcgggaagaguucacaaagaaagugagaaccaaugccgcgaugggagccguuuuuacagaagagaaccaaugggacucugcucgcgccgcuguggaagaugaggaguucuggaagcuggucgacagagaacgggagcuccacaaacugggcaagugugggagcugcguguauaauaugaugggaaaacgcgaaaagaaacuuggcgaguuugggaaggccaagggcuccagagccaucugguacauguggcugggagcgcgguaucucgaguucgaagcucugggcuuucugaacgaggaucauugguucucuagagaaaauagcuacuccggggucgagggagaaggccuccacaaacugggguacauucuucgggacaucucuaagauccccggaggcgccauguaugccgaugacaccgcugggugggacacgcgcauuaccgaggaugaccugcacaacgaggagaagaucacacagcagauggauccggagcauagacagcucgccaaugcuauuuuuaagcugaccuaccaaaacaaagugguuaaggugcagcggccuacacccaagggcaccgucauggacaucauuagccgcaaagaucagagaggauccggccagguggggacauauggacuuaauaccuucacgaacauggaagcccaacuggugcggcagauggagggcgaagggguucucagcaagguggaccuggagaauccccaucugcucgagaaaaagaucacacaguggcuggaaaccaaaggagucgagcgccuuagacggauggcgaucucuggcgaugacugcgugguuaagccuauugaugaccgcuuugccaacgcucugcucgcccugaacgauauggggaaggugagaaaagacaucccgcaguggcaacccuccaagggcuggcaugauuggcagcaggucccuuucuguagccaccacuuccaugaacuuauuaugaaagacggacggaagcuggugguccccugccgcccucaggacgagcucaucggcagagcucggauuucucaaggggccggauggucccugaaagaaaccgcgugucugggcaaggccuacgcucagauguggagccucauguauuuucaccgcagagaucugcggcuugccucuaaugcuaucugcuccgccgugcccguucauugggugccuacaagcagaaccacaugguccauucacgcucaucaccaguggaugacgaccgaggacaugcugacagucuggaaccgcguguggaucgaggauaaucccuggauggaagacaagaccccgguuacaaccugggaggaugugccuuaccucgggaaacgggaagaccaaugguguggaagccugaucggccuuacgucuagagccaccugggcgcagaacauucugacagccauccagcagguccgcagccucauuggggaugaggaguuccuggacuauaugcccuccaugaagcgguuuagaaaagaagaggaaucugagggcgcuaucugguga

SEQ ID NO: 20652 - RNA, 9873 nt, Artificial Sequence
  derived and/or modified CDS sequence (opt5) from DENV-3__FJ744729__SS-prME
accagccugugccucaugaugaugcugcccgccacacuugcuuuccaccugacguccagagacggagagccucggaugaucguggccaagaacgaacgcgggaagucucuccuguuuaagaccgcgagcggaauuaauauguguacacuuaucgcuauggaucugggcgagaugugcgacgauaccgucacauacaaauguccgcucauugccgaaguugagcccgaagacaucgauugcugguguaaccugaccuccacaugggugaccuaugggacgugcaaucaggccggagagcacagacgggacaagcgcucuguggcucuggccccucacgucggcauggggcucgauaccagaacacagaccuggaugagcgcugagggagccuggcggcaggucgaaaaaguugagacaugggcgcugcgccaucccggcuucaccauucuugcccuguuucucgcucacuacaucggcacgucccugacacagaagguggucaucuucauucuucugaugcucgugaccccuucuaugacaaugagauguguuggggugggaaaccgggacuuugucgaaggccugagcggggccaccuggguggaugugguccuggagcauggaggcugcguuaccacaauggcuaagaauaaacccacgcucgacaucgagcugcagaagaccgaagccacacaacuugcgacccugcgcaaacucuguauugaggggaagaucacaaacauuaccacggauuccagaugcccuacacagggagaagccauccugccggaggaacaggaccagaauuauguguguaaacacaccuacguggaucggggcuggggcaacgggugcggacuuuucggcaaggggagccuggugaccugcgcuaaguuucaaugucucaaacccauugagggaaaggugguucagcacgagaaucugaaauauacagugaucaucaccguccauacaggcgaccagcaccagguggggaacgacacgcaaggaguuaccguggaaauuacaccucaggccucuaccgucgaggcuauccugcccgaauacggcacacucggccuggagugcuccccucgcaccgggcuugauuucaaugaaaugauucugcucacgaugaagaacaaagccuggauggugcauagacagugguuuuucgaccugccccuuccguggaccagcggagccacaaccgagacaccuaccuggaaucggaaggagcugcucgucacguuuaaaaacgcucacgcgaagaagcaagaagugguugugcugggcucucaggagggggccaugcacacagcucugaccggagccacagaaauccaaaauuccggcgggaccagcauuuucgccggccaucucaaaugucgccugaagauggauaaacuugagcugaagggaaugucuuaugcuaugugccucaacaccuuuguccugaaaaaggaaguguccgagacacagcacggcacgauccugaucaagguugaguacaaaggggaagacgcccccuguaagauuccuuucagcaccgaggauggacaaggcaaagcgcauaacgggagacuuaucacagcuaaucccguggucaccaagaaagaggaacccgugaacauugaggccgaaccuccguucggagaguccaauaucgugauuggcaucggggacaaggcccucaagaucaacugguacaaaaagggcucuagcauuggaaaaauguuugaagcuacagcccggggcgcuagacgcauggccauccugggggauaccgcgugggacuucggauccguuggcgggguccugaauagccucggaaagauggugcaccagauuuuuggcucugccuauacggcucuguucuccggggugagcuggaucaugaaaauuggcaucggaguccuucugacauggauuggccucaacucuaagaauaccagcauguccuuuucuugcaucgugaucgggauuaucacccuguaccugggagccguugugcaggcugauaugggcugugucauuaacuggaaggggaaagagcuuaagugcggaagcggcaucuucgugacaaaugaaguucauaccuggacagagcaguauaaauuucaagccgacucccccaagcggcucgcgacggccauugcuggggccugggagaacggcguguguggaaucagaagcaccacacgcauggaaaaucugcuguggaaacagaucgcuaacgagcucaauuacauucugugggaaaacaauaucaaacuuaccgucgugguuggcgauauuaucggggugcuggagcagggaaaacggacacucaccccucagcccauggaacugaaguauucuuggaagacguggggcaaagccaagauugucaccgccgagacacaaaacuccagcuucaucaucgacgggccuaacacccccgagugcccgucugcuuccagagcguggaaugugugggaaguggaggacuacggauuuggcgucuucacaaccaacauuuggcugaaacuucgcgaaguuuauacacagagcugugaucaccggcucauguccgccgcuaucaaggacgagagagccgugcacgccgauaugggcuacuggauugaaucucagaaaaaugggagcuggaagcuggagaaggcuuccuuuaucgaggugaaaaccugcacguggccuaagucucauacacuguggagcaacggaguccucgaauccgacaugauuauccccaaaagccuggccggcccuaucucucagcacaaucaucgccccggguaccacacccaaaccgcgggaccuuggcaccuuggcaagcuggagcucgauuucaacuauugcgaagggacaaccgugguuauuacggagaauuguggaacacggggccccucccugagaaccacaaccgugagcggcaaacugauccaugaguggugcugucgcucuugcacacuuccgccucuccgguacaugggggaagacggauguugguauggcauggagauuagacccaucaacgaaaaggaggaaaauauggucaagucccuggugagcgcugggucuggaaaaauggauaacuuuaccaugggcauucugugccucgccauccuguucgaggagguuaugcgggggaaguucggcaagaagcacaugauugccggcgugcuuuuuacguucguccugcuccugagcggccagaucaccuggcgcgacauggcucauacacugaucaugauuggguccaaugccagcgauagaaugggaaugggcgugaccuaccuugcgcugaucgcuacauuuaaaauucagcccuuccucgcccugggguuuuuccuccggaagcugaccucuagagaaaaccuucugcucggaguuggccuggccauggcuacgacacugcaacuuccugaggacaucgaacagauggccaaugggauugcucugggacucaugacccugaagcucaucacacaguuugagaccuaucagcuguggaccgcccuugugucccugacauguagcaacacgaucuucacccucacagucgcguggcgcaccgccacacugauucuggcuggcgugucccuucugccgcucugccaaucuagcuccaugcggaaaaccgauuggcugcccaugacgguggccgcuaugggcgucccuccccucccucuguuuaucuucucucuuaaggacacacccaaaagacgcagcuggccucugaaugaagggguuauggccgugggacugguguccauucucgccucuagccugcuuagaaacgauguccccauggcuggcccgcugguggccgggggacuccugaucgccuguuacguuauuaccggcaccuccgcugaccucacaguggagaaggccgccgacgucaccugggaggaagaggcugaacagacaggggugagccacaaccugaugaucacgguugaugacgauggaaccaugcggaucaaagacgaugagacagaaaauauucuuaccgugcugcugaagacagcccuccugaucgucucuggcauuuuuccuuauuccauccccgcgacccuucugguguggcauacguggcagaaacagacccaacgcagcggcguccucugggacgugccuucucccccggagacacagaaggcugagcuggaagaggggguuuacagaauuaagcagcagggaaucuucggcaaaacccaagugggggucggagugcagaaggaaggcguuuuucacacaauguggcacgugacccgcggggcgguccucacacauaacggaaaacggcuggagccuaauugggccuccgugaagaaagaucuuauuagcuacggcggcggguggagacugucugcucaguggcaaaagggagaggaagugcagguuaucgccgucgagcccggcaagaacccuaaaaauuuccagacgaugcccgggaucuuccagaccacaaccggagaaauuggcgcgaucgcucuggacuuuaagcccgggaccuccggaagcccuauuaucaaccgggagggcaaaguggugggccucuaugggaauggagucgugacaaagaacggcggguacguuuccggaauugcccaaacgaaugccgaaccggauggccccaccccugagcuggaggaagagauguucaaaaagcgcaaccuuacaaucauggaccugcaccccgggagcggcaagaccagaaaauaucucccugcuaucgugcgggaagccauuaagcgcagacugcggacacucauccuggcucccaccagagucguggccgcggagauggaagaggcccuuaaaggacugccuauucgcuaccagacgacagcuaucaagucugagcauaccggccgggaaauuguugaucugaugugccacgccaccuuuacaaugagacuccugagcccggugcgcguccccaauuauaaccuuaucaucauggacgaggcucauuucaccgauccugccuccauugccgcucggggguacaucucuacaagagugggaaugggcgaagcggccgcuauuuuuaugaccgccacgcccccugggacagccgaggcuuucccccagagcaaugccccgauccaggacgaagaacgcgacauuccugagcgguccuggaacucuggaaaugaauggaucaccgauuuuguuggcaaaacagugugguucguccccagcauuaaggcggggaacgacaucgcuaacugucugagaaagaauggcaaaaaggugauccaacucucccgcaaaaccuuugauacggaguaucagaagacccggcugaacgacugggauuucguggucacaaccgacauuucugaaaugggagccaauuuuaaagccgauagaguuaucgacccccggcgcugccugaagccugugauucucacagauggccccgagagagugauccuugcugggccuaugccggucaccgccgcgagcgccgcucagcggcgcggaagagugggccggaacccccagaaggagaaugaccaauacauuuucacagggcagccucugaacaaugaugaagaccacgcccacuggaccgaggcuaaaaugcugcucgacaacaucaauacgcccgaaggaaucauuccugcccuguucgagcccgaaagagagaaguccgcugccaucgauggcgaguaccgccuuaaaggggaaagccggaagacauuuguugagcugaugagacgcggcgaccucccgguguggcuggcgcauaaagucgccucugaaggaauuaaguauaccgaucggaaauggugcuucgacggcgagagaaacaaucagauccuggaagagaacauggauguggagauuuggaccaaggaaggggagcgcaagaaacuccggccuagauggcuugacgcucgcacauacuccgauccccuggcccugaaggaauuuaaagacuucgcugccggaagaaagagcaucgcccucgaucugguuaccgagaucggccgggugccuucucaccuugcucaucgcacaagaaaugcgcuggacaaccucgucaugcugcacacguccgaacacgggggacgggccuaucgccaugcuguggaggagcugcccgaaaccauggagacacuccuucugcugggccucaugauucugcuuaccggcggggccaugcuguuucucaucagcggaaaaggcauugggaagacauccaucggacugauuugugucaucgugucuagcggcaugcuguggauggccgauguuccucuccaguggauugcuuccgccaucgugcuugaguucuuuaugauggugcugcugauccccgagccggagaagcaaagaaccccucaggacaaucagcucgcguacgucguuauugggauccugacgcuugccgcuauugugaccgccaacgaaaugggacugcucgagacaaccaaacgggaucugggcaugagcaaggaacccggcguggucucucccacauccuaucuggacguggaccuccacccugcuagcgccuggacccuuuacgcgguugccacgacagugaucaccccgaugcugagacauacaauugaaaauucuaccgcuaacgucagccuggccgcuaucgccaaccaagcugugguccucauggggcuggauaaaggauggcccaucuccaagauggaccuuggcgugccucugcucgcccuggggugcuauucucagguuaauccccugacccucacagcggccgugcuucugcuggucacgcacuacgcuauuaucggaccuggccuccaggccaaagcuacccgcgaagcccagaagcggacagccgcggggauuaugaagaaccccaccguggauggaaucaugacaauugaccuggauccuguuaucuacgacagcaaauucgagaagcaacuuggccaggugaugcugcucguccugugugcugugcagcugcuccuuaugagaaccuccugggcccugugcgaggcucugacgcucgccacaggcccgaucaccacccugugggaagggucucccggaaaauuuuggaauacaaccauugccgugagcauggcuaacaucuuccgcggcuccuaucuugccggggcgggacuggccuuuagcauuaugcggucuguuggcacagggaagagaggaacgggcucccagggcgagacccucggggaaaaauggaagaagaaacugaaucaacugagccggaaggaguucgaucucuacaaaaaguccggaaucacagaagucgaccgcaccgaggcuaaagagggccuuaagagaggggaaacaacccaucacgccgugucucggggaagcgcuaaacugcagugguuuguggagcgcaacauggucauuccugaaggcagaguuaucgaucugggguguggacggggcggcugguccuauuacugcgccgggcucaagaaggugacggaggugcgcggauauaccaaaggcgggcccggacacgaggaaccuguccccaugucuacauacggcuggaauauugugaagcugaugagcgggaaagacguuuucuaucuuccgccugagaagugugauacccugcucugcgacaucggagaauccagccccucucccacaguggaggaauccagaaccauccggguccugaaaaugguggagccuuggcugaagaacaaucaguucuguauuaagguucucaaccccuacaugccuacagugaucgagcaucuugaacgccugcagagaaaacacggcggcaugcugguccggaauccgcucagcagaaacucuacccaugagauguacuggauuuccaaugggacgggaaacaucgugagcucugugaauauggucagccgccugcuucugaaccgguuuacaaugacccacagacgccccaccauugaaaaggauguugaccucggcgcggggacacggcacgugaacgccgagccugaaacgcccaauauggacgugaucggagagagaaucaaacgcauuaaggaggaacauuccucuaccuggcacuaugaugacgagaacccuuacaaaacaugggcuuaucauggcagcuacgaagucaaggccaccggguccgcuagcuccaugaucaauggagugguuaagcugcugacaaaacccugggauguggucccgauggugacccaaauggccaugacagacaccacgccuuucggccagcagcggguuuuuaaggagaaaguggauaccagaacaccccgcccuaugcccggcacccggaaggucauggaaauuacagcugaguggcucuggagaacccuggggcgcaacaaacggccuagacuuugcacgcgcgaggaguucacaaagaaggugagaaccaaugccgcgaugggagccguuuuuacagaggaaaaccaaugggacucugcucgggccgcuguggaggaugaagaguucuggaaacuggucgaccgcgagagagaacuccacaagcugggcaaaugugggagcugcguguauaauaugaugggaaagcgggagaagaaacuuggcgaauuugggaaagccaaaggcuccagagccaucugguacauguggcugggagcgcgguaucucgaguucgaggcucugggcuuucugaacgaagaucauugguucucucgcgagaauagcuacuccggggucgaaggagagggccuccacaagcugggguacauucuuagagacaucucuaaaauccccggaggcgccauguaugccgaugacaccgcugggugggacacgcggauuaccgaagaugaccugcacaacgaggagaagaucacacagcagauggauccggaacaucgccagcucgccaaugcuauuuuuaaacugaccuaccaaaacaaggugguuaaagugcagagaccuacacccaagggcaccgucauggacaucauuagccggaaggaucagcgcggauccggccagguggggacauauggacuuaauaccuucacgaacauggaggcccaacuggugagacagauggaaggcgaggggguucucagcaaaguggaccuggaaaauccccaucugcucgagaagaaaaucacacaguggcuggagaccaagggagucgaacggcuucgcagaauggcgaucucuggcgaugacugcgugguuaaaccuauugaugaccgguuugccaacgcucugcucgcccugaacgauauggggaaggugcgcaaggacaucccgcaguggcaacccuccaaaggcuggcaugauuggcagcaggucccuuucuguagccaccacuuccaugagcuuauuaugaaggacggaagaaaacuggugguccccugccggccucaggacgaacucaucggccgcgcuagaauuucucaaggggccggauggucccugaaggagaccgcgugucugggcaaagccuacgcucagauguggagccucauguauuuucaccggagagaucugcgccuugccucuaaugcuaucugcuccgccgugcccguucauugggugccuacaagccggaccacaugguccauucacgcucaucaccaguggaugacgaccgaagacaugcugacagucuggaacagaguguggaucgaggauaaucccuggauggaggacaagaccccgguuacaaccugggaagaugugccuuaccucgggaagcgcgaggaccaaugguguggaagccugaucggccuuacgucucgggccaccugggcgcagaacauucugacagccauccagcaggucagaagccucauuggggaugaagaguuccuggacuauaugcccuccaugaaacgcuuucggaaggaggaagagucugaaggcgcuaucugguga

SEQ ID NO: 20653 - RNA, 9873 nt, Artificial Sequence
  derived and/or modified CDS sequence (opt5) from DENV-3__FJ687448__SS-prME
accagccugugccucaugaugaugcugcccgccacacuugcuuuccaccugacgucccgggacggcgaaccucggaugaucguggccaagaacgaacgcgggaagucucuccuguuuaagaccgcgagcggaauuaauauguguacacuuaucgcuauggaucugggcgaaaugugcgacgauaccgucacauacaaauguccgcucauugccgaaguugagcccgaagacaucgauugcugguguaaccugaccuccacaugggugaccuaugggacgugcaaucaggccggagagcauagacgggacaagcgcucuguggcucuggccccucacgucggcauggggcucgauaccagaacacagaccuggaugagcgcugagggagccuggagacagguggaaaaaguugagacaugggcgcugcgccaucccggcuucaccauucuugcccuguuucucgcucacuacaucggcacgucccugacacagaagguggucaucuucauucuucugaugcucgugaccccuucuaugacaaugagauguguuggggugggaaaccgggacuuugucgaaggccugagcggggccaccuggguggaugugguccuggagcauggaggcugcguuaccacaauggcuaagaauaaacccacgcucgacaucgagcugcagaagaccgaagccacacaacuugcgacccugcgcaaacucuguauugaggggaagaucacaaacauuaccacggauuccagaugcccuacacagggagaagccauccugccggaggaacaggaccagaauuauguguguaaacacaccuacguggaucggggcuggggcaacgggugcggacuuuucggcaaggggagccuggucacaugcgcuaaguuucaaugucucgagcccauugagggaaaagugguucagcacgaaaaucugaaguauacagugaucaucaccguccauacaggcgaccagcaccagguggggaacgacacgcaaggaguuaccguggagauuacaccucaggccucuaccgucgaagcuauccugcccgaguacggcacacucggccuggaaugcuccccucgcaccgggcuugauuucaaugagaugauucugcucacgaugaaaaacaaggccuggauggugcauagacagugguuuuucgaccugccccuuccguggaccagcggagccacaaccgagacaccuaccuggaaucggaaagaacugcucgucacguuuaagaacgcucacgcgaaaaagcaagaggugguugugcugggcucucaggaaggggccaugcacacagcucugaccggagccacagagauccaaaauuccggcgggaccagcauuuucgccggccaucucaagugucgccugaaaauggauaaacuugaacugaaaggaaugucuuaugcuaugugccucaacaccuuuguccugaagaaagagguguccgagacacagcacggcacgauccugaucaagguugaauacaagggggaggacgcccccuguaaaauuccuuucagcaccgaagauggacaaggcaaggcgcauaacgggagacuuaucacagcuaaucccguggucaccaaaaaggaggagcccgugaacauugaagccgagccuccguucggagaauccaauaucgugauuggcaucggggacaaagcccucaagaucaacugguacaagaaaggcucuagcauuggaaagauguuugaggcuacagcccggggcgcuagacgcauggccauccugggggauaccgcgugggacuucggauccguuggcgggguccugaauagccucggaaaaauggugcaccagauuuuuggcucugccuauacggcucuguucuccggggugagcuggaucaugaagauuggcaucggaguccuucugacauggauuggccucaacucuaaaaauaccagcauguccuuuucuugcaucgugaucgggauuaucacccuguaccugggagccguugugcaggcugauaugggcugugucauuaacuggaaggggaaggaacuuaaaugcggaagcggcaucuucgugacaaaugagguucauaccuggacagagcaguauaaguuucaagccgacucccccaaacggcucgcgacggccauugcuggggccugggaaaacggcguguguggaaucagaagcaccacacgcauggagaaucugcuguggaagcagaucgcuaacgaacucaauuacauucugugggagaacaauaucaaacuuaccgucgugguuggcgauauuaucggggugcuggaacagggaaagcggacacucaccccucagcccauggagcugaaauauucuuggaagacguggggcaaggccaaaauugucaccgccgagacacaaaacuccagcuucaucaucgacgggccuaacacccccgaaugcccgucugcuuccagagcguggaaugugugggagguggaagacuacggauuuggcgucuucacaaccaacauuuggcugaaacuucgcgagguuuauacacagagcugugaucaccggcucauguccgccgcuaucaaagacgaaagagccgugcacgccgauaugggcuacuggauugagucucagaagaaugggagcuggaaacuggagaaggcuuccuuuaucgaagugaagaccugcacguggccuaaaucucauacacuguggagcaacggaguccucgaguccgacaugauuauccccaagagccuggccggcccuaucucucagcacaaucaucgccccggguaccacacccaaaccgcgggaccuuggcaccuuggcaaacuggaacucgauuucaacuauugcgaggggacaaccgugguuauuacggagaauuguggaacacggggccccucccugagaaccacaaccgugagcggcaagcugauccaugaauggugcugucgcucuugcacacuuccgccucuccgguacaugggggaggacggauguugguauggcauggaaauuagacccaucaacgagaaagaagagaauauggucaagucccuggugagcgcugggucuggaaagauggauaacuuuaccaugggcauucugugccucgccauccuguucgaggaaguuaugcgggggaaauucggaaagaaacacaugauugccggcgugcuuuuuacguucguccugcuccugagcggccagaucaccuggcgcgacauggcucauacacugaucaugauuggguccaaugccagcgauagaaugggaaugggcgugaccuaccuugcgcugaucgcuacauuuaagauucagcccuuccucgcccugggguuuuuccuccggaaacugaccucuagagagaaccuucugcucggaguuggccuggccauggcuacgacacugcaacuuccugaagacaucgagcagauggccaaugggauugcucugggacucaugacccugaagcucaucacacaguuugaaaccuaucagcuguggaccgcccuugugucccugacauguagcaacacgaucuucacccucacagucgcguggcgcaccgccacacugauucuggcuggcgugucccuucugccgcucugccaaucuagcuccaugcggaagaccgauuggcugcccaugacgguggccgcuaugggcgucccuccccucccucuguuuaucuucucucuuaaagacacacccaagagacgcagcuggccucugaaugaggggguuauggccgugggacugguguccauucucgccucuagccugcuuagaaacgauguccccauggcuggcccgcugguggccgggggacuccugaucgccuguuacguuauuaccggcaccuccgcugaccucacaguggagaaagccgccgacgucaccugggaagaggaagcugagcagacaggggugagccacaaccugaugaucacgguugaugacgauggaaccaugcggaucaaggacgaugaaacagagaauauucuuaccgugcugcugaaaacagcccuccugaucgucucuggcauuuuuccuuauuccauccccgcgacccuucugguguggcauacguggcagaagcagacccaacgcagcggcguccucugggacgugccuucucccccggagacacagaaagcugaacuggaggaagggguuuacagaauuaagcagcagggaaucuucggcaagacccaagugggggucggagugcagaaagagggcguuuuucacacaauguggcacgugacccgcggggcgguccucacacauaacggaaagcggcuggagccuaauugggccuccgugaaaaaggaucuuauuagcuacggcggcggguggagacugucugcucaguggcaaaaaggagaagaggugcagguuaucgccgucgaacccggcaagaacccuaagaauuuccagacgaugcccgggaucuuccagaccacaaccggagagauuggcgcgaucgcucuggacuuuaaacccgggaccuccggaagcccuauuaucaaccgggaaggcaagguggugggccucuaugggaauggagucgugaccaagaacggcggguacguuuccggaauugcccaaacgaaugccgagccggauggccccaccccugagcuggaagaggaaauguucaagaaacgcaaccuuacaaucauggaccugcaccccgggagcggcaagaccagaaaguaucucccugcuaucgugcgggaggccauuaaacgcagacugcggacacucauccuggcucccaccagagucguggccgcggaaauggaggaggcccuuaagggacugccuauucgcuaccagacgacagcuaucaaaucugaacauaccggccgggagauuguugaucugaugugccacgccaccuuuacaaugagacuccugagcccggugcgcguccccaauuauaaccuuaucaucauggacgaagcucauuucaccgauccugccuccauugccgcucggggguacaucucuacaagagugggaaugggcgaggcggccgcuauuuuuaugaccgccacgcccccugggacagccgaggcuuucccccagagcaaugccccgauccaggacgaggagcgcgacauuccugaacgguccuggaacucuggaaaugaguggaucaccgauuuuguuggcaagacagugugguucguccccagcauuaaagcggggaacgacaucgcuaacugucugagaaagaauggcaagaaagugauccaacucucccgcaagaccuuugauacggaauaucagaaaacccggcugaacgacugggauuucguggucacaaccgacauuucugagaugggagccaauuuuaaggccgauagaguuaucgacccccggcgcugccugaaaccugugauucucacagauggccccgagagagugauccuugcugggccuaugccggucaccgccgcgagcgccgcucagcggcgcggaagagugggccggaacccccagaaggaaaaugaccaauacauuuucacagggcagccucugaacaaugaugaggaccacgcccacuggaccgaagcuaagaugcugcucgacaacaucaauacgcccgagggaaucauuccugcccuguucgaacccgagagagagaaauccgcugccaucgauggcgaauaccgccuuaagggggagagccggaaaacauuuguugaacugaugagacgcggcgaccucccgguguggcuggcgcauaaggucgccucugagggaauuaaauauaccgaucggaaguggugcuucgacggcgaaagaaacaaucagauccuggaggagaacauggauguggaaauuuggaccaaagagggggaacgcaagaagcuccggccuagauggcuugacgcucgcacauacuccgauccccuggcccugaaagaguuuaaggacuucgcugccggaagaaaaagcaucgcccucgaucugguuaccgaaaucggccgggugccuucucaccuugcucaucgcacaagaaaugcgcuggacaaccucgucaugcugcacacguccgagcacgggggacgggccuaucgccaugcuguggaggaacugcccgagaccauggaaacacuccuucugcugggccucaugauucugcuuaccggcggggccaugcuguuucucaucagcggaaagggcauugggaaaacauccaucggacugauuugugucaucgugucuagcggcaugcuguggauggccgauguuccucuccaguggauugcuuccgccaucgugcuugaguucuuuaugauggugcugcugauccccgagccggaaaagcaaagaaccccucaggacaaucagcucgcguacgucguuauugggauccugacgcuugccgcuauugugaccgccaacgagaugggacugcucgaaacaaccaagcgggaucugggcaugagcaaagagcccggcguggucucucccacauccuaucuggacguggaccuccacccugcuagcgccuggacccuuuacgcgguugccacgacagugaucaccccgaugcugagacauacaauugaaaauucuaccgcuaacgucagccuggccgcuaucgccaaccaagcugugguccucauggggcuggauaagggauggcccaucuccaaaauggaccuuggcgugccucugcucgcccuggggugcuauucucagguuaauccccugacccucacagcggccgugcuucugcuggucacgcacuacgcuauuaucggaccuggccuccaggccaaggcuacccgcgaggcccagaaacggacagccgcggggauuaugaagaaccccaccguggauggaaucaugacaauugaccuggauccuguuaucuacgacagcaaguucgagaaacaacuuggccaggugaugcugcucguccugugugcugugcagcugcuccuuaugagaaccuccugggcccugugcgaagcucugacgcucgccacaggcccgaucaccacccugugggaggggucucccggaaaguuuuggaauacaaccauugccgugagcauggcuaacaucuuccgcggcuccuaucuugccggggcgggacuggccuuuagcauuaugaaaucuguuggcacagggaagcggggaacgggcucccagggcgaaacccucggggagaaauggaagaagaaacugaaucaacugagcagaaaggaguucgaucucuacaaaaaguccggaaucacagaggucgaccggaccgaggcuaaagaaggccuuaagcgcggggagacaacccaucacgccgugucuagaggaagcgcuaaacugcagugguuuguggaacggaacauggucauuccugagggccgcguuaucgaucugggguguggaagaggcggcugguccuauuacugcgccgggcucaagaaggugacggaagugcggggauauaccaaaggcgggcccggacacgaggagccuguccccaugucuacauacggcuggaauauugugaagcugaugagcgggaaagacguuuucuaucuuccgccugaaaagugugauacccugcucugcgacaucggagaguccagccccucucccacaguggaagagucccgcaccaucagaguccugaaaaugguggagccuuggcugaagaacaaucaguucuguauuaagguucucaaccccuacaugccuacagugaucgaacaucuugagcggcugcagcgcaaacacggcggcaugcuggucagaaauccgcucagccggaacucuacccaugaaauguacuggauuuccaaugggacgggaaacaucgugagcucugugaauauggucagcagacugcuucugaaccgcuuuacaaugacccaccggagacccaccauugagaaggauguugaccucggcgcggggacacgccacgugaacgccgaaccugagacgcccaauauggacgugaucggagagcggaucaaaagaauuaaggaagaacacuccucuaccuggcacuaugaugacgaaaacccuuacaaaacaugggcuuaucauggcagcuacgaggucaaggccaccggguccgcuagcuccaugaucaauggagugguuaagcugcugacaaaacccugggauguggucccgauggugacccaaauggccaugacagacaccacgccuuucggccagcagcgcguuuuuaaggaaaaaguggauacccggacacccagaccuaugcccggcacccgcaaggucauggagauuacagcugaguggcucuggcggacccuggggagaaacaaacgcccucggcuuugcacgagagaagaguucacaaagaaggugcgcaccaaugccgcgaugggagccguuuuuacagaagagaaccaaugggacucugcuagagccgcuguggaagaugaggaguucuggaaacuggucgaccgggaacgcgagcuccacaagcugggcaaaugugggagcugcguguauaauaugaugggaaagagagagaagaaacuuggcgaguuugggaaagccaagggcucccgggccaucugguacauguggcugggagcgagauaucucgaguucgaagcucugggcuuucugaacgaggaucauugguucucucgggaaaauagcuacuccggggucgagggagaaggccuccacaagcugggguacauucuucgcgacaucucuaaaauccccggaggcgccauguaugccgaugacaccgcugggugggacacgagaauuaccgaggaugaccugcacaacgaggaaaagaucacacagcagauggauccggagcaucggcagcucgccaaugcuauuuuuaaacugaccuaccaaaacaaggugguuaaagugcagcgcccuacacccaagggcaccgucauggacaucauuagcagaaaggaucagcggggauccggccagguggggacauauggacuuaauaccuucacgaacauggaagcccaacuggugcgccagauggagggcgaagggguucucagcaaaguggaccuggagaauccccaucugcucgagaagaaaaucacacaguggcuggaaaccaagggagucgagagacuucggcgcauggcgaucucuggcgaugacugcgugguuaaaccuauugaugacagauuugccaacgcucugcucgcccugaacgauauggggaaggugcggaaggacaucccgcaguggcaacccuccaaaggcuggcaugauuggcagcaggucccuuucuguagccaccacuuccaugaacuuauuaugaaggacggacgcaaacuggugguccccugcagaccucaggacgagcucaucggccgggcucgcauuucucaaggggccggauggucccugaaggaaaccgcgugucugggcaaagccuacgcucagauguggagccucauguauuuucacagacgggaucugagacuugccucuaaugcuaucugcuccgccgugcccguucauugggugccuacaagccgcaccacaugguccauucacgcucaucaccaguggaugacgaccgaggacaugcugacagucuggaaccggguguggaucgaggauaaucccuggauggaagacaagaccccgguuacaaccugggaggaugugccuuaccucgggaagagagaagaccaaugguguggaagccugaucggccuuacgucucgcgccaccugggcgcagaacauucugacagccauccagcagguccggagccucauuggggaugaggaguuccuggacuauaugcccuccaugaaaagauuucgcaaggaagaggaaucugagggcgcuaucugguga

SEQ ID NO: 20654 - RNA, 9873 nt, Artificial Sequence
  derived and/or modified CDS sequence (opt5) from DENV-3__FJ744732__SS-prME
accagccugugccucaugaugaugcugcccgccacacuugcuuuccaccugacgucccgggacggcgaaccucggaugaucguggccaagaacgaacgcgggaaaucucuccuguuuaagaccgcgagcggaauuaauauguguacacuuaucgcuauggaucugggcgaaaugugcgacgauaccgucacauacaaauguccgcucauugccgaaguugagcccgaagacaucgauugcugguguaaccugaccuccacaugggugaccuaugggacgugcaaucaggccggagagcauagacgggacaagcgcucuguggcucuggccccucacgucggcauggggcucgauaccagaacacagaccuggaugagcgcugagggagccuggagacagguggaaaaaguugagacaugggcgcugcgccaucccggcuucaccauucuugcccuguuucucgcucacuacaucggcacgucccugacacagaagguggucaucuucauucuucugaugcucgugaccccuucuaugacaaugagauguguuggggugggaaaccgggacuuugucgaaggccugagcggggccaccuggguggaugugguccuggagcauggaggcugcguuaccacaauggcuaagaauaaacccacgcucgacaucgagcugcagaagaccgaagccacacagcuugcgacccugcgcaaacucuguauugaggggaagaucacaaacauuaccacggauuccagaugcccuacacagggagaagccauccugccggaggaacaggaccagaauuauguguguaaacacaccuacguggaucggggcuggggcaacgggugcggacuuuucggcaaggggagccuggucacaugcgcuaaguuucagugucucgagcccauugagggaaaagugguucagcacgaaaaucugaaguauacagugaucaucaccguccauacaggcgaccagcaccagguggggaacgacacgcaaggaguuaccguggagauuacaccucaggccucuaccgucgaagcuauccugcccgaguacggcacacucggccuggaaugcuccccucgcaccgggcuugauuucaaugagaugauucugcucacgaugaaaaacaaggccuggauggugcauagacagugguuuuucgaccugccccuuccguggaccagcggagccacaaccgagacaccuaccuggaaucggaaagaacugcucgucacguuuaagaacgcucacgcgaaaaagcaagaggugguugugcugggcucucaggaaggggccaugcacacagcucugaccggagccacagagauccaaaauuccggcgggaccagcauuuucgccggccaucucaagugucgccugaaaauggauaaacuugaacugaaaggaaugucuuaugcuaugugccucaacaccuuuguccugaagaaagagguguccgagacacagcacggcacgauccugaucaagguugaauacaagggggaggacgcccccuguaaaauuccuuucagcaccgaagauggacaaggcaaggcgcauaacgggagacuuaucacagcuaaucccguggucaccaaaaaggaggagcccgugaacauugaagccgagccuccguucggagaauccaauaucgugauuggcaucggggacaaagcccucaagaucaacugguacaagaaaggcucuagcauuggaaagauguuugaggcuacagcccggggcgcuagacgcauggccauccugggggauaccgcgugggacuucggauccguuggcgggguccugaauagccucggaaaaauggugcaccagauuuuuggcucugccuauacggcucuguucuccggggugagcuggaucaugaagauuggcaucggaguccuucugacauggauuggccucaacucuaaaaauaccagcauguccuuuucuugcaucgugaucgggauuaucacccuguaccugggagccguugugcaggcugauaugggcugugucauuaacuggaaggggaaggaacuuaaaugcggaagcggcaucuucgugacaaaugagguucauaccuggacagagcaguauaaguuucaagccgacucccccaaacggcucgcgacggccauugcuggggccugggaaaacggcguguguggaaucagaagcaccacacgcauggagaaucugcuguggaagcagaucgcuaacgaacucaauuacauucugugggagaacaauaucaaacuuaccgucgugguuggcgauauuaucggggugcuggaacagggaaagcggacacucaccccucagcccauggagcugaaauauucuuggaagacguggggcaaggccaaaauugucaccgccgagacacaaaacuccagcuucaucaucgacgggccuaacacccccgaaugcccgucugcuuccagagcguggaaugugugggagguggaagacuacggauuuggcgucuucacaaccaacauuuggcugaaacuucgcgagguuuauacacagagcugugaucaccggcucauguccgccgcuaucaaagacgaaagagccgugcacgccgauaugggcuacuggauugagucucagaagaaugggagcuggaaacuggagaaggcuuccuuuaucgaagugaagaccugcacguggccuaaaucucauacacuguggagcaacggaguccucgaguccgacaugauuauccccaagagccuggccggcccuaucucucagcacaaucaucgccccggguaccacacccaaaccgcgggaccuuggcaccuuggcaaacuggaacucgauuucaacuauugcgaggggacaaccgugguuauuacggagaauuguggaacacggggccccucccugagaaccacaaccgugagcggcaagcugauccaugaauggugcugucgcucuugcacacuuccgccucuccgguacaugggggaggacggauguugguauggcauggaaauuagacccaucaacgagaaagaagagaauauggucaagucccuggugagcgcugggucuggaaagauggauaacuuuaccaugggcauucugugccucgccauccuguucgaggaaguuaugcgggggaaauucggaaagaaacacaugauugccggcgugcuuuuuacguucguccugcuccugagcggccagaucaccuggcgcgacauggcucauacacugaucaugauuggguccaaugccagcgauagaaugggaaugggcgugaccuaccuugcgcugaucgcuacauuuaagauucagcccuuccucgcccugggguuuuuccuccggaaacugaccucuagagagaaccuucugcucggaguuggccuggccauggcuacgacacugcaacuuccugaagacaucgagcagauggccaaugggauugcucugggacucaugacccugaagcucaucacacaguuugaaaccuaucagcuguggaccgcccuugugucccugacauguagcaacacgaucuucacccucacagucgcguggcgcaccgccacacugauucuggcuggcgugucccuucugccgcucugccaaucuagcuccaugcggaagaccgauuggcugcccaugacgguggccgcuaugggcgucccuccccucccucuguuuaucuucucucuuaaagacacacccaagagacgcagcuggccucugaaugaggggguuauggccgugggacugguguccauucucgccucuagccugcuuagaaacgauguccccauggcuggcccgcugguggccgggggacuccugaucgccuguuacguuauuaccggcaccuccgcugaccucacaguggagaaagccgccgacgucaccugggaagaggaagcugagcagacaggggugagccacaaccugaugaucacgguugaugacgauggaaccaugcggaucaaggacgaugaaacagagaauauucuuaccgugcugcugaaaacagcccuccugaucgucucuggcauuuuuccuuauuccauccccgcgacccuucugguguggcauacguggcagaagcagacccaacgcagcggcguccucugggacgugccuucucccccggagacacagaaagcugaacuggaggaagggguuuacagaauuaagcagcagggaaucuucggcaagacccaagugggggucggagugcagaaagagggcguuuuucacacaauguggcacgugacccgcggggcgguccucacacauaacggaaagcggcuggagccuaauugggccuccgugaaaaaggaucuuauuagcuacggcggcggguggagacugucugcucaguggcaaaaaggagaagaggugcagguuaucgccgucgaacccggcaagaacccuaagaauuuccagacgaugcccgggaucuuccagaccacaaccggagagauuggcgcgaucgcucuggacuuuaaacccgggaccuccggaagcccuauuaucaaccgggaaggcaagguggugggccucuaugggaauggagucgugaccaagaacggcggguacguuuccggaauugcccaaacgaaugccgagccggauggccccaccccugagcuggaagaggaaauguucaagaaacgcaaccuuacaaucauggaccugcaccccgggagcggcaagaccagaaaguaucucccugcuaucgugcgggaggccauuaaacgcagacugcggacacucauccuggcucccaccagagucguggccgcggaaauggaggaggcccuuaagggacugccuauucgcuaccagacgacagcuaucaaaucugaacauaccggccgggagauuguugaucugaugugccacgccaccuuuacaaugagacuccugagcccggugcgcguccccaauuauaaccuuaucaucauggacgaagcucauuucaccgauccugccuccauugccgcucggggguacaucucuacaagagugggaaugggcgaggcggccgcuauuuuuaugaccgccacgcccccugggacagccgaggcuuucccccagagcaaugccccgauccaggacgaggagcgcgacauuccugaacgguccuggaacucuggaaaugaguggaucaccgauuuugcgggcaagacaguuugguucgugcccagcauuaaagcugggaacgacaucgccaacugucugagaaagaauggcaagaaagucauccaacucucccgcaagaccuuugauacggaauaucagaaaacccggcugaacgacugggauuucguggugacaaccgacauuucugagaugggagccaauuuuaaggcugauagagucaucgacccccggcgcugccugaaaccuguuauucucacagauggccccgagagagugauccuugccgggccuaugccggugaccgcggccagcgcugcccagcggcgcggaagagucggccggaacccccagaaggaaaaugaccaauacauuuucacagggcagccucugaacaaugaugaggaccacgcucacuggaccgaagccaagaugcugcucgacaacaucaauacgcccgagggaaucauuccugcucuguucgaacccgagagagagaaauccgccgcgaucgauggcgaauaccgccuuaagggggagagccggaaaacauuuguggaacugaugagacgcggcgaccucccgguuuggcuggcccauaagguggcuucugagggaauuaaauauaccgaucggaaguggugcuucgacggcgaaagaaacaaucagauccuggaggagaacauggaugucgaaauuuggaccaaagagggggaacgcaagaagcuccggccuagauggcuugacgcccgcacauacuccgauccccuggcucugaaagaguuuaaggacuucgccgccggaagaaaaagcaucgcucucgaucuggugaccgaaaucggccggguuccuucucaccuugcgcaucgcacaagaaaugcccuggacaaccucgugaugcugcacacguccgagcacgggggacgggcuuaucgccaugccgucgaggaacugcccgagaccauggaaacacuccuucugcugggccucaugauucugcuuaccggcggggccaugcuguuucucaucagcggaaagggcauugggaaaacauccaucggacugauuugugugaucgucucuagcggcaugcuguggauggcugaugugccucuccaguggauugccuccgcgaucguucuugaguucuuuaugauggugcugcugauccccgagccggaaaagcaaagaaccccucaggacaaucagcucgccuacguggucauugggauccugacgcuugcugccauuguuaccgcuaacgagaugggacugcucgaaacaaccaagcgggaucugggcaugagcaaagagcccggcguggugucucccacauccuaucuggacgucgaccuccacccugccagcgcguggacccuuuacgccguggcuacgacaguuaucaccccgaugcugagacauacaauugaaaauucuaccgccaacgugagccuggcugccaucgcuaaccaagccgucgugcucauggggcuggauaagggauggcccaucuccaaaauggaccuuggcgucccucugcucgcgcuggggugcuauucucaggugaauccccugacccucacagccgcuguucuucugcuggugacgcacuacgccauuaucggaccuggccuccaggcuaaggccacccgcgaggcccagaaacggacagcggcugggauuaugaagaaccccaccgucgauggaaucaugacaauugaccuggauccugugaucuacgacagcaaguucgagaaacaacuuggccagguuaugcugcucgugcugugugccguccagcugcuccuuaugagaaccuccugggcucugugcgaagcccugacgcucgccacaggcccgaucaccacccugugggaggggucucccggaaaguuuuggaauacaaccauugcugugagcauggccaacaucuuccgcggcuccuaucuugcgggggccggacuggcuuuuagcauuaugaaaucugugggcacagggaagcggggaacgggcucccagggcgaaacccucggggagaaauggaagaagaaacugaaucaacugagcagaaaggaguucgaucucuacaaaaaguccggaaucacagagguugaccggaccgaggccaaagaaggccuuaagcgcggggagacaacccaucacgcugucucuagaggaagcgccaaacugcagugguuuguggaacggaacauggugauuccugagggccgcgucaucgaucugggguguggaagaggcggcugguccuauuacugcgcggggcucaagaagguuacggaagugcggggauauaccaaaggcgggcccggacacgaggagccugugcccaugucuacauacggcuggaauauugucaagcugaugagcgggaaagacguguucuaucuuccgccugaaaagugugauacccugcucugcgacaucggagaguccagccccucucccacaguugaagagucccgcaccaucagagugcugaaaauggucgagccuuggcugaagaacaaucaguucuguauuaaggugcucaaccccuacaugccuacaguuaucgaacaucuugagcggcugcagcgcaaacacggcggcaugcuggugagaaauccgcucagccggaacucuacccaugaaauguacuggauuuccaaugggacgggaaacaucgucagcucugugaauauggugagcagacugcuucugaaccgcuuuacaaugacccaccggagacccaccauugagaaggaugucgaccucggcgccgggacacgccacguuaacgcugaaccugagacgcccaauauggacgugaucggagagcggaucaaaagaauuaaggaagaacacuccucuaccuggcacuaugaugacgaaaacccuuacaaaacaugggccuaucauggcagcuacgaggugaaggcuaccggguccgccagcuccaugaucaauggagucgugaagcugcugacaaaacccugggauguugugccgauggucacccaaauggcuaugacagacaccacgccuuucggccagcagcgcguguuuaaggaaaaaguugauacccggacacccagaccuaugcccggcacccgcaaggugauggagauuacagccgaguggcucuggcggacccuggggagaaacaaacgcccucggcuuugcacgagagaagaguucacaaagaagguccgcaccaaugcggccaugggagcuguguuuacagaagagaaccaaugggacucugccagagcugccguugaagaugaggaguucuggaaacugguggaccgggaacgcgagcuccacaagcugggcaaaugugggagcugcgucuauaauaugaugggaaagagagagaagaaacuuggcgaguuugggaaagccaagggcucccgggcgaucugguacauguggcugggagcuagauaucucgaguucgaagcccugggcuuucugaacgaggaucauugguucucucgggaaaauagcuacuccgggguggagggagaaggccuccacaagcugggguacauucuucgcgacaucucuaaaauccccggaggcgccauguaugcugaugacaccgccgggugggacacgagaauuaccgaggaugaccugcacaacgaggaaaagaucacacagcagauggauccggagcaucggcagcucgcuaaugccauuuuuaaacugaccuaccaaaacaaggucgugaaaguucagcgcccuacacccaagggcaccgugauggacaucauuagcagaaaggaucagcggggauccggccaggucgggacauauggacuuaauaccuucacgaacauggaagcgcaacuggugcgccagauggagggcgaaggggugcucagcaaaguugaccuggagaauccccaucugcucgagaagaaaaucacacaguggcuggaaaccaagggaguggagagacuucggcgcauggccaucucuggcgaugacugcgucgugaaaccuauugaugacagauuugcuaacgcccugcucgcucugaacgauauggggaagguucggaaggacaucccgcaguggcaacccuccaaaggcuggcaugauuggcaacaggugccuuucuguagccaccacuuccaugaacuuauuaugaaggacggacgcaaacuggucgugcccugcagaccucaggacgagcucaucggccgggcccgcauuucucaaggggcgggauggucccugaaggaaaccgccugucugggcaaggcuuacgcccagauguggagccucauguauuuucacagacgggaucugagacuugcuucuaaugccaucugcuccgcuguccccgugcauuggguuccuacaagccgcaccacaugguccauucacgcccaucaccaguggaugacgaccgaggacaugcugacaguguggaaccgggucuggaucgaggauaaucccuggauggaagacaagaccccggugacaaccugggaggauguuccuuaccucgggaagagagaagaccaaugguguggaagccugaucggccuuacgucucgcgcgaccugggcccagaacauucugacagcuauccaacaggugcggagccucauuggggaugaggaguuccuggacuauaugcccuccaugaaaagauuucgcaaggaagaggaaucugagggcgccaucugguga

SEQ ID NO: 20655 - RNA, 9873 nt, Artificial Sequence
  derived and/or modified CDS sequence (opt5) from DENV-3__FJ810414__SS-prME
accagccugugccucaugaugaugcugcccgccacacuugcuuuccaccugacguccagagacggcgagccucggaugaucguggccaagaacgaacgcgggaaaucucuccuguuuaagaccgcgagcggaauuaauauguguacacuuaucgcuauggaucugggcgagaugugcgacgauaccgucacauacaaauguccgcucauugccgaaguugagcccgaagacaucgauugcugguguaaccugaccuccacaugggugaccuaugggacgugcaaucaggccggagagcauagacgggacaagcgcucuguggcucuggccccucacgucggcauggggcucgauaccagaacacaaaccuggaugagcgcugagggagccuggcggcagguggaaaaaguugagacaugggcgcugcgccaucccggcuucaccauucuugcccuguuucucgcucacuacaucggcacgucccugacacagaagguggucaucuucauucuucugaugcucgugaccccuucuaugacaaugagauguguuggggugggaaaccgggacuuugucgaaggccugagcggggccaccuggguggaugugguccuggagcauggaggcugcguuaccacaauggcuaagaauaaacccacgcucgacaucgagcugcagaagaccgaagccacacaacuugcgacccugcgcaaacucuguauugaggggaagaucacaaacauuaccacggauuccagaugcccuacacagggagaagccauccugccggaggaacaggaccagaauuauguguguaaacacaccuacguggaucggggcuggggcaacgggugcggacuuuucggcaaggggagccuggucaccugcgcuaaguuucaaugucucgagcccauugagggaaaagugguucagcacgaaaaucugaaguauacagugaucaucaccguccauacaggcgaccagcaccagguggggaacgacacgcaaggaguuaccguggagauuacaccucaggccucuaccgucgaagcuauccugcccgaguacggcacacucggccuggaaugcuccccucgcaccgggcuugauuucaaugagaugauucugcucacgaugaaaaacaaggccuggauggugcauagacagugguuuuucgaccugccccuuccguggaccagcggagccacaaccgagacaccuaccuggaaucggaaagaacugcucgucacguuuaagaacgcucacgcgaaaaagcaagaggugguugugcugggcucucaggaaggggccaugcacacagcucugaccggagccacagagauccagaauuccggcgggaccagcauuuucgccggccaucucaagugucgccugaaaauggauaagcuugaacugaaaggaaugucuuaugcuaugugccucaacaccuuuguccugaagaaagagguguccgagacacagcacggcacgauccugaucaagguugaauacaagggggaggacgcccccuguaaaauuccuuucagcaccgaagauggacaaggcaaggcgcauaacgggagacuuaucacagcuaaucccguggucaccaaaaaggaggagcccgugaacauugaagccgagccuccguucggagaauccaauaucgugauuggcaucggggacaaagcccucaagaucaacugguacaagaaaggcucuagcauuggaaagauguuugaggcuacagcccggggcgcuagacgcauggccauccugggggauaccgcgugggacuucggauccguuggcgggguccugaauagccucggaaaaauggugcaccagauuuuuggcucugccuauacggcucuguucuccggggugagcuggaucaugaagauuggcaucggaguccuucugacauggauuggccucaacucuaaaaauaccagcauguccuuuucuugcaucgugaucgggauuaucacccuguaccugggagccguugugcaggcugauaugggcugugucauuaacuggaaggggaaggaacuuaaaugcggaagcggcaucuucgugacaaaugagguucauaccuggacagagcaguauaaguuucaagccgacucccccaaacggcucgcgacggccauugcuggggccugggaaaacggcguguguggaaucagaagcaccacacgcauggagaaucugcuguggaagcagaucgcuaacgaacucaauuacauucugugggagaacaauaucaaacuuaccgucgugguuggcgauauuaucggggugcuggaacagggaaagcggacacucaccccucagcccauggagcugaaauauucuuggaagacguggggcaaggccaaaauugucaccgccgagacacaaaacuccagcuucaucaucgacgggccuaacacccccgaaugcccgucugcuuccagagcguggaaugugugggagguggaagacuacggauuuggcgucuucacaaccaacauuuggcugaagcuucgcgagguuuauacacagagcugugaucaccggcucauguccgccgcuaucaaagacgaaagagccgugcacgccgauaugggcuacuggauugagucucagaagaaugggagcuggaaacuggagaaggcuuccuuuaucgaagugaagaccugcacguggccuaaaucucauacacuguggagcaacggaguccucgaguccgacaugauuauccccaagagccuggccggcccuaucucucagcacaaucaucgccccggguaccacacccaaaccgcgggaccuuggcaccuuggcaaacuggaacucgauuucaacuauugcgaggggacaaccgugguuauuacggagaauuguggaacacggggccccucccugagaaccacaaccgugagcggcaagcugauccaugaauggugcugucgcucuugcacacuuccgccucuccgguacaugggggaggacggauguugguauggcauggaaauuagacccaucaacgagaaagaagagaauauggcuaagucccuggucagcgccgggucuggaaagauggauaacuuuaccaugggcauucugugccucgccauccuguucgaggaagugaugcgggggaaauucggaaagaaacacaugauugcuggcguucuuuuuacguucgugcugcuccugagcggccagaucaccuggcgcgacauggcccauacacugaucaugauuggguccaaugcgagcgauagaaugggaaugggcgucaccuaccuugcucugaucgccacauuuaagauucagcccuuccucgcccugggguuuuuccuccggaaacugaccucuagagagaaccuucugcucggagugggccuggcuauggccacgacacugcaacuuccugaagacaucgagcagauggcuaaugggauugcccugggacucaugacccugaagcucaucacacaguuugaaaccuaucagcuguggaccgcgcuuguuucccugacauguagcaacacgaucuucacccucacaguggccuggcgcaccgcuacacugauucuggccggcgucucccuucugccgcucugccaaucuagcuccaugcggaagaccgauuggcugcccaugacgguggcugccaugggcgugccuccccucccucuguuuaucuucucucuuaaagacacacccaagagacgcagcuggccucugaaugagggggucauggccguuggacugguguccauucucgcuucuagccugcuuagaaacgaugugcccauggcgggcccgcuggucgccgggggacuccugaucgcuuguuacgugauuaccggcaccuccgccgaccucacaguugagaaagccgcugacgugaccugggaagaggaagccgagcagacaggggucagccacaaccugaugaucacgguggaugacgauggaaccaugcggaucaaggacgaugaaacagagaauauucuuaccguucugcugaaaacagcgcuccugaucgugucuggcauuuuuccuuauuccauccccgcuacccuucuggucuggcauacguggcagaagcagacccaacgcagcggcgugcucugggacgucccuucucccccggagacacagaaagccgaacuggaggaagggguguacagaauuaagcagcagggaaucuucggcaagacccaaguuggggugggaguccagaaagagggcguguuucacacaauguggcacguuacccggggggccgugcucacacauaacggaaagcgccuggagccuaauugggcuuccgucaaaaaggaucuuauuagcuacggcggcggguggagacugucugcccaguggcaaaaaggagaagaggugcaggugaucgcgguugaacccggcaagaacccuaagaauuuccagacgaugcccgggaucuuccagaccacaaccggagagauuggcgcuaucgcccuggacuuuaaacccgggaccuccggaagcccuauuaucaaccgggaaggcaaggucgugggccucuaugggaauggaguggucacaaaaaacggcggguacguguccggaauugcccaaacgaaugcugagccggauggccccaccccugagcuggaagaggaaauguucaagaaacgcaaccuuacaaucauggaccugcaccccgggagcggcaagaccagaaaguaucucccugccaucguucgggaggcuauuaaacgcagacugcggacacucauccuggcccccaccagaguggucgcggccgaaauggaggaggcucuuaagggacugccuauucgcuaccagacgacagccaucaaaucugaacauaccggccgggagauuguggaucugaugugccacgcuaccuuuacaaugagacuccugagcccgguucgcgugcccaauuauaaccuuaucaucauggacgaagcccauuucaccgauccugccuccauugcugcgcggggguacaucucuacaagagucggaaugggcgaggccgcugccauuuuuaugaccgccacgcccccugggacagcugaagccuucccccagagcaaugcgccgauccaggacgaggagcgcgacauuccugaacgguccuggaacucuggaaaugaguggaucaccgauuuugugggcaagacaguuugguucgugcccagcauuaaagcugggaacgacaucgccaacugucugagaaagaauggcaagaaagucauccaacucucccgcaagaccuuugauacggaauaucagaaaacccggcugaacgacugggauuucguggugacaaccgacauuucugagaugggagccaauuuuaaggcugauagagucaucgacccccggcgcugccugaaaccuguuauucucacagauggccccgagagagugauccuugccgggccuaugccggugaccgcggccagcgcugcccagcggcgcggaagagucggccggaacccccagaaggaaaaugaccaauacauuuucacagggcagccucugaacaaugaugaggaccacgcucacuggaccgaagccaagaugcugcucgacaacaucaauacgcccgagggaaucauuccugcucuguucgaacccgagagagagaaauccgccgcgaucgauggcgaauaccgccuuaagggggagagccggaaaacauuuguggaacugaugagacgcggcgaccucccgguuuggcuggcccauaagguggcuucugagggaauuaaauauaccgaucggaaguggugcuucgacggcgaaagaaacaaucagauccuggaggagaacauggaugucgaaauuuggaccaaagagggggaacgcaagaagcuccggccuagauggcuugacgcccgcacauacuccgauccccuggcucugaaagaguuuaaggacuucgccgccggaagaaaaagcaucgcucucgaucuggugaccgaaaucggccggguuccuucucaccuugcgcaucgcacaagaaaugcccuggacaaccucgugaugcugcacacguccgagcacgggggacgggcuuaucgccaugccgucgaggaacugcccgagaccauggaaacacuccuucugcugggccucaugauucugcuuaccggcggggccaugcuguuucucaucagcggaaagggcauugggaaaacauccaucggacugauuugugugaucgucucuagcggcaugcuguggauggcugaugugccucuccaguggauugccuccgcgaucguucuugaguucuuuaugauggugcugcugauccccgagccggaaaagcaaagaaccccucaggacaaucagcucgccuacguggucauugggauccugacgcuugcugccauuguuaccgcuaacgagaugggacugcucgaaacaaccaagcgggaucugggcaugagcaaagagcccggcguggugucucccacauccuaucuggacgucgaccuccacccugccagcgcguggacccuuuacgccguggcuacgacaguuaucaccccgaugcugagacauacaauugaaaauucuaccgccaacgugagccuggcugccaucgcuaaccaagccgucgugcucauggggcuggauaagggauggcccaucuccaaaauggaccuuggcgucccucugcucgcgcuggggugcuauucucaggugaauccccugacccucacagccgcuguucuucugcuggugacgcacuacgccauuaucggaccuggccuccaggcuaaggccacccgcgaggcccagaaacggacagcggcugggauuaugaagaaccccaccgucgauggaaucaugacaauugaccuggauccugugaucuacgacagcaaguucgagaaacaacuuggccagguuaugcugcucgugcugugugccguccagcugcuccuuaugagaaccuccugggcucugugcgaagcccugacgcucgccacaggcccgaucaccacccugugggaggggucucccggaaaguuuuggaauacaaccauugcugugagcauggccaacaucuuccgcggcuccuaucuugcgggggccggacuggcuuuuagcauuaugaaaucugugggcacagggaagcggggaacgggcucccagggcgaaacccucggggagaaauggaagaagaaacugaaucaacugagcagaaaggaauucgaucucuacaaaaaguccggaaucacagagguugaccggaccgaggccaaagaaggccuuaagcgcggggagacaacccaucacgcugucucuagaggaagcgccaaacugcagugguuuguggaacggaacauggugauuccugagggccgcgucaucgaucugggguguggaagaggcggcugguccuauuacugcgcggggcucaagaagguuacggaagugcggggauauaccaaaggcgggcccggacacgaggagccugugcccaugucuacauacggcuggaauauugucaagcugaugagcgggaaagacguguucuaucuuccgccugaaaagugugauacccugcucugcgacaucggagaguccagccccucucccacaguugaagagucccgcaccaucagagugcugaaaauggucgagccuuggcugaagaacaaucaguucuguauuaaggugcucaaccccuacaugccuacaguuaucgaacaucuugagcggcugcagcgcaaacacggcggcaugcuggugagaaauccgcucagccggaacucuacccaugaaauguacuggauuuccaaugggacgggaaacaucgucagcucugugaauauggugagcagacugcuucugaaccgcuuuacaaugacccaccggagacccaccauugagaaggaugucgaccucggcgccgggacacgccacguuaacgcugaaccugagacgcccaauauggacgugaucggagagcggaucaaaagaauuaaggaagagcauuccucuaccuggcacuaugaugacgaaaacccuuacaaaacaugggccuaucauggcagcuacgaggugaaggcuaccggguccgccagcuccaugaucaauggagucgugaagcugcugacaaaacccugggauguugugccgauggucacccaaauggcuaugacagacaccacgccuuucggccagcagcgcguguuuaaggaaaaaguugauacccggacacccagaccuaugcccggcacccgcaaggugauggagauuacagccgaguggcucuggcggacccuggggagaaacaaacgcccucggcuuugcacgagagaagaguucacaaagaagguccgcaccaaugcggccaugggagcuguguuuacagaagagaaccaaugggacucugccagagcugccguugaagaugaggaguucuggaaacugguggaccgggaacgcgagcuccacaagcugggcaaaugugggagcugcgucuauaauaugaugggaaagagagaaaaaaagcuuggcgaguuugggaaagccaagggcucccgggcgaucugguacauguggcugggagcuagauaucucgaguucgaagcccugggcuuucugaacgaggaucauugguucucucgggaaaauagcuacuccgggguggagggagaaggccuccacaagcugggguacauucuucgcgacaucucuaaaauccccggaggcgccauguaugcugaugacaccgccgggugggacacgagaauuaccgaggaugaccugcacaacgaggaaaagaucacacagcagauggauccggagcaucggcagcucgcuaaugccauuuuuaaacugaccuaccaaaacaaggucgugaaaguucagcgcccuacacccaagggcaccgugauggacaucauuagcagaaaggaucagcggggauccggccaggucgggacauauggacuuaauaccuucacgaacauggaagcgcaacuggugcgccagauggagggcgaaggggugcucagcaaaguugaccuggagaauccccaccugcucgagaagaaaaucacacaguggcuggaaaccaagggaguggagagacuucggcgcauggccaucucuggcgaugacugcgucgugaaaccuauugaugacagauuugcuaacgcccugcucgcucugaacgauauggggaagguucggaaggacaucccgcaguggcaacccuccaaaggcuggcaugauuggcagcaggugccuuucuguagccaccacuuccaugaacuuauuaugaaggacggacgcaaacuggucgugcccugcagaccucaggacgagcucaucggccgggcccgcauuucucaaggggcgggauggucccugaaggaaaccgccugucugggcaaagcuuacgcccagauguggagccucauguauuuucacagacgggaucugagacuugcuucuaaugccaucugcuccgcuguccccgugcauuggguuccuacaagccgcaccacaugguccauucacgcccaucaccaguggaugacgaccgaggacaugcugacaguguggaaccgggucuggaucgaggauaaucccuggauggaagacaagaccccggugacaaccugggaggauguuccuuaccucgggaagagagaagaccaaugguguggaagccugaucggccuuacgucucgcgcgaccugggcccagaacauucugacagcuauccagcaggugcggagccucauuggggaugaggaguuccuggacuauaugcccuccaugaaaagauuucgcaaggaagaggaaucugagggcgccaucugguga

SEQ ID NO: 20656 - RNA, 9873 nt, Artificial Sequence
  derived and/or modified CDS sequence (opt5) from DENV-3__FJ744734__SS-prME
accagccugugccucaugaugaugcugcccgccacacuugcuuuccaccugacguccagagacggcgaaccucggaugaucguggccaagaacgaacgcgggaagucucuccuguuuaagaccgcgagcggaauuaauauguguacccuuaucgcuauggaucugggcgaaaugugcgacgauaccgucacauacaaguguccgcucauugccgaaguugagcccgaagacaucgauugcugguguaaccugaccuccacaugggugaccuaugggacgugcaaucaggccggagagcauagacgggacaagcgcucuguggcucuggccccucacgucggcauggggcucgauaccagaacacagaccuggaugagcgcugagggagccuggcggcaggucgaaaaaguugagacaugggcgcugcgccaucccggcuucaccauucuugcccuguuucucgcucacuacaucggcacgucccugacacagaagguggucaucuucauucuucugaugcucgugaccccuucuaugacaaugagauguguuggggugggaaaccgggacuuugucgaaggccugagcggggccaccuggguggaugugguccuggagcauggaggcugcguuaccacaauggcuaagaauaaacccacgcucgacaucgagcugcagaagaccgaagccacacaacuugcgacccugcgcaaacucuguauugaggggaagaucacaaacauuaccacggauuccagaugcccuacacagggagaagccauccugccggaggaacaggaccagaauuauguguguaaacacaccuacguggaucggggcuggggcaacgggugcggacuuuucggcaaggggagccuggugaccugcgcuaaguuucaaugucucgagcccauugagggaaaagugguucagcacgaaaaucugaaguauacagugaucaucaccguccauacaggcgaccagcaccagguggggaacgacacgcaaggaguuaccguggagauuacaccucaggccucuaccgucgaagcuauccugcccgaguacggcacacucggccuggaaugcuccccucgcaccgggcuugauuucaaugagaugauucugcucacgaugaaaaacaaggccuggauggugcauagacagugguuuuucgaccugccccuuccguggaccagcggagccacaaccgagacaccuaccuggaaucggaaagaacugcucgucacguuuaagaacgcucacgcgaaaaagcaagaggugguugugcugggcucucaggaaggggccaugcacacagcucugaccggagccacagagauccaaaauuccggcgggaccagcauuuucgccggccaucucaagugucgccugaaaauggauaaacuugaacugaaaggaaugucuuaugcuaugugccucaacaccuuuguccugaagaaagagguguccgagacacagcacggcacgauccugaucaagguugaauacaagggggaggacgcccccuguaaaauuccuuucagcaccgaagauggacaaggcaaggcgcauaacgggagacuuaucacagcuaaucccguggucaccaaaaaggaggagcccgugaacauugaagccgagccuccguucggagaauccaauaucgugauuggcaucggggacaaagcccucaagaucaacugguacaagaaaggcucuagcauuggaaagauguuugaggcuacagcccggggcgcuagacgcauggccauccugggggauaccgcgugggacuucggauccguuggcgggguccugaauagccucggaaaaauggugcaccagauuuuuggcucugccuauacggcucuguucuccggggugagcuggaucaugaagauuggcaucggaguccuucugacauggauuggccucaacucuaaaaauaccagcauguccuuuucuugcaucgugaucgggauuaucacccuguaccugggagccguugugcaggcugauaugggcugugucauuaacuggaaggggaaggaacuuaaaugcggaagcggcaucuucgugacaaaugagguucauaccuggacagagcaguauaaguuucaagccgacucccccaaacggcucgcgacggccauugcuggggccugggaaaacggcguguguggaaucagaagcaccacacgcauggagaaucugcuguggaagcagaucgcuaacgaacucaauuacauucugugggagaacaauaucaaacuuaccgucgugguuggcgauauuaucggggugcuggaacagggaaagcggacacucaccccucagcccauggagcugaaauauucuuggaagacguggggcaaggccaaaauugucaccgccgagacacaaaacuccagcuucaucaucgacgggccuaacacccccgaaugcccgucugcuuccagagcguggaaugugugggagguggaagacuacggauuuggcgucuucacaaccaacauuuggcugaaacuucgcgagguuuauacacagagcugugaucaccggcucauguccgccgcuaucaaagacgaaagagccgugcacgccgauaugggcuacuggauugagucucagaagaaugggagcuggaaacuggagaaggcuuccuuuaucgaagugaagaccugcacguggccuaaaucucauacacuguggagcaacggaguccucgaguccgacaugauuauccccaagagccuggccggcccuaucucucagcacaaucaucgccccggguaccacacccaaaccgcgggaccuuggcaccuuggcaaacuggaacucgauuucaacuauugcgaggggacaaccgugguuauuacggagaauuguggaacacggggccccucccugagaaccacaaccgugagcggcaagcugauccaugaauggugcugucgcucuugcacacuuccgccucuccgguacaugggggaggacggauguugguauggcauggaaauuagacccaucaacgagaaagaagagaauauggucaagucccuggugagcgcugggucuggaaagauggauaacuuuaccaugggcauucugugccucgccauccuguucgaggaaguuaugcgggggaaauucggaaagaaacacaugauugccggcgugcuuuuuacguucguccugcuccugagcggccagaucaccuggcgcgacauggcucauacacugaucaugauuggguccaaugccagcgauagaaugggaaugggcgugaccuaccuugcgcugaucgcuacauuuaagauucagcccuuccucgcccugggguuuuuccuccggaaacugaccucuagagagaaccuucugcucggaguuggccuggccauggcuacgacacugcaacuuccugaagacaucgagcagauggccaaugggauugcucugggacucaugacccugaagcucaucacacaguuugaaaccuaucagcuguggaccgcccuugugucccugacauguagcaacacgaucuucacccucacagucgcguggcgcaccgccacacugauucuggcuggcgugucccuucugccgcucugccaaucuagcuccaugcggaagaccgauuggcugcccaugacgguggccgcuaugggcgucccuccccucccucuguuuaucuucucucuuaaagacacacccaagagacgcagcuggccucugaaugaggggguuauggccgugggacugguguccauucucgccucuagccugcuuagaaacgauguccccauggcuggcccgcugguggccgggggacuccugaucgccuguuacguuauuaccggcaccuccgcugaccucacaguggagaaagccgccgacgucaccugggaagaggaagcugagcagacaggggugagccacaaccugaugaucacgguugaugacgauggaaccaugcggaucaaggacgaugaaacagagaauauucuuaccgugcugcugaaaacagcccuccugaucgucucuggcauuuuuccuuauuccauccccgcgacccuucugguguggcauacguggcagaagcagacccaacgcagcggcguccucugggacgugccuucucccccggagacacagaaagcugaacuggaggaagggguuuacagaauuaagcagcagggaaucuucggcaagacccaagugggggucggagugcagaaagagggcguuuuucacacaauguggcacgugacccgcggggcgguccucacacauaacggaaagcggcuggagccuaauugggccuccgugaaaaaggaucuuauuagcuacggcggcggguggagacugucugcucaguggcaaaaaggagaagaggugcagguuaucgccgucgaacccggcaagaacccuaagaauuuccagacgaugcccgggaucuuccagaccacaaugggagagauuggcgcgaucgcucuggacuuuaaacccgggaccuccggaagcccuauuaucaaccgggaaggcaagguggugggccucuaugggaauggagucgugaccaaaaacggcggguacguuuccggaauugcccaaacaaaugccgagccggauggccccacgccugagcuggaagaggaaauguucaagaaacgcaaccuuaccaucauggaccugcaccccgggagcggcaagacaagaaaguaucucccugcuaucgugcgggaggccauuaaacgcagacugcggacccucauccuggcucccacaagagucguggccgcggaaauggaggaggcccuuaagggacugccuauucgcuaccagaccacggcuaucaaaucugaacauacaggccgggagauuguugaucugaugugccacgccaccuuuaccaugagacuccugagcccggugcgcguccccaauuauaaccuuaucaucauggacgaagcucauuucacagauccugccuccauugccgcucggggguacaucucuaccagagugggaaugggcgaggcggccgcuauuuuuaugacagccacacccccugggacggccgaggcuuucccccagagcaaugccccgauccaggacgaggagcgcgacauuccugaacgguccuggaacucuggaaaugaguggaucacagauuuuguuggcaagaccgugugguucguccccagcauuaaagcggggaacgacaucgcuaacugucugagaaagaauggcaagaaagugauccaacucucccgcaagacauuugauaccgaauaucagaaaacgcggcugaacgacugggauuucguggucaccacagacauuucugagaugggagccaauuuuaaggccgauagaguuaucgacccccggcgcugccugaaaccugugauucucaccgauggccccgagagagugauccuugcugggccuaugccggucacagccgcgagcgccgcucagcggcgcggaagagugggccggaacccccagaaggaaaaugaccaauacauuuucaccgggcagccucugaacaaugaugaggaccacgcccacuggacagaagcuaagaugcugcucgacaacaucaauacccccgagggaaucauuccugcccuguucgaacccgagagagagaaauccgcugccaucgauggcgaauaccgccuuaagggggagagccggaaaacguuuguugaacugaugagacgcggcgaccucccgguguggcuggcgcauaaggucgccucugagggaauuaaauauacagaucggaaguggugcuucgacggcgaaagaaacaaucagauccuggaggagaacauggauguggaaauuuggaccaaagagggggaacgcaagaagcuccggccuagauggcuugacgcucgcaccuacuccgauccccuggcccugaaagaguuuaaggacuucgcugccggaagaaaaagcaucgcccucgaucugguuacagaaaucggccgggugccuucucaccuugcucaucgcaccagaaaugcgcuggacaaccucgucaugcugcacacauccgagcacgggggacgggccuaucgccaugcuguggaggaacugcccgagacgauggaaacccuccuucugcugggccucaugauucugcuuacaggcggggccaugcuguuucucaucagcggaaagggcauugggaaaaccuccaucggacugauuugugucaucgugucuagcggcaugcuguggauggccgauguuccucuccaguggauugcuuccgccaucgugcuugaguucuuuaugauggugcugcugauccccgagccggaaaagcaaagaacaccucaggacaaucagcucgcguacgucguuauugggauccugacccuugccgcuauugugacggccaacgagaugggacugcucgaaaccacaaagcgggaucugggcaugagcaaagagcccggcguggucucucccaccuccuaucuggacguggaccuccacccugcuagcgccuggacacuuuacgcgguugccaccacggugaucacaccgaugcugagacauaccauugaaaauucuacagcuaacgucagccuggccgcuaucgccaaccaagcugugguccucauggggcuggauaagggauggcccaucuccaaaauggaccuuggcgugccucugcucgcccuggggugcuauucucagguuaauccccugacccucaccgcggccgugcuucugcuggucacacacuacgcuauuaucggaccuggccuccaggccaaggcuacgcgcgaggcccagaaacggaccgccgcggggauuaugaagaaccccacaguggauggaaucaugaccauugaccuggauccuguuaucuacgacagcaaguucgagaaacaacuuggccaggugaugcugcucguccugugugcugugcagcugcuccuuaugagaacauccugggcccugugcgaagcucugacccucgccacgggcccgaucacaacccugugggaggggucucccggaaaguuuuggaauaccacaauugccgugagcauggcuaacaucuuccgcggcuccuaucuugccggggcgggacuggccuuuagcauuaugaaaucuguuggcaccgggaagcggggaacaggcucccagggcgaaacgcucggggagaaauggaagaagaaacugaaucaacugagcagaaaggaguucgaucucuacaaaaaguccggaaucaccgaggucgaccggacagaggcuaaagaaggccuuaagcgcggggagaccacacaucacgccgugucuagaggaagcgcuaaacugcagugguuuguggaacggaacauggucauuccugagggccgcguuaucgaucugggguguggaagaggcggcugguccuauuacugcgccgggcucaagaaggugaccgaagugcggggauauacgaaaggcgggcccggacacgaggagccuguccccaugucuaccuacggcuggaauauugugaagcugaugagcgggaaagacguuuucuaucuuccgccugaaaagugugauacacugcucugcgacaucggagaguccagccccucucccaccguggaagagucccgcacaaucagaguccugaaaaugguggagccuuggcugaagaacaaucaguucuguauuaagguucucaaccccuacaugccuaccgugaucgaacaucuugagcggcugcagcgcaaacacggcggcaugcuggucagaaauccgcucagccggaacucuacacaugaaauguacuggauuuccaaugggaccggaaacaucgugagcucugugaauauggucagcagacugcuucugaaccgcuuuacgaugacacaccggagacccaccauugagaaggauguugaccucggcgcggggacccgccacgugaacgccgaaccugagacacccaauauggacgugaucggagagcggaucaaaagaauuaaggaagaacacuccucuacguggcacuaugaugacgaaaacccuuacaaaaccugggcuuaucauggcagcuacgaggucaaggccacaggguccgcuagcuccaugaucaauggagugguuaagcugcugaccaaacccugggauguggucccgauggugacacaaauggccaugaccgacacaaccccuuucggccagcagcgcguuuuuaaggaaaaaguggauacgcggacccccagaccuaugcccggcacacgcaaggucauggagauuaccgcugaguggcucuggcggacacuggggagaaacaaacgcccucggcuuugcaccagagaagaguucacgaagaaggugcgcacaaaugccgcgaugggagccguuuuuaccgaagagaaccaaugggacucugcuagagccgcuguggaagaugaggaguucuggaaacuggucgaccgggaacgcgagcuccacaagcugggcaaaugugggagcugcguguauaauaugaugggaaagagagagaagaaacuuggcgaguuugggaaagccaagggcucccgggccaucugguacauguggcugggagcgagauaucucgaguucgaagcucugggcuuucugaacgaggaucauugguucucucgggaaaauagcuacuccggggucgagggagaaggccuccacaagcugggguacauucuucgcgacaucucuaaaauccccggaggcgccauguaugccgaugacacagcugggugggacaccagaauuacggaggaugaccugcacaacgaggaaaagaucacccagcagauggauccggagcaucggcagcucgccaaugcuauuuuuaaacugacauaccaaaacaaggugguuaaagugcagcgcccuacccccaagggcacagucauggacaucauuagcagaaaggaucagcggggauccggccagguggggaccuauggacuuaauacauucaccaacauggaagcccaacuggugcgccagauggagggcgaagggguucucagcaaaguggaccuggagaauccccaucugcucgagaagaaaaucacgcaguggcuggaaacaaagggagucgagagacuucggcgcauggcgaucucuggcgaugacugcgugguuaaaccuauugaugacagauuugccaacgcucugcucgcccugaacgauauggggaaggugcggaaggacaucccgcaguggcaacccuccaaaggcuggcaugauuggcagcaggucccuuucuguagccaccacuuccaugaacuuauuaugaaggacggacgcaaacuggugguccccugcagaccucaggacgagcucaucggccgggcucgcauuucucaaggggccggauggucccugaaggaaaccgcgugucugggcaaagccuacgcucagauguggagccucauguauuuucacagacgggaucugagacuugccucuaaugcuaucugcuccgccgugcccguucauugggugccuaccagccgcacaaccugguccauucacgcucaucaccaguggaugacaacggaggacaugcugaccgucuggaaccggguguggaucgaggauaaucccuggauggaagacaagacaccgguuaccacaugggaggaugugccuuaccucgggaagagagaagaccaaugguguggaagccugaucggccuuaccucucgcgccacgugggcgcagaacauucugaccgccauccagcagguccggagccucauuggggaugaggaguuccuggacuauaugcccuccaugaaaagauuucgcaaggaagaggaaucugagggcgcuaucugguga

SEQ ID NO: 20657 - RNA, 9873 nt, Artificial Sequence
  derived and/or modified CDS sequence (opt5) from DENV-3__FJ744737__SS-prME
accagccugugccucaugaugaugcugcccgccacacuugcuuuccaccugacguccagagacggcgagccucggaugaucguggccaagaacgaacgcgggaaaucucuccuguuuaagaccgcgagcggaauuaauauguguacacuuaucgcuauggaucugggcgagaugugcgacgauaccgucacauacaaauguccgcucauugccgaaguugagcccgaagacaucgauugcugguguaaccugaccuccacaugggugaccuaugggacgugcaaucaggccggagagcauagacgggacaagcgcucuguggcucuggccccucacgucggcauggggcucgauaccagaacacaaaccuggaugagcgcugagggagccuggcggcagguggaaaaaguugagacaugggcgcugcgccaucccggcuucaccauucuugcccuguuucucgcucacuacaucggcacgucccugacacagaagguggucaucuucauucuucugaugcucgugaccccuucuaugacaaugagauguguuggggugggaaaccgggacuuugucgaaggccugagcggggccaccuggguggaugugguccuggagcauggaggcugcguuaccacaauggcuaagaauaaacccacgcucgacaucgagcugcagaagaccgaagccacacaacuugcgacccugcgcaaacucuguauugaggggaagaucacaaacauuaccacggauuccagaugcccuacacagggagaagccauccugccggaggaacaggaccagaauuauguguguaaacacaccuacguggaucggggcuggggcaacgggugcggacuuuucggcaaggggagccuggucaccugcgcuaaguuucaaugucucgagcccauugagggaaaagugguucagcacgaaaaucugaaguauacagugaucaucaccguccauacaggcgaccagcaccagguggggaacgacacgcaaggaguuaccgccgagauuacaccucaggcuucuaccguggaagccauccugcccgaguacggcacacucggccuggaaugcuccccucgcaccgggcuugauuucaaugagaugauucugcucacgaugaaaaacaaggccuggaugguccauagacagugguuuuucgaccugccccuuccguggaccagcggagcuacaaccgagacaccuaccuggaaucggaaagaacugcucgugacguuuaagaacgcgcacgccaaaaagcaagaggucgugguucugggcucucaggaaggggcuaugcacacagcccugaccggagccacagagauccagaauuccggcgggaccagcauuuucgcuggccaucucaagugucgccugaaaauggauaagcuugaacugaaaggaaugucuuaugccaugugccucaacaccuuugugcugaagaaagaggucuccgagacacagcacggcacgauccugaucaagguggaauacaagggggaggacgcgcccuguaaaauuccuuucagcaccgaagauggacaaggcaaggcucauaacgggagacuuaucacagccaaucccguugugaccaaaaaggaggagcccgucaacauugaagccgagccuccguucggagaauccaauaucgugauuggcaucggggacaaagcucucaagaucaacugguacaagaaaggcucuagcauuggaaagauguuugaggccacagcucggggcgccagacgcauggcgauccugggggauaccgccugggacuucggauccgugggcgggguucugaauagccucggaaaaaugguccaccagauuuuuggcucugcuuauacggcccuguucuccggggugagcuggaucaugaagauuggcaucggagugcuucugacauggauuggccucaacucuaaaaauaccagcauguccuuuucuugcaucgucaucgggauuaucacccuguaccugggagcugugguucaggccgauaugggcugugugauuaacuggaaggggaaggaacuuaaaugcggaagcggcaucuucgucacaaaugaggugcauaccuggacagagcaguauaaguuucaagcggacucccccaaacggcucgccacggcuauugccggggcuugggaaaacggcguuuguggaaucagaagcaccacacgcauggagaaucugcuguggaagcagaucgccaacgaacucaauuacauucugugggagaacaauaucaaacuuaccguggucgugggcgauauuaucgggguucuggaacagggaaagcggacacucaccccucagcccauggagcugaaauauucuuggaagacguggggcaaggccaaaauugugaccgcugagacacaaaacuccagcuucaucaucgacgggccuaacacccccgaaugcccgucugcguccagagccuggaaugucugggagguggaagacuacggauuuggcguguucacaaccaacauuuggcugaagcuucgcgaggucuauacacagagcugugaucaccggcucauguccgcugccaucaaagacgaaagagccguucacgcugauaugggcuacuggauugagucucagaagaaugggagcuggaaacuggagaaggccuccuuuaucgaagugaagaccugcacguggccuaaaucucauacacuguggagcaacggagugcucgaguccgacaugauuauccccaagagccuggcgggcccuaucucucagcacaaucaucgccccggguaccacacccaaaccgcuggaccuuggcaccuuggcaaacuggaacucgauuucaacuauugcgaggggacaaccgucgugauuacggagaauuguggaacacggggccccucccugagaaccacaaccguuagcggcaagcugauccaugaauggugcugucgcucuugcacacuuccgccucuccgguacaugggggaggacggauguugguauggcauggaaauuagacccaucaacgagaaagaagagaauauggugaagucccuggucagcgccgggucuggaaagauggauaacuuuaccaugggcauucugugccucgccauccuguucgaggaagugaugcgggggaaauucggaaagaaacacaugauugcuggcguucuuuuuacguucgugcugcuccugagcggccagaucaccuggcgcgacauggcccauacacugaucaugauuggguccaaugcgagcgauagaaugggaaugggcgucaccuaccuugcucugaucgccacauuuaagauucagcccuuccucgcccugggguuuuuccuccggaaacugaccucuagagagaaccuucugcucggagugggccuggcuauggccacgacacugcaacuuccugaagacaucgagcagauggcuaaugggauugcccugggacucaugacccugaagcucaucacacaguuugaaaccuaucagcuguggaccgcgcuuguuucccugacauguagcaacacgaucuucacccucacaguggccuggcgcaccgcuacacugauucuggccggcgucucccuucugccgcucugccaaucuagcuccaugcggaagaccgauuggcugcccaugacgguggcugccaugggcgugccuccccucccucuguuuaucuucucucuuaaagacacacccaagagacgcagcuggccucugaaugagggggucauggccguuggacugguguccauucucgcuucuagccugcuuagaaacgaugugcccauggcgggcccgcuggucgccgggggacuccugaucgcuuguuacgugauuaccggcaccuccgccgaccucacaguugagaaagccgcugacgugaccugggaagaggaagccgagcagacaggggucagccacaaccugaugaucacgguggaugacgauggaaccaugcggaucaaggacgaugaaacagagaauauucuuaccguucugcugaaaacagcgcuccugaucgugucuggcauuuuuccuuauuccauccccgcuacccuucuggucuggcauacguggcagaagcagacccaacgcagcggcgugcucugggacgucccuucucccccggagacacagaaagccgaacuggaggaagggguguacagaauuaagcagcagggaaucuucggcaagacccaaguuggggugggaguccagaaagagggcguguuucacacaauguggcacguuacccggggggccgugcucacacauaacggaaagcgccuggagccuaauugggcuuccgucaaaaaggaucuuauuagcuacggcggcggguggagacugucugcccaguggcaaaaaggagaagaggugcaggugaucgcgguugaacccggcaagaacccuaagaauuuccagacgaugcccgggaucuuccagaccacaaccggagagauuggcgcuaucgcccuggacuuuaaacccgggaccuccggaagcccuauuaucaaccgggaaggcaaggucgugggccucuaugggaauggaguggucacaaaaaacggcggguacguguccggaauugcccaaacgaaugcugagccggauggccccaccccugagcuggaagaggaaauguucaagaaacgcaaccuuacaaucauggaccugcaccccgggagcggcaagaccagaaaguaucucccugccaucguucgggaggcuauuaaacgcagacugcggacacucauccuggcccccaccagaguggucgcggccgaaauggaggaggcucuuaagggacugccuauucgcuaccagacgacagccaucaaaucugaacauaccggccgggagauuguggaucugaugugccacgcuaccuuuacaaugagacuccugagcccgguucgcgugcccaauuauaaccuuaucaucauggacgaagcccauuucaccgauccugccuccauugcugcgcggggguacaucucuacaagagucggaaugggcgaggccgcugccauuuuuaugaccgccacgcccccugggacagcugaagccuucccccagagcaaugcgccgauccaggacgaggagcgcgacauuccugaacgguccuggaacucuggaaaugaguggaucaccgauuuugugggcaagacaguuugguucgugcccagcauuaaagcugggaacgacaucgccaacugucugagaaagaauggcaagaaagucauccaacucucccgcaagaccuuugauacggaauaucagaaaacccggcugaacgacugggauuucguggugacaaccgacauuucugagaugggagccaauuuuaaggcugauagagucaucgacccccggcgcugccugaaaccuguuauucucacagauggccccgagagagugauccuugccgggccuaugccggugaccgcggccagcgcugcccagcggcgcggaagagucggccggaacccccagaaggaaaaugaccaauacauuuucacagggcagccucugaacaaugaugaggaccacgcucacuggaccgaagccaagaugcugcucgacaacaucaauacgcccgagggaaucauuccugcucuguucgaacccgagagagagaaauccgccgcgaucgauggcgaauaccgccuuaagggggagagccggaaaacauuuguggaacugaugagacgcggcgaccucccgguuuggcuggcccauaagguggcuucugagggaauuaaauauaccgaucggaaguggugcuucgacggcgaaagaaacaaucagauccuggaggagaacauggaugucgaaauuuggaccaaagagggggaacgcaagaagcuccggccuagauggcuugacgcccgcacauacuccgauccccuggcucugaaagaguuuaaggacuucgccgccggaagaaaaagcaucgcucucgaucuggugaccgaaaucggccggguuccuucucaccuugcgcaucgcacaagaaaugcccuggacaaccucgugaugcugcacacguccgagcacgggggacgggcuuaucgccaugccgucgaggaacugcccgagaccauggaaacacuccuucugcugggccucaugauucugcuuaccggcggggccaugcuguuucucaucagcggaaagggcauugggaaaacauccaucggacugauuugugugaucgucucuagcggcaugcuguggauggcugaugugccucuccaguggauugccuccgcgaucguucuugaguucuuuaugauggugcugcugauccccgagccggaaaagcaaagaaccccucaggacaaucagcucgccuacguggucauugggauccugacgcuugcugccauuguuaccgcuaacgagaugggacugcucgaaacaaccaagcgggaucugggcaugagcaaagagcccggcguggugucucccacauccuaucuggacgucgaccuccacccugccagcgcguggacccuuuacgccguggcuacgacaguuaucaccccgaugcugagacauacaauugaaaauucuaccgccaacgugagccuggcugccaucgcuaaccaagccgucgugcucauggggcuggauaagggauggcccaucuccaaaauggaccuuggcgucccucugcucgcgcuggggugcuauucucaggugaauccccugacccucacagccgcuguucuucugcuggugacgcacuacgccauuaucggaccuggccuccaggcuaaggccacccgcgaggcccagaaacggacagcggcugggauuaugaagaaccccaccgucgauggaaucaugacaauugaccuggauccugugaucuacgacagcaaguucgagaaacaacuuggccagguuaugcugcucgugcugugugccguccagcugcuccuuaugagaaccuccugggcucugugcgaagcccugacgcucgccacaggcccgaucaccacccugugggaggggucucccggaaaguuuuggaauacaaccauugcugugagcauggccaacaucuuccgcggcuccuaucuugcgggggccggacuggcuuuuagcauuaugaaaucugugggcacagggaagcggggaacgggcucccagggcgaaacccucggggagaaauggaagaagaaacugaaucaacugagcagaaaggaauucgaucucuacaaaaaguccggaaucacagagguugaccggaccgaggccaaagaaggccuuaagcgcggggagacaacccaucacgcugucucuagaggaagcgccaaacugcagugguuuguggaacggaacauggugauuccugagggccgcgucaucgaucugggguguggaagaggcggcugguccuauuacugcgcggggcucaagaagguuacggaagugcggggauauaccaaaggcgggcccggacacgaggagccugugcccaugucuacauacggcuggaauauugucaagcugaugagcgggaaagacguguucuaucuuccgccugaaaagugugauacccugcucugcgacaucggagaguccagccccucucccacaguugaagagucccgcaccaucagagugcugaaaauggucgagccuuggcugaagaacaaucaguucuguauuaaggugcucaaccccuacaugccuacaguuaucgaacaucuugagcggcugcagcgcaaacacggcggcaugcuggugagaaauccgcucagccggaacucuacccaugaaauguacuggauuuccaaugggacgggaaacaucgucagcucugugaauauggugagcagacugcuucugaaccgcuuuacaaugacccaccggagacccaccauugagaaggaugucgaccucggcgccgggacacgccacguuaacgcugaaccugagacgcccaauauggacgugaucggagagcggaucaaaagaauuaaggaagagcauuccucuaccuggcacuaugaugacgaaaacccuuacaaaacaugggccuaucauggcagcuacgaggugaaggcuaccggguccgccagcuccaugaucaauggagucgugaagcugcugacaaaacccugggauguugugccgauggucacccaaauggcuaugacagacaccacgccuuucggccagcagcgcguguuuaaggaaaaaguugauacccggacacccagaccuaugcccggcacccgcaaggugauggagauuacagccgaguggcucuggcggacccuggggagaaacaaacgcccucggcuuugcacgagagaagaguucacaaagaagguccgcaccaaugcggccaugggagcuguguuuacagaagagaaccaaugggacucugccagagcugccguugaagaugaggaguucuggaaacugguggaccgggaacgcgagcuccacaagcugggcaaaugugggagcugcgucuauaauaugaugggaaagagagaaaaaaagcuuggcgaguuugggaaagccaagggcucccgggcgaucugguacauguggcugggagcuagauaucucgaguucgaagcccugggcuuucugaacgaggaucauugguucucucgggaaaauagcuacuccgggguggagggagaaggccuccacaagcugggguacauucuucgcgacaucucuaaaauccccggaggcgccauguaugcugaugacaccgccgggugggacacgagaauuaccgaggaugaccugcacaacgaggaaaagaucacacagcagauggauccggagcaucggcagcucgcuaaugccauuuuuaaacugaccuaccaaaacaaggucgugaaaguucagcgcccuacacccaagggcaccgugauggacaucauuagcagaaaggaucagcggggauccggccaggucgggacauauggacuuaauaccuucacgaacauggaagcgcaacuggugcgccagauggagggcgaaggggugcucagcaaaguugaccuggagaauccccaccugcucgagaagaaaaucacacaguggcuggaaaccaagggaguggagagacuucggcgcauggccaucucuggcgaugacugcgucgugaaaccuauugaugacagauuugcuaacgcccugcucgcucugaacgauauggggaagguucggaaggacaucccgcaguggcaacccuccaaaggcuggcaugauuggcagcaggugccuuucuguagccaccacuuccaugaacuuauuaugaaggacggacgcaaacuggucgugcccugcagaccucaggacgagcucaucggccgggcccgcauuucucaaggggcgggauggucccugaaggaaaccgccugucugggcaaagcuuacgcccagauguggagccucauguauuuucacagacgggaucugagacuugcuucuaaugccaucugcuccgcuguccccgugcauuggguuccuacaagccgcaccacaugguccauucacgcccaucaccaguggaugacgaccgaggacaugcugacaguguggaaccgggucuggaucgaggauaaucccuggauggaagacaagaccccggugacaaccugggaggauguuccuuaccucgggaagagagaagaccaaugguguggaagccugaucggccuuacgucucgcgcgaccugggcccagaacauucugacagcuauccagcaggugcggagccucauuggggaugaggaguuccuggacuauaugcccuccaugaaaagauuucgcaaggaagaggaaucugagggcgccaucugguga

SEQ ID NO: 20658 - RNA, 9873 nt, Artificial Sequence
  derived and/or modified CDS sequence (opt5) from DENV-3__FJ744739__SS-prME
accagccugugccucaugaugaugcugcccgccacacuugcuuuccaccugacguccagagacggcgagccucggaugaucguggccaagaacgaacgcgggaaaucucuccuguuuaagaccgucagcggaauuaauauguguacacuuaucgcgauggaucugggcgagaugugcgacgauaccguuacauacaaauguccgcucauugcugaaguggagcccgaagacaucgauugcugguguaaccugaccuccacaugggugaccuaugggacgugcaaucaggccggagagcauagacgggacaagcgcucugucgcccuggcuccucacgugggcauggggcucgauaccagaacacaaaccuggaugagcgccgagggagcuuggcggcagguugaaaaaguggagacaugggcccugcgccaucccggcuucaccauucuugcgcuguuucucgcccacuacaucggcacgucccugacacagaaggucgugaucuucauucuucugaugcucguuaccccuucuaugacaaugagaugugugggggucggaaaccgggacuuuguggaaggccugagcggggcuaccuggguggaugucguucuggagcauggaggcugcgugaccacaauggccaagaauaaacccacgcucgacaucgagcugcagaagaccgaagcuacacaacuugccacccugcgcaaacucuguauugaggggaagaucacaaacauuaccacggauuccagaugcccuacacagggagaagcgauccugccggaggaacaggaccagaauuauguguguaaacacaccuacgucgaucggggcuggggcaacgggugcggacuuuucggcaaggggagccuggugaccugcgccaaguuucaaugucucgagcccauugagggaaaaguugugcagcacgaaaaucugaaguauacagucaucaucaccgugcauacaggcgaccagcaccagguugggaacgacacgcaaggagugaccgucgagauuacaccucaggcuucuaccguggaagccauccugcccgaguacggcacacucggccuggaaugcuccccucgcaccgggcuugauuucaaugagaugauucugcucacgaugaaaaacaaggcuuggaugguccauagacagugguuuuucgaccugccccuuccguggaccagcggagccacaaccgagacaccuaccuggaaucggaaagaacugcucgugacguuuaagaacgcccacgcuaaaaagcaagagguugugguccugggcucucaggaaggggcgaugcacacagcccugaccggagcuacagagauccagaauuccggcgggaccagcauuuucgccggccaucucaagugucgccugaaaauggauaagcuugaacugaaaggaaugucuuaugccaugugccucaacaccuuugugcugaagaaagagguuuccgagacacagcacggcacgauccugaucaagguggaauacaagggggaggacgcucccuguaaaauuccuuucagcaccgaagauggacaaggcaaggcccauaacgggagacuuaucacagcgaaucccgucgugaccaaaaaggaggagcccgugaacauugaagcugagccuccguucggagaauccaauaucguuauuggcaucggggacaaagcccucaagaucaacugguacaagaaaggcucuagcauuggaaagauguuugaggccacagcucggggcgccagacgcauggcuauccugggggauaccgccugggacuucggauccgucggcggggugcugaauagccucggaaaaauggugcaccagauuuuuggcucugcguauacggcccuguucuccggggucagcuggaucaugaagauuggcaucggagugcuucugacauggauuggccucaacucuaaaaauaccagcauguccuuuucuugcaucguuaucgggauuaucacccuguaccugggagcugugguccaggccgauaugggcugugugauuaacuggaaggggaaggaacuuaaaugcggaagcggcaucuucguuacaaaugaggugcauaccuggacagagcaguauaaguuucaagcugacucccccaaacggcucgccacggcgauugccggggcuugggaaaacggcgucuguggaaucagaagcaccacacgcauggagaaucugcuguggaagcagaucgccaacgaacucaauuacauucugugggagaacaauaucaaacuuaccgugguugugggcgauauuaucgggguccuggaacagggaaagcggacacucaccccucagcccauggagcugaaauauucuuggaagacguggggcaaggcuaaaauugugaccgccgagacacaaaacuccagcuucaucaucgacgggccuaacacccccgaaugcccgucugccuccagagcuuggaaugugugggaggucgaagacuacggauuuggcguuuucacaaccaacauuuggcugaagcuucgcgagguguauacacagagcugugaucaccggcucauguccgcggccaucaaagacgaaagagcugugcacgccgauaugggcuacuggauugagucucagaagaaugggagcuggaaacuggagaaggccuccuuuaucgaagucaagaccugcacguggccuaaaucucauacacuguggagcaacggagugcucgaguccgacaugauuauccccaagagccuggcuggcccuaucucucagcacaaucaucgccccggguaccacacccaaaccgccggaccuuggcaccuuggcaaacuggaacucgauuucaacuauugcgaggggacaaccguugugauuacggagaauuguggaacacggggccccucccugagaaccacaaccgucagcggcaagcugauccaugaauggugcugucgcucuugcacacuuccgccucuccgguacaugggggaggacggauguugguauggcauggaaauuagacccaucaacgagaaagaagagaauauggugaagucccugguuagcgcggggucuggaaagauggauaacuuuaccaugggcauucugugccucgcuauccuguucgaggaagugaugcgggggaaauucggaaagaaacacaugauugccggcguccuuuuuacguucgugcugcuccugagcggccagaucaccuggcgcgacauggcccauacacugaucaugauuggguccaaugcuagcgauagaaugggaaugggcguuaccuaccuugcccugaucgcgacauuuaagauucagcccuuccucgcucugggguuuuuccuccggaaacugaccucuagagagaaccuucugcucggagugggccuggccauggccacgacacugcaacuuccugaagacaucgagcagauggcuaaugggauugcccugggacucaugacccugaagcucaucacacaguuugaaaccuaucagcuguggaccgcucuugucucccugacauguagcaacacgaucuucacccucacaguggccuggcgcaccgcgacacugauucuggccggcgugucccuucugccgcucugccaaucuagcuccaugcggaagaccgauuggcugcccaugacggucgcugccaugggcguuccuccccucccucuguuuaucuucucucuuaaagacacacccaagagacgcagcuggccucugaaugagggggugauggcugugggacuggucuccauucucgccucuagccugcuuagaaacgaugugcccauggccggcccgcugguugcugggggacuccugaucgcguguuacgugauuaccggcaccuccgccgaccucacagucgagaaagcugccgacgugaccugggaagaggaagccgagcagacagggguuagccacaaccugaugaucacgguggaugacgauggaaccaugcggaucaaggacgaugaaacagagaauauucuuaccguccugcugaaaacagcucuccugaucgugucuggcauuuuuccuuauuccauccccgccacccuucuggucuggcauacguggcagaagcagacccaacgcagcggcgugcucugggacguuccuucucccccggagacacagaaagcggaacuggaggaagggguguacagaauuaagcagcagggaaucuucggcaagacccaagucggggugggaguucagaaagagggcguguuucacacaauguggcacgucacccggggggcugugcucacacauaacggaaagcgccuggagccuaauugggccuccgugaaaaaggaucuuauuagcuacggcggcggguggagacugucugcccaguggcaaaaaggagaagagguucaggucaucgcuguggaacccggcaagaacccuaagaauuuccagacgaugcccgggaucuuccagaccacaaccggagagauuggcgccaucgcgcuggacuuuaaacccgggaccuccggaagcccuauuaucaaccgggaaggcaagguggucggccucuaugggaauggagugguuacaaaaaacggcggguacguguccggaauugcucaaacgaaugccgagccggauggccccaccccugagcuggaagaggaaauguucaagaaacgcaaccuuacaaucauggaccugcaccccgggagcggcaagaccagaaaguaucucccugccaucguccgggaggcuauuaaacgcagacugcggacacucauccuggcccccaccagagugguugcugccgaaauggaggaggcgcuuaagggacugccuauucgcuaccagacgacagccaucaaaucugaacauaccggccgggagauuguggaucugaugugccacgcuaccuuuacaaugagacuccugagcccgguccgcgugcccaauuauaaccuuaucaucauggacgaagcccauuucaccgauccugcuuccauugccgcccggggguacaucucuacaagaguuggaaugggcgaggcugcggccauuuuuaugaccgcuacgcccccugggacagccgaagccuucccccagagcaaugcuccgauccaggacgaggagcgcgacauuccugaacgguccuggaacucuggaaaugaguggaucaccgauuuugugggcaagacagucugguucgugcccagcauuaaagccgggaacgacaucgcgaacugucugagaaagaauggcaagaaagugauccaacucucccgcaagaccuuugauacggaauaucagaaaacccggcugaacgacugggauuucgucguuacaaccgacauuucugagaugggagcuaauuuuaaggccgauagagugaucgacccccggcgcugccugaaaccugugauucucacagauggccccgagagagucauccuugccgggccuaugccggugaccgcugccagcgcggcccagcggcgcggaagaguuggccggaacccccagaaggaaaaugaccaauacauuuucacagggcagccucugaacaaugaugaggaccacgcucacuggaccgaagccaagaugcugcucgacaacaucaauacgcccgagggaaucauuccugcucuguucgaacccgagagagagaaauccgccgcuaucgauggcgaauaccgccuuaagggggagagccggaaaacauuuguggaacugaugagacgcggcgaccucccggucuggcuggcccauaagguggcgucugagggaauuaaauauaccgaucggaaguggugcuucgacggcgaaagaaacaaucagauccuggaggagaacauggauguugaaauuuggaccaaagagggggaacgcaagaagcuccggccuagauggcuugacgcccgcacauacuccgauccccuggcucugaaagaguuuaaggacuucgccgcuggaagaaaaagcaucgcccucgaucuggugaccgaaaucggccgggucccuucucaccuugcccaucgcacaagaaaugcucuggacaaccucgugaugcugcacacguccgagcacgggggacgggcguaucgccaugccgucgaggaacugcccgagaccauggaaacacuccuucugcugggccucaugauucugcuuaccggcggggcuaugcuguuucucaucagcggaaagggcauugggaaaacauccaucggacugauuugugugaucguuucuagcggcaugcuguggauggccgaugugccucuccaguggauugccuccgcuaucgugcuugaguucuuuaugaugguccugcugauccccgagccggaaaagcaaagaaccccucaggacaaucagcucgccuacguugugauugggauccugacgcuugcggccauugugaccgcuaacgagaugggacugcucgaaacaaccaagcgggaucugggcaugagcaaagagcccggcgucgugucucccacauccuaucuggacguugaccuccacccugccagcgcuuggacccuuuacgccguggcgacgacagucaucaccccgaugcugagacauacaauugaaaauucuaccgccaacgugagccuggcugccaucgcuaaccaagccgucgugcucauggggcuggauaagggauggcccaucuccaaaauggaccuuggcguuccucugcucgcucuggggugcuauucucaggugaauccccugacccucacagccgcgguccuucugcuggugacgcacuacgccauuaucggaccuggccuccaggcuaaggccacccgcgaggcucagaaacggacagccgccgggauuaugaagaaccccaccguugauggaaucaugacaauugaccuggauccugugaucuacgacagcaaguucgagaaacaacuuggccaggucaugcugcucgugcugugugcggugcagcugcuccuuaugagaaccuccugggcucugugcgaagcccugacgcucgcuacaggcccgaucaccacccugugggaggggucucccggaaaguuuuggaauacaaccauugccguuagcauggccaacaucuuccgcggcuccuaucuugcuggggccggacuggcguuuagcauuaugaaaucugucggcacagggaagcggggaacgggcucccagggcgaaacccucggggagaaauggaagaagaaacugaaucaacugagcagaaaggaauucgaucucuacaaaaaguccggaaucacagagguggaccggaccgaggccaaagaaggccuuaagcgcggggagacaacccaucacgcugugucuagaggaagcgccaaacugcagugguuugucgaacggaacaugguuauuccugagggccgcgugaucgaucugggguguggaagaggcggcugguccuauuacugcgcugggcucaagaaggugacggaaguccggggauauaccaaaggcgggcccggacacgaggagccugugcccaugucuacauacggcuggaauauuguuaagcugaugagcgggaaagacguguucuaucuuccgccugaaaagugugauacccugcucugcgacaucggagaguccagccccucucccacagucgaagagucccgcaccaucagagugcugaaaaugguugagccuuggcugaagaacaaucaguucuguauuaaggugcucaaccccuacaugccuacagucaucgaacaucuugagcggcugcagcgcaaacacggcggcaugcuggugagaaauccgcucagccggaacucuacccaugaaauguacuggauuuccaaugggacgggaaacaucgugagcucugucaauaugguuagcagacugcuucugaaccgcuuuacaaugacccaccggagacccaccauugagaaggauguggaccucggcgccgggacacgccacgugaacgcggaaccugagacgcccaauauggacgucaucggagagcggaucaaaagaauuaaggaagagcauuccucuaccuggcacuaugaugacgaaaacccuuacaaaacaugggccuaucauggcagcuacgaggugaaggcuaccggguccgccagcuccaugaucaauggaguugugaagcugcugacaaaacccugggaugucgugccgaugguuacccaaauggcuaugacagacaccacgccuuucggccagcagcgcguguuuaaggaaaaagucgauacccggacacccagaccuaugcccggcacccgcaaggugauggagauuacagccgaguggcucuggcggacccuggggagaaacaaacgcccucggcuuugcacgagagaagaguucacaaagaagguucgcaccaaugcugccaugggagcgguguuuacagaagagaaccaaugggacucugccagagcugccgucgaagaugaggaguucuggaaacugguggaccgggaacgcgagcuccacaagcugggcaaaugugggagcugcgucuauaauaugaugggaaagagagaaaaaaagcuuggcgaguuugggaaagcuaagggcucccgggccaucugguacauguggcugggagccagauaucucgaguucgaagcgcugggcuuucugaacgaggaucauugguucucucgggaaaauagcuacuccgggguggagggagaaggccuccacaagcugggguacauucuucgcgacaucucuaaaauccccggaggcgcuauguaugccgaugacaccgccgggugggacacgagaauuaccgaggaugaccugcacaacgaggaaaagaucacacagcagauggauccggagcaucggcagcucgcuaaugccauuuuuaaacugaccuaccaaaacaagguugugaaaguccagcgcccuacacccaagggcaccgugauggacaucauuagcagaaaggaucagcggggauccggccagguggggacauauggacuuaauaccuucacgaacauggaagcucaacugguucgccagauggagggcgaaggggugcucagcaaagucgaccuggagaauccccaccugcucgagaagaaaaucacacaguggcuggaaaccaagggaguggagagacuucggcgcauggccaucucuggcgaugacugcguugugaaaccuauugaugacagauuugcgaacgcccugcucgcucugaacgauauggggaagguccggaaggacaucccgcaguggcaacccuccaaaggcuggcaugauuggcagcaggugccuuucuguagccaccacuuccaugaacuuauuaugaaggacggacgcaaacuggucgugcccugcagaccucaggacgagcucaucggccgggcccgcauuucucaaggggcuggauggucccugaaggaaaccgccugucugggcaaagcguacgcccagauguggagccucauguauuuucacagacgggaucugagacuugcuucuaaugccaucugcuccgcuguucccgugcauugggucccuacaagccgcaccacaugguccauucacgcccaucaccaguggaugacgaccgaggacaugcugacaguguggaaccggguuuggaucgaggauaaucccuggauggaagacaagaccccggugacaaccugggaggaugucccuuaccucgggaagagagaagaccaaugguguggaagcuucaucggccugacgucucgcgcuaccugggcccagaacauucuuacagcgauccagcaggugcggagccugauuggggaugaggaguuucucgacuauaugcccuccaugaaaagauuccgcaaggaagaggaaucugagggcgccaucugguga

SEQ ID NO: 20659 - RNA, 9873 nt, Artificial Sequence
  derived and/or modified CDS sequence (opt5) from DENV-3__FJ744740__SS-prME
accagccugugccucaugaugaugcugcccgccacacuugcuuuccaccugacgucccgggacggcgaaccucggaugaucguggccaagaacgaacgcgggaagucucuccuguuuaagaccgcgagcggaauuaauauguguacacuuaucgcuauggaucugggcgaaaugugcgacgauaccgucacauacaaauguccgcucauugccgaaguugagcccgaagacaucgauugcugguguaaccugaccuccacaugggugaccuaugggacgugcaaucaggccggagagcauagacgggacaagcgcucuguggcucuggccccucacgucggcauggggcucgauaccagaacacagaccuggaugagcgcugagggagccuggagacagguggaaaaaguugagacaugggcgcugcgccaucccggcuucaccauucuugcccuguuucucgcucacuacaucggcacgucccugacacagaagguggucaucuucauucuucugaugcucgugaccccuucuaugacaaugagauguguuggggugggaaaccgggacuuugucgaaggccugagcggggccaccuggguggaugugguccuggagcauggaggcugcguuaccacaaucgcuaagaauaaacccacgcucgacauugagcugcagaagaccgaagccacacagcuugcgacccugcgcaaacucuguaucgaggggaagauuacaaacaucaccacggauuccagaugcccuacacagggagaagccauucugccggaggaacaggaccagaauuauguguguaaacacaccuacguggaucggggcuggggcaacgggugcggacuuuucggcaaggggagccuggucacaugcgcuaaguuucaaugucucgagcccaucgagggaaaagugguucagcacgaaaaucugaaguauacagugaucauuaccguccauacaggcgaccagcaccagguggggaacgacacgcaaggaguuaccguggagaucacaccucaggccucuaccgucgaagcuauucugcccgaguacggcacacucggccuggaaugcuccccucgcaccgggcuugauuucaaugagaugauccugcucacgaugaaaaacaaggccuggauggugcauagacagugguuuuucgaccugccccuuccguggaccagcggagccacaaccgagacaccuaccuggaaucggaaagaacugcucgucacguuuaagaacgcucacgcgaaaaagcaagaggugguugugcugggcucucaggaaggggccaugcacacagcucugaccggagccacagagauucaaaauuccggcgggaccagcaucuucgccggccaucucaagugucgccugaaaauggauaaacuugaacugaaaggaaugucuuaugcuaugugccucaacaccuuuguccugaagaaagagguguccgagacacagcacggcacgauccugauuaagguugaauacaagggggaggacgcccccuguaaaaucccuuucagcaccgaagauggacaaggcaaggcgcauaacgggagacuuauuacagcuaaucccguggucaccaaaaaggaggagcccgugaacaucgaagccgagccuccguucggagaauccaauauugugaucggcguuggggacaaagcccucaagaucaacugguacaagaaaggcucuagcauuggaaagauguuugaggcuacagcccggggcgcuagacgcauggccauccugggggauaccgcgugggacuucggauccgucggcggggugcugaauagccucggaaaaauggugcaccagauuuuuggcucugccuauacggcucuguucuccggggucagcuggaucaugaagauuggcaucggagugcuucugacauggauuggccucaacucuaaaaauaccagcauguccuuuucuugcaucguuaucgggauuaucacccuguaccugggagccgugguccaggcugauaugggcugugugauuaacuggaaggggaaggaacuuaaaugcggaagcggcaucuucguuacaaaugaggugcauaccuggacagagcaguauaaguuucaagccgacucccccaaacggcucgcgacggccauugcuggggccugggaaaacggcgucuguggaaucagaagcaccacacgcauggagaaucugcuguggaagcagaucgcuaacgaacucaauuacauucugugggagaacaauaucaaacuuaccgugguugugggcgauauuaucgggguccuggaacagggaaagcggacacucaccccucagcccauggagcugaaauauucuuggaagacguggggcaaggccaaaauugugaccgccgagacacaaaacuccagcuucaucaucgacgggccuaacacccccgaaugcccgucugcuuccagagcguggaaugugugggaggucgaagacuacggauuuggcguuuucacaaccaacauuuggcugaaacuucgcgagguguauacacagagcugugaucaccggcucauguccgccgcuaucaaagacgaaagagccgugcacgccgauaugggcuacuggauugagucucagaagaaugggagcuggaaacuggagaaggcuuccuuuaucgaagucaagaccugcacguggccuaaaucucauacacuguggagcaacggagugcucgaguccgacaugauuauccccaagagccuggccggcccuaucucucagcacaaucaucgccccggguaccacacccaaaccgcgggaccuuggcaccuuggcaaacuggaacucgauuucaacuauugcgaggggacaaccguugugauuacggagaauuguggaacacggggccccucccugagaaccacaaccgucagcggcaagcugauccaugaauggugcugucgcucuugcacacuuccgccucuccgguacaugggggaggacggauguugguauggcauggaaauuagacccaucaacgagaaagaagagaauauggugaagucccugguuagcgcugggucuggaaagguggauaacuuuaccaugggcauucugugccucgccauccuguucgaggaagucaugcgggggaaauucggaaagaaacacaugauugccggcgugcuuuuuacguucguucugcuccugagcggccagaucaccuggcgcgacauggcucauacacugaucaugauuggguccaaugccagcgauagaaugggaaugggcgugaccuaccuugcgcugaucgcuacauuuaagauucagcccuuccucgcccugggguuuuuccuccggaaacugaccucuagagagaaccuucugcucggagucggccuggccauggcuacgacacugcaacuuccugaagacaucgagcagauggccaaugggauugcucugggacucaugacccugaagcucaucacacaguuugaaaccuaucagcuguggaccgcccuugugucccugacauguagcaacacgaucuucacccucacaguggcguggcgcaccgccacacugauucuggcuggcgucucccuucugccgcucugccaaucuagcuccaugcggaagaccgauuggcugcccaugacgguugccgcuaugggcgugccuccccucccucuguuuaucuucucucuuaaagacacacccaagagacgcagcuggccucugaaugagggggugauggccgucggacugguguccauucucgccucuagccugcuuagaaacgauguucccauggcuggcccgcugguggccgggggacuccugaucgccuguuacgucauuaccggcaccuccgcugaccucacaguggagaaagccgccgacguuaccugggaagaggaagcugagcagacaggggugagccacaaccugaugaucacggucgaugacgauggaaccaugcggaucaaggacgaugaaacagagaauauucuuaccgugcugcugaaaacagcccuccugaucgucucuggcauuuuuccuuauuccauccccgcgacccuucugguguggcauacguggcagaagcagacccaacgcagcggcguucucugggacgugccuucucccccggagacacagaaagcugaacuggaggaaggggucuacagaauuaagcagcagggaaucuucggcaagacccaaguggggguuggagugcagaaagagggcgucuuucacacaauguggcacgugacccgcggggcggugcucacacauaacggaaagcggcuggagccuaauugggccuccguuaaaaaggaucuuauuagcuacggcggcggguggagacugucugcucaguggcaaaaaggagaagagguccaggugaucgccguggaacccggcaagaacccuaagaauuuccagacgaugcccgggaucuuccagaccacaaccggagagauuggcgcgaucgcucuggacuuuaaacccgggaccuccggaagcccuauuaucaaccgggaaggcaaggucgugggccucuaugggaauggaguugugaccaagaacggcggguacgucuccggaauugcccaaacgaaugccgagccggauggccccaccccugagcuggaagaggaaauguucaagaaacgcaaccuuacaaucauggaccugcaccccgggagcggcaagaccagaaaguaucucccugcuaucgugcgggaggccauuaaacgcagacugcggacacucauccuggcucccaccagaguuguggccgcggaaauggaggaggcccuuaagggacugccuauucgcuaccagacgacagcuaucaaaucugaacauaccggccgggagauugucgaucugaugugccacgccaccuuuacaaugagacuccugagcccggugcgcguucccaauuauaaccuuaucaucauggacgaagcucauuucaccgauccugccuccauugccgcucggggguacaucucuacaagagugggaaugggcgaggcggccgcuauuuuuaugaccgccacgcccccugggacagccgaggcuuucccccagagcaaugccccgauccaggacgaggagcgcgacauuccugaacgguccuggaacucuggaaaugaguggaucaccgauuuugucggcaagacagugugguucgugcccagcauuaaagcggggaacgacaucgcuaacugucugagaaagaauggcaagaaagucauccaacucucccgcaagaccuuugauacggaauaucagaaaacccggcugaacgacugggauuucguugugacaaccgacauuucugagaugggagccaauuuuaaggccgauagagugaucgacccccggcgcugccugaaaccugucauucucacagauggccccgagagagugauccuugcugggccuaugccgguuaccgccgcgagcgccgcucagcggcgcggaagagugggccggaacccccagaaggaaaaugaccaauacauuuucacagggcagccucugaacaaugaugaggaccacgcccacuggaccgaagcuaagaugcugcucgacaacaucaauacgcccgagggaaucauuccugcccuguucgaacccgagagagagaaauccgcugccaucgauggcgaauaccgccuuaagggggagagccggaaaacauuugucgaacugaugagacgcggcgaccucccgguguggcuggcgcauaagguugccucugagggaauuaaauauaccgaucggaaguggugcuucgacggcgaaagaaacaaucagauccuggaggagaacauggauguggaaauuuggaccaaagagggggaacgcaagaagcuccggccuagauggcuugacgcucgcacauacuccgauccccuggcccugaaagaguuuaaggacuucgcugccggaagaaaaagcaucgcccucgaucuggucaccgaaaucggccgggugccuucucaccuugcucaucgcacaagaaaugcgcuggacaaccucgucaugcugcacacguccgagcacgggggacgggccuaucgccaugcuguggaggaacugcccgagaccauggaaacacuccuucugcugggccucaugauucugcuuaccggcggggccaugcuguuucucaucagcggaaagggcauugggaaaacauccaucggacugauuuguguuaucgugucuagcggcaugcuguggauggccgaugugccucuccaguggauugcuuccgccaucguccuugaguucuuuaugaugguucugcugauccccgagccggaaaagcaaagaaccccucaggacaaucagcucgcguacguggugauugggauccugacgcuugccgcuauugucaccgccaacgagaugggacugcucgaaacaaccaagcgggaucugggcaugagcaaagagcccggcgugguuucucccacauccuaucuggacguggaccuccacccugcuagcgccuggacccuuuacgcggucgccacgacagugaucaccccgaugcugagacauacaauugaaaauucuaccgcuaacgucagccuggccgcuaucgccaaccaagcugugguucucauggggcuggauaagggauggcccaucuccaaaauggaccuuggcgugccucugcucgcccuggggugcuauucucaggucaauccccugacccucacagcggccgugcuucugcugguuacgcacuacgcuauuaucggaccuggccuccaggccaaggcuacccgcgaggcccagaaacggacagccgcggggauuaugaagaaccccaccguggauggaaucaugacaauugaccuggauccugucaucuacgacagcaaguucgagaaacaacuuggccaggugaugcugcucgugcugugugcuguucagcugcuccuuaugagaaccuccugggcccugugcgaagcucugacgcucgccacaggcccgaucaccacccugugggaggggucucccggaaaguuuuggaauacaaccauugccgucagcauggcuaacaucuuccgcggcuccuaucuugccggggcgggacuggccuuuagcauuaugaaaucugugggcacagggaagcggggaacgggcucccagggcgaaacccucggggagaaauggaagaagaaacugaaucaacugagcagaaaggaguucgaucucuacaaaaaguccggaaucacagagguggaccggaccgaggcuaaagaaggccuuaagcgcggggagacaacccaucacgccgucucuagaggaagcgcuaaacugcagugguuuguugaacggaacauggugauuccugagggccgcgugaucgaucugggguguggaagaggcggcugguccuauuacugcgccgggcucaagaaggucacggaagugcggggauauaccaaaggcgggcccggacacgaggagccuguucccaugucuacauacggcuggaauauugugaagcugaugagcgggaaagacgucuucuaucuuccgccugaaaagugugauacccugcucugcgacaucggagaguccagccccucucccacaguggaagagucccgcaccaucagaguucugaaaaugguggagccuuggcugaagaacaaucaguucuguauuaagguccucaaccccuacaugccuacagugaucgaacaucuugagcggcugcagcgcaaacacggcggcaugcuggugagaaauccgcucagccggaacucuacccaugaaauguacuggauuuccaaugggacgggaaacaucgucagcucuguuaauauggugagcagacugcuucugaaccgcuuuacaaugacccaccggagacccaccauugagaaggauguggaccucggcgcggggacacgccacgucaacgccgaaccugagacgcccaauauggacgugaucggagagcggaucaaaagaauuaaggaagaacacuccucuaccuggcacuaugaugacgaaaacccuuacaaaacaugggcuuaucauggcagcuacgagguuaaggccaccggguccgcuagcuccaugaucaauggaguggucaagcugcugacaaaacccugggaugugguuccgauggugacccaaauggccaugacagacaccacgccuuucggccagcagcgcgucuuuaaggaaaaaguggauacccggacacccagaccuaugcccggcacccgcaagguuauggagauuacagcugaguggcucuggcggacccuggggagaaacaaacgcccucggcuuugcacgagagaagaguucacaaagaaggugcgcaccaaugccgcgaugggagccgucuuuacagaagagaaccaaugggacucugcuagagccgcuguggaagaugaggaguucuggaaacuggucgaccgggaacgcgagcuccacaagcugggcaaaugugggagcugcguguauaauaugaugggaaagagagagaagaaacuuggcgaguuugggaaagccaagggcucccgggccaucugguacauguggcugggagcgagauaucucgaguucgaagcucugggcuuucugaacgaggaucauugguucucucgggaaaauagcuacuccgggguugagggagaaggccuccacaagcugggguacauucuucgcgacaucucuaaaauccccggaggcgccauguaugccgaugacaccgcugggugggacacgagaauuaccgaggaugaccugcacaacgaggaaaagaucacacagcagauggauccggagcaucggcagcucgccaaugcuauuuuuaaacugaccuaccaaaacaagguggucaaagugcagcgcccuacacccaagggcaccgugauggacaucauuagcagaaaggaucagcggggauccggccagguugggacauauggacuuaauaccuucacgaacauggaagcccaacuggugcgccagauggagggcgaagggguccucagcaaaguggaccuggagaauccccaucugcucgagaagaaaaucacacaguggcuggaaaccaagggaguugagagacuucggcgcauggcgaucucuggcgaugacugcguggucaaaccuauugaugacagauuugccaacgcucugcucgcccugaacgauauggggaaggugcggaaggacaucccgcaguggcaacccuccaaaggcuggcaugauuggcagcaggucccuuucuguagccaccacuuccaugaacuuauuaugaaggacggacgcaaacuggugguucccugcagaccucaggacgagcucaucggccgggcucgcauuucucaaggggccggauggucccugaaggaaaccgcgugucugggcaaagccuacgcucagauguggagccucauguauuuucacagacgggaucugagacuugccucuaaugcuaucugcuccgccgugcccguccauugggugccuacaagccgcaccacaugguccauucacgcucaucaccaguggaugacgaccgaggacaugcugacaguuuggaaccggguguggaucgaggauaaucccuggauggaagacaagaccccggucacaaccugggaggaugugccuuaccucgggaagagagaagaccaaugguguggaagccugaucggccuuacgucucgcgccaccugggcgcagaacauucugacagccauccaacaggugcggagccucauuggggaugaggaguuccuggacuauaugcccuccaugaaaagauuucgcaaggaagaggaaucugagggcgcuaucugguga

SEQ ID NO: 20660 - RNA, 9873 nt, Artificial Sequence
  derived and/or modified CDS sequence (opt5) from DENV-3__GQ868593__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcauauugcugaaguugagcccgaagacaucgauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauucuggcgcuuuuucuggcccauuacaucgggacgucccucacacagaagguggucaucuucauucugcuuauccuggugaccccuucuauggcuaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccauucucccggaggaacaggaccagaauuauguguguaaacacacauacguggaucggggcugggggaacggaugcggccuguucgggaagggaagccuugucaccugcgcuaaguuucaaugucuggagucuaucgagggcaaagugguucagcaugaaaaucucaaguauaccgugaucauuacaguccacaccggggaccagcaucaggugggaaacgagacacaaggcguuacggccgaaaucaccccccaggcuuccacaguggaggccauucugccugaauacggcacccuggggcucgagugcagcccccgcacaggacuggacuucaaugagaugauccuucugaccaugaaaaacaaggccuggaugguccacagacagugguuuuucgaucucccucugcccuggacgucuggcgcuaccacagaaaccccgacauggaaucggaaagagcuucuggugaccuuuaagaacgcgcacgccaaaaagcaagaagucgugguucucgggucccaggagggagcuaugcauacggcccugacaggcgccaccgaaauucagaauagcgggggcacaucuaucuucgcuggacaccugaagugucgccucaaaauggacaagcuggagcuuaaaggcauguccuaugccaugugccugaacaccuuugugcucaagaaagaggucagcgaaacccagcaugggacaauccugauuaagguggaguacaagggagaagaugcgccuuguaaaauccccuucuccacggaggacggccaagggaaggcucacaacggaagacugauuaccgccaauccuguugugacaaaaaaggaggaacccgucaacaucgaggccgaacccccuuucggcgagucuaauauugugaucgggaucggcgauaaagcucuuaagauuaacugguacaagaaaggaagcuccaucggcaagauguuugaagccaccgcucggggggccagacgcauggcgauucucggagacacagccugggauuucggcagcguggggggaguucugaauucucugggcaaaaugguccaucagaucuuuggguccgcuuauaccgcccucuucagcggcgugucuuggauuaugaagaucggaauuggcgugcugcuuacguggaucgggcugaacagcaaaaauacauccaugucuuuuagcugcaucgcuauuggaaucauuacccucuaccugggcgccgucgugcaggcggacaugggguguguuaucaacuggaagggaaaggagcugaaaugcggcuccgggauuuucgugaccaaugagguccacacauggaccgaacaguauaaguuucaagccgauagcccgaaacggcuugcuacagccaucgcuggcgccugggagaacggaguguguggcaucagaucuacgacccgcauggaaaaucuccuguggaagcagauugccaacgagcugaauuacauccucugggaaaacaauauuaaacugacaguuguggucggggacaucauuggagugcuugagcagggcaagcggacccugacaccccagccuauggagcucaaauauuccuggaagaccugggggaaggcuaaaaucguuacggcggaaacccaaaacagcucuuucaucauugauggacccaacacaccugagugccccuccgccagcagagcuuggaaugugugggaagucgaggacuacggcuuuggcguguucaccacaaacaucuggcugaagcugcgcgaaguguauacccagcuuugugaccaccggcucauguccgccgccgucaaagaugagagagcuguucaugccgacaugggguacuggauugagucucagaagaauggaagcuggaaacuggaaaaggcgucccugaucgaggugaagacaugcaccuggccgaaaucucacacgcucuggagcaacggcgugcuggaauccgauaugauuaucccuaagagccuugcugggcccaucucucagcauaaucaccgcccuggauaccacacacaaaccgccggccccuggcaucuggggaaacucgagcuggacuuuaacuauugcgagggaaccacagucgugauuaccgaaaauuguggcacgcggggcccuucccugagaacaaccacaguuagcgggaagcuuauccacgaguggugcugucgcucuugcacccuccccccgcugcgguacaugggagaagauggcuguugguaugggauggagauuagaccuaucaacgaaaaagaggagaauauggugaagucccuggccagcgcuggaucuggcaaggucgacaacuucacaaugggggugcucugccuggccauucuuuuugaagagguuaugcggggaaaauucggcaagaaacauaugaucgcgggcgugcugcucaccuucguccugcugcuuagcgggcagauuacguggcgcgauauggcucacacccugaucaugaucggauccaaugccagcgacagaaugggcaugggggugacauaccucgcccugauugcuaccuuuaagauccagcccuuccucgcccugggauuuuuccuucggaaacugacaucuagagaaaaccuccugcugggcguugggcuugcuauggccaccacgcugcaacuccccgaggauauugaacagauggcgaauggaaucgcccugggccucauggcucugaagcuuauuacacaguuugagaccuaucagcuguggacagcccucgugucccugaccuguagcaacaccaucuucacacugacggucgcuuggcgcaccgccacacuuauccuggccggcgugucccuccugccugugugccaaucuagcuccaugcggaagaccgacuggcucccgauggcugucgcggccauggggguucccccucugccccuuuuuauuuucucucugaaagauacacugaagagacgcagcuggccucucaaugagggagugauggcugugggccuggucuccauccuugccucuagccugcucagaaacgacgugcccauggccgggccucugguugcuggaggccuccugauugccuguuacgugaucaccgggacguccgcggaucuuacagucgaaaaagcugccgacgugaccugggaggaagaggccgaacagaccggaguuagccauaaccugaugauuacaguggacgaugacggcaccaugcggaucaaggaugacgagacagagaauauccugacgguccuccugaaaaccgcucuucugauugugucuggcaucuuucccuauuccauuccggccacacuccuggucuggcacaccuggcagaagcagacacaacgcagcggggugcucugggauguuccuucucccccugaaacccagaaagcggagcuggaagagggaguguacagaaucaagcagcagggcauuuucgggaagacgcaagucggagugggcguucagaaagaggggguguuucacaccauguggcaugucacacggggagcugugcuuacccacaacggcaagcgccuggaacccaauugggccuccgugaaaaaggaccugaucagcuacggcgggggauggagacucucugcccaguggcaaaaaggcgaggaaguucaggucauugcuguggagccggggaagaacccuaagaauuuccagacaaugcccggaaucuuucagaccacaacgggcgaaaucggggccauugcucuggauuucaaaccuggaaccuccggcagccccaucauuaaccgggagggcaagguggucgggcuuuauggaaauggcgugguuacaaaaaacgggggauacguguccggcaucgcccaaaccaaugcggagcccgacgggccuaccccggaacuggaggaagagauguucaagaaacgcaaccucacaauuauggaucugcaucccggcagcggaaagacgagaaaguaucucccugccaucguccgggaagcuaucaaacgcagacugcggacccuuauucuggcccccacaagagugguugcugccgagauggaggaagcccugaagggccucccuauccgcuaccagaccacagcuaccaaaucugagcacacggggcgggaaauuguggaccugaugugccaugcgacauuuaccaugagacuucugagccccguccgcgugccuaauuauaaccucaucauuauggaugaggcccacuucaccgacccggcuuccaucgccgcccggggauacaucucuacaagaguuggcaugggggaagcugccgcgauuuuuaugaccgcuacacccccuggaaccgccgaugccuucccccagagcaaugcuccuauccaggacgaggagcgcgacauucccgaacgguccuggaacucuggcaaugaguggaucacggauuuuguggggaagacagucugguucgugccgagcauuaaagccggcaacgacaucgcgaacugucugagaaagaauggaaagaaagugauucaacugucccgcaagaccuuugauacagaauaucagaaaaccaagcucaacgacugggauuucgucguuacgaccgacaucucugagaugggcgccaauuuuaaagcugaucgggugaucgacccuagacggugccuuaagcccgugauucugacagaugggcccgagcgcgucauccuggccggaccuaugcccgugaccgcugccagcgcugcccagagacggggccgcguugggagaaacccucagaaggaaaaugaccaauacauuuucacaggacagccgcucaacaaugaugaggaccacgcgcauuggaccgaagccaaaaugcugcuugacaacaucaauacacccgagggcauuaucccugcucuguuugaacccgagcgggagaaguccgccgcuaucgauggggaauacagacucaaaggcgagagccgcaagaccuucguggaacugaugcggagaggagaccugccugucuggcucgcccacaaaguggccucugagggcauuaaguauacggaucgcaaauggugcuucgacggggaacggaacaaucagauccuugaggagaacauggauguugaaauuuggacaaaggagggagaaaagaaaaagcugagaccccgcuggcuggacgcucggaccuacuccgauccgcucgcgcugaaagaguuuaaggacuucgccgcuggcagaaaaagcaucgcccuugaucuggugaccgaaauugggcgcgucccuucucaucucgcccacagaacacggaaugcucuggacaaccuggugaugcuccacaccuccgagcauggaggccgcgccuauagacacgcggucgaggaacuucccgagacaauggaaacgcugcugcuccugggccuuaugauccugcucaccgggggagccaugcuguuucugaucagcggcaaggggauuggaaagacauccaucggccucauuugugugaucgcuucuagcgggaugcuuuggauggccgauguuccucugcaguggauugcuuccgccaucgugcuggaguucuuuaugauggugcuccugauucccgagccugaaaaacaacggaccccccaggacaaucagcuugcguacgucguuaucggaauccugacacucgccgcuauuguggccgcuaacgagaugggccugcuggaaaccacgaagcgcgaucucggcaugagcaaagagccggggguggucucuccuaccuccuaucuugacguggaccugcaucccgccagcgcuuggacacuguacgccguugcgaccacagugaucacccccaugcucagacacacgauugaaaauucuacagccaacgucagccuggcugccaucgcuaaccaagccgugguccuuaugggacuggauaagggcuggccuauuuccaaaauggaccucggggugccgcugcuggcccucggaugcuauucucagguuaauccccuuacccugacagcggcugugcugcuccuggccacccauuacgcuaucaucggcccugggcuucaggccaaggccacccgggaggcucagaagagaacagccgcgggaauuaugaaaaaccccacggucgauggcaucaugaccauugaccuggauccugugaucuacgacagcaaguucgagaaacaacucggccagguuaugcugcuggugcucugugccguccagcuucugcugaugcgcacauccugggcucucugcgaagcccugacccuugcuacagggcccauuaccacgcugugggagggaucuccuggcaaguuuuggaauacaaccaucgccgugagcauggcgaacaucuuccggggguccuaucucgccggagcuggccuggccuuuagcauuaugaaaucuguggggaccggaaagagaggcacaggcucccagggggaaacccugggagagaaguggaaaaagaaacucaaucaacuuagccgcaaggaauucgaucuguacaaaaaguccggcaucacagagguugaccggacggaggcuaaagaagggcugaagagaggagagauuacccggcacgccgucucucgcggcagcgcuaagcuccagugguuuguggaaagaaacauggugaucccggaggggcgggucauugaucugggauguggccgcggcgggugguccuauuacugcgccggacuuaaaaagguuacagaagugagaggcuauaccaaagggggacccggccacgaggagccugugcccaugucuacauacggguggaauaucgucaagcugaugagcggaaaagacguguucuaucucccucccgaaaagugugauacccugcugugcgacauuggcgaguccagcccgucuccuacgguugaagagucccggaccauccgcgugcucaagauggucgagcccuggcuuaaaaacaaucaguuuuguaucaaggugcugaaccccuacaugccuacaguuauugaacaucuggagagacuccagcggaaacacggcgggaugcuggugcgcaauccccuuagcagaaacucuacccaugaaauguacuggaucuccaauggaacaggcaacauugucagcucugugaauauggugagccggcugcuccugaacagauucaccaugacacaccgccggccuaccaucgagaaggaugucgaccugggggcgggaacgagacacguuaacgccgaaccggagacacccaauauggacgugauuggcgagcgcaucaaacggaucaaggaagagcauaacuccaccuggcacuaugaugacgaaaauccuuacaagaccugggcuuaucaugggucuuacgaggugaaagccacaggaagcgcuuccagcaugauuaacggcgucgugaagcuccugacgaaacccugggauguugugccuauggucauccaaauggccaugaccgacacaacccccuucggccagcagagaguguuuaaggaaaaaguugauacacgcaccccgcggccuaugcccgggacaagaaaggugauggagauuaccgccgaguggcuuuggcgcacgcugggacggaauaagagaccucgccucugcacccgggaagaguucacaaaaaaggucagaaccaacgcggcuaugggcgccguguuuacagaagagaaucaaugggacuccgcccgcgcugccguugaagaugaggaguucuggaaacugguggacagagaacgggagcuucacaagcuggggaaauguggaucuugcgucuauaacaugaugggcaagcgcgaaaaaaagcucggggaguuuggcaaggcuaaaggaagcagagccaucugguacauguggcugggcgcgcgguaucuggaguucgaagcccucggguuucugaaugaggaucauugguucuccagagaaaacucuuacagcggaguggagggcgaagggcuucacaagcugggauacauucuccgggacaucuccaaaauccccggcggggcuauguaugccgaugacaccgcuggcugggacacgcgcauuacagaggaugaccugcacaaugaggaaaagaucacccagcagauggauccugagcauagacagcuugccaacgcgauuuuuaaacugacauaccaaaauaaggucgugaagguucagcggcccaccccgaaaggaacggugauggacaucauuucucgcaaggaucagagaggcagcgggcaggucggaaccuauggccucaacacauucaccaauauggaagcccaacuggugcggcagauggagggggaaggagugcuguccaaagcugaccucgagaacccucaccugcuugagaagaaaaucacacaguggcuggaaaccaagggcguugagcgccucaagagaauggccaucagcggggaugacugcguggucaaacccauugaugaccgguuugcuaacgcccugcuugcucugaaugauaugggcaaggugcgcaaagacaucccccaguggcaaccuucuaagggauggcaugauuggcagcagguuccguucuguucccaccacuuucaugaacucauuaugaaagacggcagaaagcuggugguccccugccggccucaggacgagcugaucgggcgcgccagaauuagccaaggagcgggcuggucucucaaggaaacagccugucuggggaaagcuuacgcccagauguggucccuuauguauuuccaccggcgcgaucugagacucgccagcaacgcuaucugcucugccgugcccguccauugggugccuaccucccggacgacauggagcauucacgcgcaucaccaguggaugaccaccgaggacaugcugacaguuuggaauagaguguggaucgaggauaaccccuggauggaagacaagaccccugucacaacgugggaggaugugcccuaccuuggaaaacgcgaagaccaaugguguggcucccugaucgggcucaccagccgggcuacaugggcccagaauauucugaccgccauccagcagguuagaucucugauuggcaacgaggaguuccucgauuauaugccgagcaugaagcgcuuuaaaaaggaagaggaauccgagggagcuaucugguga

SEQ ID NO: 20661 - RNA, 9873 nt, Artificial Sequence
  derived and/or modified CDS sequence (opt5) from DENV-3__FJ898459__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucauguggggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaaccaucgccccggauaucacacacaaaccgcuggcccuuggcaccuugggaagcuggagcucgacuuuaauuacugcgagggaacgacagugguuaucaccgaaaacuguggcacacggggccccucucugagaaccacaaccguguccgggaaacugauccaugaguggugcugucgcagcugcacgcuuccgccucuccgguauaugggagaagauggcuguugguacgggauggagauuagacccaucucugaaaaggaggagaauauggucaaaucccuggugagcgccggaucuggcaagguugacaacuucaccaugggggugcugugccucgccauucuguuugaagaggucaugcggggaaaguucggcaaaaagcacaugaucgcuggcguguucuuuacauucguucuucugcucagcgggcagauuaccuggcgcgauauggcccauacacugaucaugauuggauccaaugcgagcgacagaaugggcaugggggugaccuaucuggcucuuaucgccacguuuaaaguccagcccuuccuggcccucggauuuuuccugcggaagcucacaucuagagaaaaccugcuucugggcguggggcucgcuauggccaccacacugcaacugccugaggauaucgaacagauggcuaauggaauugcccuuggccugauggcgcucaaacugaucacccaguuugagaccuaccagcucuggacagcccugauuucccuuacguguagcaacaccauguucacacugaccguggcuuggcgcacagccacccucauccuggcuggcgucucccugcuuccgguuugccaaucuagcuccaugcggaagacggacuggcugcccauggccguggccgcuaugggggugccuccccucccucuguuuauuuucucucucaaggauacacugaaaagacgcagcuggccccuuaaugagggagucauggcggugggccugguuuccauccuggccucuagccuccugagaaacgacgugccuauggcugggccccuugucgccggaggccugcucaucgccuguuaugugauuaccgggaccuccgcugaucugacaguugaaaaggccgcggacaucaccugggaggaagaggcugaacagacaggagugagccacaaccucaugauuacggucgacgaugacggcaccaugcggaucaaagaugacgagacagagaauauucugaccgugcuucugaagacagcccugcucaucgucucuggcguguuuccguacuccaucccugccacccugcuuguuuggcauacguggcagaaacagacccaacgcagcggggugcugugggauguccccucuccucccgaaacacagaaggcugagcucgaagagggaguguacagaauuaaacagcagggcaucuucgggaagacccaaguuggagugggcguccagaaggaggggguguuucacacaauguggcacgugacccggggagccguucugacauauaacggcaaacgccucgaaccgaauugggcguccgucaagaaagaccugauuagcuacggcgggggauggagacuuucugcucaguggcaaaagggcgaggaaguccaggugaucgccgucgagccugggaaaaaccccaagaauuuccagacgaugccuggaaccuuccagacaaccaccggcgaaauuggggccaucgcucuggauuuuaagcccggaacauccggcagccccauuaucaaccgggagggcaaagugguugggcuguauggaaauggcguggucacgaagaacgggggauacguguccggcaucgcccaaaccaaugcugagccugacgggccgacacccgaacucgaggaagagauguucaaaaagcgcaaccugaccauuauggaucuucauccuggcagcggaaaaacaagaaaguaucugcccgccaucguucgggaagcgauuaagcgcagacuccggacccugauccucgccccuacgagaguggucgcugccgagauggaggaagcucugaaaggccuucccauucgcuaccagacaaccgccaccaagucugagcacacagggcgggaaaucguggaccugaugugccaugccaccuuuacaaugagacugcucagcccuguucgcgugccgaauuauaaccugaucauuauggaugaggcucacuucaccgaccccgcguccaucgccgcucggggauacauuucuacgagagucggcaugggggaagccgccgcuaucuuuaugacagccaccccucccggaacagcggaugcuuucccucagagcaaugcccccauucaggacgaggagcgcgacaucccggaacgguccuggaacucuggcaaugaguggaucaccgauuuugccgggaaaacggugugguucgugccuagcauuaaggcuggcaacgacaucgccaacugucuucgcaaaaauggaaagaaggucauucaacuguccagaaaaaccuuugauacagaauaccagaagaccaaacucaacgacugggauuucguugugacaaccgacaucucugagaugggcgcgaauuuuaaggccgaucgggugauugaccccagacggugccugaaacccgucauccugacagaugggccugagcgcgugauucucgcuggacccaugccuguuaccgccgcuagcgccgcucagagacggggccgcguggggagaaacccgcagaaggaaaaugaccaauauaucuucacgggacagccccuuaacaaugaugaggaccaugcccacuggacagaagcgaagaugcugcuggacaacaucaauaccccugagggcauuauccccgcccucuucgaaccugagcgggagaaauccgcugccauugauggggaauacagacugaagggcgagagccgcaaaaccuuugucgaacuuaugcggagaggagaccugcccguguggcucgcucacaagguugccucugagggcaucaaauauacagaucgcaaguggugcuucgacgggcagcggaacaaucagauucuggaagagaacauggauguggagaucuggaccaaagaaggagagaagaagaaacugagaccgcgcuggcucgacgcccggacauacuccgauccucuugcucugaaggaauuuaaagacuucgcggccggcagaaagagcaucgcucuggaucucgucacggagauugggcgcgugcccucucaucuggcccacagaacccggaaugcccuugacaaccuggucaugcuccauacauccgaacacggaggccgcgcuuauagacacgccguggaggagcugccugaaaccauggagacacugcuccuucugggccugaugauccuccugaccgggggagcgaugcuuuuucugauuagcggcaaagggaucggaaagacguccauuggccucaucuguguuaucgccucuagcgggaugcuguggauggcugaaauuccccugcaauggaucgccuccgcuauugugcucgaguucuuuaugauggugcuucugaucccugagcccgaaaagcagcggaccccgcaggauaaucaacuggccuacgucguuauuggaauccucacacuggcggccauuaucgcugccaacgagaugggccuucuggaaaccacaaaacgcgaccucggcaugagcaaggagccugggguggugucucccaccuccuaucuggaugucgaccugcaucccgcuagcgccuggacgcucuacgcuguggccacaaccguuaucacaccuaugcuuagacacaccauugaaaauucuaccgcgaacgugagccuggccgcuaucgccaaccaggcugucgugcugaugggacucgacaaaggcuggccgauuuccaagauggaucugggggucccccuucuggcccucggaugcuacucucaggugaauccucugacacugacggccgcgguucuccuucugaucacccauuaugcuauuaucggccccgggcugcaggccaaagcuacacgggaggcccaaaagagaaccgccgcuggaaucaugaagaacccuacaguggacggcauuaugaccaucgaucucgaccccgucauuuacgauagcaaauucgagaagcagcugggccaggugaugcuucugguucucugugccgugcagcugcugcucaugcgcacguccugggcgcuuugcgaagcccugacacuggcuaccgggccuaucaccacacucugggagggaucuccgggcaaauuuuggaauaccacaauugccgucagcauggcuaacaucuuccggggguccuaucuggccggagcgggccuugccuuuagcaucaugaagucuguggggacgggaaaaagaggcaccggcucccaaggggaaacacugggagagaaguggaagaaaaagcucaaucagcugagccgcaaagaguucgaccuguacaagaaauccggcauuaccgagguggaucggacagaggcuaaggaagggcucaaaagaggagagaccacgcaccaugccguuucucggggcagcgcuaaacuucagugguuugucgaacgcaacauggugauccccgaggggagagugauugaccugggauguggccggggcgggugguccuauuacugcgccggacugaagaaagucaccgaaguucgcggcuauacaaaagggggaccuggccacgaggagcccgugccuaugucuaccuacggguggaauaucgugaaacucaugagcggaaaggaugucuucuaccugcccccggaaaaaugugacacacuucugugcgauauuggcgaguccagcccuucucccaccguggaagaguccagaacaauccggguucucaagaugguggagcccuggcugaagaacaaucaguucuguauuaaaguccugaacccuuauaugcccaccgugaucgaacaccucgagcgccuucaaagaaagcauggcgggaugcugguucggaauccucugagccgcaacucuacgcacgaaauguacuggaucuccaauggaacaggcaacauuguggcuagcgucaauauggugucuagacuccugcuuaaccgguuuaccaugacccauagacgcccgacaaucgagaaagacguggaucugggggccggaacgcggcacgucaacgcggaacccgagaccccuaauauggacguuauuggcgagagaaucaagcgcauuaaagaagaacacaacagcacauggcauuaugacgaugaaaaucccuacaagaccugggccuaucacggguccuacgaggugaaggcuacaggaucugccagcuccaugaucaacggcguggucaaacuccugaccaagccuugggacgugguucccauggugacacagauggcuaugaccgauacgaccccguucggccagcaacgggucuuuaaagaaaagguggacacaagaaccccucgcagcaugcccgggacacggagaguuaugggaaucaccgccgaguggcuguggcgcacgcucggccggaauaaaaagccuagacugugcacacgcgaggaguucaccaagaaagugcggacaaacgccgcgaugggggcugucuuuaccgaggaaaaucagugggauuccgccaaggccgcuguggaggacgaagauuucuggaaacuuguugacagagagcgcgagcugcauaagcucggaaaauguggcucuugcguguauaacaugauggggaagagagagaagaagcugggcgaguuuggaaaggccaaaggcagccgggcuauuugguacauguggcuuggggcccgcuaccuggaguucgaggcgcucggauuucugaaugaggaucacugguucuccagagaaaacucuuauagcggcgucgagggggaaggacugcauaagcucggcuacauccugcgggacauuuccaaaauccccgggggcgccauguaugcugaugacacggccggaugggacaccagaauuacagaggaugaccuucacaaugaagagaagaucacccagcagauggauccugagcaccggcaacuggcuaacgccaucuuuaaacucacauaccagaauaagguggucaaggugcagcgccccaccccgacaggcaccguuauggacauuaucucuagaaaagaucagcgggggagcggacaagugggcacguaugggcugaacacauucaccaauauggaagcgcagcuuauucgccagauggagggagaaggcguccuguccaaggccgaccucgagaacccucaucugcccgagaagaagaucacccaguggcuggagacaaaagggguggagagacucaagcggauggcuauuagcggcgaugacugcgugguuaagcccaucgaugaccgcuuugccaacgcucugcuugcccugaaugauaugggaaaagugagaaaggacaucccucaauggcagccgucuaaaggcuggcacgauuggcagcagguccccuucuguucccaucacuuccacgaacucauuaugaaggacgggcggaaacuggugguuccuugccgcccccaagacgagcuuaucggacgggcucggauuagccagggcgccggguggucucugcgcgaaaccgcgugucucggaaaggccuacgcucagauguggucccugauguauuuucauagacgggaucugcgccucgccagcaacgccaucugcucugcugugccuguccacugggugcccacauccagaacgaccuggagcauucaugcccaccaucaauggaugacaaccgaggacaugcugacagucuggaaucggguguggaucgaagauaacccuuggauggaggacaagacccccguuacgaccugggagaaugugccguaccuuggcaaaagagaagaucaguggugugggucccugauuggccucacaagccgcgcgaccugggcucagaacaucccuacagccauccagcaaguccggucucugauuggaaaugaggaguuccuugacuacaugcccagcaugaagagauuucgcaaagaggaggaauccgagggcgccaucugguga

SEQ ID NO: 20662 - RNA, 9873 nt, Artificial Sequence
  derived and/or modified CDS sequence (opt5) from DENV-3__EU482555__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggcccggggggcuagacgcauggccauccuuggagacacagcgugggauuucggcuccguggggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggagugaucacccuguaucucggcgcuguugugcaggccgacauggggugugucauuaauuggaaaggaaaggagcugaagugcggcagcgggaucuucgugacaaacgagguucauacguggaccgaacaguacaaauuucaagcggauucccccaagcggcuggccacagcuauugccggcgcuugggagaauggaguguguggcaucagaagcaccacacgcauggaaaaccuucucuggaaacagauugccaaugagcugaacuauauccugugggaaaauaacaucaagcucaccgucgugguuggggacauuaucggagugcuggagcagggcaaacggacgcuuaccccucagcccauggagcugaaguacucuuggaaaacaugggggaaggccaagauugucaccgcugaaauccaaaacuccagcuucauuaucgauggaccuaauacacccgagugcccgucugcguccagagccuggaacgugugggaaguggaggacuauggcuuuggcgucuucaccacaaauaucuggcucaaacugcgcgaaguuuacacccagcugugugaccaccggcuuaugagcgcugccgugaaggaugagagagccgugcacgcugacaugggguacuggauugagucccagaaaaacggaucuuggaagcucgaaaaagccagccugaucgaggucaagacgugcacauggccuaagucccauacccuguggucuaauggcgugcucgaaagcgauaugauuauccccaaaucccuggcggggccuauuagccagcacaacuaucgccccggauaccauacccaaacagcuggcccuuggcaccuugggaagcuggaccucgauuuuaauuauugcgagggaaccacgguugugaucacagagaacuguggcacccggggccccucucugagaacaaccacagucuccgggaaacugauccacgaauggugcugucgcagcugcacccuuccgccucuccgguacaugggagaggacggcuguugguaugggauggaaauuagacccaucucugagaaggaagagaauauggugaaaucccugguuagcgccggaucuggcaagguggauaacuucacgauggggguccugugccucgccauucuguuugaggaagugaugcggggaaaguucggcaaaaagcauaugaucgcuggcguuuucuuuaccuucgugcuucugcucagcgggcagauuacauggcgcgacauggcccacacccugaucaugauuggauccaaugcgagcgauaaaaugggcaugggggucacauaccuggcucuuaucgccaccuuuaagauccagcccuuccuggcccucggauuuuuccugagaaaacucacgucucgggagaaccugcuucugggcguggggcucgcuauggccacaacccugcaacugccugaagacauugagcagauggcuaauggaaucgcccuuggccugauggcgcucaagcugauuacacaguuugaaaccuaucagcucuggaccgcccugaucucccuuacauguagcaacacgauguucacccugacaguggcuuggagaaccgccacacucauucuggcuggcgucucccugcuuccgguuugccaaucuagcuccaugcgcaagaccgauuggcugcccauggccguggccgcuaugggggugccuccccucccucuguuuaucuucucucucaaagacacgcugaagcggagaagcuggccccuuaaugagggagucauggcggugggccugguuuccauccuggccucuagccuccugcgcaacgaugugccuauggcugggccccuugucgccggaggccugcucauugccuguuacgugaucacagggaccuccgcugaccugaccguugagaaagccgcggacauuacaugggaagaggaagcugagcagaccggagugagccauaaccucaugaucacagucgaugacgauggcacgaugagaauuaaggacgaugaaaccgagaauauccugacagugcuucugaaaaccgcccugcucaucgucucuggcguguuuccguacuccauuccugccacacugcuuguuuggcacaccuggcagaagcagacgcaacggagcggggugcugugggacguccccucuccucccgagacccagaaagcugaacucgaggaaggaguguaucgcaucaagcagcagggcauuuucgggaagacacaaguuggagugggcguccagaaagaggggguguuucauaccauguggcacgugacaagaggagccguucugaccuacaacggcaagcggcucgagccgaauugggcguccgucaaaaaggaucugaucagcuauggcgggggauggcgccuuucugcucaguggcaaaaaggcgaagaggugcaggugauugccgucgaaccugggaagaaccccaagaauuuccagacaaugccuggaacguuccagaccacaaccggcgagaucggggccauugcucuggacuuuaaacccggaaccuccggcagccccaucaucaacagagaaggcaaggugguugggcuguacggaaauggcguggucacaaaaaacgggggauauguguccggcauugcccaaacgaaugcugagccugaugggccgacccccgagcucgaagaggaaauguucaagaaacggaaccugacaaucauggaccuucacccuggcagcggaaagacccgcaaguaccugcccgccauuguuagagaggcgaucaaacggcgccucagaacacugauucucgccccuacccggguggucgcugccgaaauggaggaggcucugaagggccuucccaucagauaucagacgacagccaccaaaucugaacauaccgggcgcgagaucguggaucugaugugccacgccacauuuaccaugcggcugcucagcccuguuagagugccgaauuacaaccugauuaucauggacgaagcucauuucacagaucccgcguccauugccgcucgcggauacaucucuacccgggucggcaugggggaggccgccgcuauuuuuaugacggccacaccucccggaaccgcggacgcuuucccucagagcaaugcccccauccaggacgaagagagagauaucccggagcgcuccuggaacucuggcaaugaauggauuacagacuuugccgggaagaccgugugguucgugccuagcaucaaagcuggcaacgauauugccaacugucuucggaagaauggaaagaaagucauccaacuguccagaaagacguuugacaccgaguaucagaaaacaaagcucaacgauugggacuucguugugaccacagauauuucugaaaugggcgcgaauuuuaaagccgaccgcgugaucgauccccggagaugccugaagcccgucauucugaccgacgggccugagcgggugauccucgcuggacccaugccuguuacagccgcuagcgccgcucagcgcagaggccggguggggcgcaacccgcagaaggagaaugaucaauacaucuucaccggacagccccuuaacaaugacgaagaccacgcccauuggacggaggcgaaaaugcugcuggauaacauuaauacaccugaaggcaucauucccgcccucuucgagccugaaagagagaaguccgcugccaucgacggggaguaucggcugaaaggcgaaagcagaaagaccuuugucgagcuuaugcgccggggagaucugcccguguggcucgcucacaaaguugccucugaaggcauuaaguacaccgacagaaaauggugcuucgaugggcagcgcaacaaucagauccuggaggaaaacauggacguggagaucuggacaaaggagggagaaaagaaaaagcugcggccgagauggcucgaugcccgcaccuauuccgacccucuugcucugaaagaguuuaaggauuucgcggccggccggaaaagcauugcucuggaccucgucacagaaaucgggagagugcccucucaccuggcccaucgcacgagaaaugcccuugauaaccuggucaugcuccacaccuccgagcauggaggccgggcuuaccgccacgccguggaagagcugccugagacaauggaaacccugcuccuucugggccugaugauucuccugacagggggagcgaugcuuuuucugaucagcggcaaggggauuggaaagaccuccaucggccucaucuguguuauugccucuagcgggaugcuguggauggcugagaucccccugcaauggauugccuccgcuaucgugcucgaauucuuuaugauggugcuucugauuccugagcccgagaaacagagaacgccgcaggacaaucaacuggccuaugucguuaucggaauucucacccuggcggccaucaucgcugccaacgaaaugggccuucuggagacaaccaagcgggaucucggcaugagcaaagaaccugggguggugucucccacauccuaccuggacgucgaccugcaccccgcuagcgccuggacccucuacgcuguggccacgacaguuauuaccccuaugcuucgccauacaaucgagaauucuaccgcgaacgugagccuggccgcuauugccaaccaggcugucgugcugaugggacucgauaagggcuggccgaucuccaaaauggaccugggggucccccuucuggcccucggaugcuauucucaggugaauccucugacccugacagccgcgguucuccuucugauuacgcacuacgcuaucaucggccccgggcugcaggccaaggcuaccagagaagcccaaaagcggacagccgcuggaauuaugaaaaacccuaccguggauggcaucaugacaauugaccucgaucccgucaucuaugacagcaaguucgagaaacagcugggccaggugaugcuucugguucucugugccgugcagcugcugcucaugagaaccuccugggcgcuuugcgaggcccugacgcuggcuacagggccuauuaccacccucugggaaggaucuccgggcaaguuuuggaauacaaccaucgccgucagcauggcuaacaucuuccgcggguccuaccuggccggagcgggccuugccuuuagcauuaugaaaucuguggggacaggaaagcggggcacgggcucccaaggggagacccugggagaaaaguggaaaaagaaacucaaucagcugagcagaaaggaguucgaucuguauaaaaaguccggcaucacagaaguggaccgcaccgaggcuaaagaggggcucaagcggggagaaacaacccaucacgccguuucuagaggcacggcuaagcuucagugguuugucgagcggaacauggugauucccgaagggcgcgugaucgaucugggauguggcagaggcggguggagcuacuauugcgccggacugaaaaaggucaccgagguucggggcuacacaaaagggggaccuggccaugaagagcccgugccuauguccaccuacggguggaauauugugaagcucaugucuggaaaagacgucuucuaucugcccccggagaagugugauacacuucugugcgacaucggcgaaagcuccccuagccccaccguggaggaaucucgcacaauuagaguucucaagaugguggagcccuggcugaaaaacaaucaguucuguaucaagguccugaacccuuacaugcccaccgugaucgagcaccucgaacggcuucaacgcaaacacggcgggaugcugguuagaaauccucugucccggaacagcacgcaugagauguauuggauuucuaauggaacaggcaacaucguggcuuccgucaauauggugagccgccuccugcuuaacagauuuaccaugacccaccggagaccgacaauugaaaaggauguggaccugggggccggaacgcgccaugucaacgcggagcccgaaaccccuaauauggacguuaucggcgagcggauuaaaagaaucaaggaggaacacaacucuacauggcacuacgaugacgagaaucccuauaagaccugggccuaccaugggagcuaugaagugaaagcuacaggauccgccucuagcaugaucaacggcguggucaagcuccugaccaaaccuugggaugugguucccauggugacacagauggcuaugaccgacacgaccccguucggccagcaacgcgucuuuaaggagaaaguggauacacggaccccuagauccaugcccgggacacgccggguuaugggaauuaccgccgaauggcuguggagaacgcucggccgcaauaagaagccucggcugugcacaagagaggaguucaccaaaaaggugcgcacaaacgccgcgaugggggcugucuuuaccgaagagaaucagugggacagcgccaaagccgcuguggaagaugaggacuucuggaagcuuguugaucgggaaagagagcugcacaaacucggaaaguguggcuccugcguguacaacaugauggggaaacgcgagaagaagcugggcgaauuuggaaaagccaagggcucuagagcuaucugguacauguggcuuggggcccgguaucuggaguucgaagcgcucggauuucugaaugaggaccauugguucagccgcgagaacuccuacucuggcgucgaaggggagggacugcacaaacucggcuauauucugagagauaucagcaagauucccgggggcgccauguacgcugacgacacggccggaugggauacccggaucacagaagacgaucuucauaaugaggaaaaaaucacccagcagauggacccugagcacagacaacuggcuaacgccauuuuuaagcucacauaucagaauaagguggucaaagugcagcggcccaccccgacaggcaccguuauggauaucauuucccgcaaggaccagagagggucuggacaagugggcacguacgggcugaacacauucaccaauauggaggcgcagcuuauccggcagauggaaggagagggcguccugagcaaagccgaucucgaaaacccucaccugcccgagaagaaaauuacccaguggcuggaaacaaaggggguggagcgccucagacggauggcuaucuccggcgacgauugcgugguuaagcccaucgacgaucgcuuugccaacgcucugcuugcccugaaugacaugggaaaagugagaaaggauauuccucaauggcagccgagcaaaggcuggcaugacuggcagcagguccccuucuguucucaccauuuccacgagcucaucaugaaggacgggcggaaacuggugguuccuugccgcccccaagaugaacuuauuggaagagcucggaucucccagggcgccggguggagccugcgcgagaccgcgugucucggaaaggccuaugcucagauguggucucugauguacuuucacagacgggaccugcgccucgccuccaacgccauuugcagcgcugugccuguccauugggugcccacaucuagaacgaccugguccauccacgcccaucaccaauggaugacaaccgaagauaugcugacagucuggaaucggguguggauugaggacaacccuuggauggaagauaagacccccguuacgaccugggagaaugugccguaccuuggcaaaagagaggaccaguggugugggagccugaucggccucacaucccgcgcgaccugggcucagaacaucccuacagccauucagcaaguccggagccugaucggaaaugaagaguuccuugauuauaugcccucuaugaagagauuucgcaaagaagaggagagcgaaggcgccauuugguga

SEQ ID NO: 20663 - RNA, 9873 nt, Artificial Sequence
  derived and/or modified CDS sequence (opt5) from DENV-3__EU529692__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggcccggggggcuagacgcauggccauccuuggagacacagcgugggauuucggcuccguggggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggagugaucacccuguaucucggcgcuguugugcaggccgacauggggugugucauuaauuggaaaggaaaggagcugaagugcggcagcgggaucuucgugacaaacgagguucauacguggaccgaacaguacaaauuucaagcggauucccccaagcggcuggccacagcuauugccggcgcuugggagaauggaguguguggcaucagaagcaccacacgcauggaaaaccuucucuggaaacagauugccaaugagcugaacuauauccugugggaaaauaacaucaagcucaccgucgugguuggggacauuaucggagugcuggagcagggcaaacggacgcuuaccccucagcccauggagcugaaguacucuuggaaaacaugggggaaggccaagauugucaccgcugaaauccaaaacuccagcuucauuaucgauggaccuaauacacccgagugcccgucugcguccagagccuggaacgugugggaaguggaggacuauggcuuuggcgucuucaccacaaauaucuggcucaaacugcgcgaaguuuacacccagcugugugaccaccggcuuaugagcgcugccgugaaggaugagagagccgugcacgcugacaugggguacuggauugagucccagaaaaacggaucuuggaagcucgaaaaagccagccugaucgaggucaagacgugcacauggccuaagucccauacccuguggucuaauggcgugcucgaaagcgauaugauuauccccaaaucccuggcggggccuauuagccagcacaacuaucgccccggauaccauacccaaacagcuggcccuuggcaccuugggaagcuggaccucgauuuuaauuauugcgagggaaccacgguugugaucacagagaacuguggcacccggggccccucucugagaacaaccacagucuccgggaaacugauccacgaauggugcugucgcagcugcacccuuccgccucuccgguacaugggagaggacggcuguugguaugggauggaaauuagacccaucucugagaaggaagagaauauggugaaaucccugguuagcgccggaucuggcaagguggauaacuucacgauggggguccugugccucgccauucuguuugaggaagugaugcggggaaaguucggcaaaaagcauaugaucgcuggcguuuucuuuaccuucgugcuucugcucagcgggcagauuacauggcgcgacauggcccacacccugaucaugauuggauccaaugcgagcgauaaaaugggcaugggggucacauaccuggcucuuaucgccaccuuuaagauccagcccuuccuggcccucggauuuuuccugagaaaacucacgucucgggagaaccugcuucugggcguggggcucgcuauggccacaacccugcaacugccugaagacauugagcagauggcuaauggaaucgcccuuggccugauggcgcucaagcugauuacacaguuugaaaccuaucagcucuggaccgcccugaucucccuuacauguagcaacacgauguucacccugacaguggcuuggagaaccgccacacucauucuggcuggcgucucccugcuuccgguuugccaaucuagcuccaugcgcaagaccgauuggcugcccauggccguggccgcuaugggggugccuccccucccucuguuuaucuucucucucaaagacacgcugaagcggagaagcuggccccuuaaugagggagucauggcggugggccugguuuccauccuggccucuagccuccugcgcaacgaugugccuauggcugggccccuugucgccggaggccugcucauugccuguuacgugaucacagggaccuccgcugaccugaccguugagaaagccgcggacauuacaugggaagaggaagcugagcagaccggagugagccauaaccucaugaucacagucgaugacgauggcacgaugagaauuaaggacgaugaaaccgagaauauccugacagugcuucugaaaaccgcccugcucaucgucucuggcguguuuccguacuccauuccugccacacugcuuguuuggcacaccuggcagaagcagacgcaacggagcggggugcugugggacguccccucuccucccgagacccagaaagcugaacucgaggaaggaguguaucgcaucaagcagcagggcauuuucgggaagacacaaguuggagugggcguccagaaagaggggguguuucauaccauguggcacgugacaagaggagccguucugaccuacaacggcaagcggcucgagccgaauugggcguccgucaaaaaggaucugaucagcuauggcgggggauggcgccuuucugcucaguggcaaaaaggcgaagaggugcaggugauugccgucgaaccugggaagaaccccaagaauuuccagacaaugccuggaacguuccagaccacaaccggcgagaucggggccauugcucuggacuuuaaacccggaaccuccggcagccccaucaucaacagagaaggcaaggugguugggcuguacggaaauggcguggucacaaaaaacgggggauauguguccggcauugcccaaacgaaugcugagccugaugggccgacccccgagcucgaagaggaaauguucaagaaacggaaccugacaaucauggaccuucacccuggcagcggaaagacccgcaaguaccugcccgccguugugagagaggcgauuaaacggcgccucagaacacugauccucgccccuacccgggucguggcugccgaaauggaggaggcucugaagggccuucccauuagauaucagacgacagccaccaaaucugaacauaccgggcgcgagaucguugaucugaugugccacgccacauuuaccaugcggcugcucagcccugugagagucccgaauuacaaccugaucauuauggacgaagcucauuucacagaucccgcguccaucgccgcucgcggauacauuucuacccgggugggcaugggggaggccgccgcuaucuuuaugacggccacaccucccggaaccgcggacgcuuucccucagagcaaugcccccauucaggacgaagagagagauaucccggagcgcuccuggaacucuggcaaugaauggaucacagacuuugccgggaagaccgugugguucgucccuagcauuaaagcuggcaacgauaucgccaacugucuucggaagaauggaaagaaaguuauucaacuguccagaaagacguuugacaccgaguaucagaaaacaaagcucaacgauugggacuucguggugaccacagauaucucugaaaugggcgcgaauuuuaaagccgaccgcgucauugauccccggagaugccugaagcccgugauccugaccgacgggccugagcggguuauucucgcuggacccaugccugugacagccgcuagcgccgcucagcgcagaggccgggucgggcgcaacccgcagaaggagaaugaucaauacaucuucaccggacagccccuuaacaaugacgaagaccacgcccauuggacggaggcgaaaaugcugcuggauaacaucaauacaccugaaggcauuauccccgcccucuucgagccugaaagagagaaguccgcugccauugacggggaguaucggcugaaaggcgaaagcagaaagaccuuuguggagcuuaugcgccggggagaucugcccguuuggcucgcucacaaaguggccucugaaggcaucaaguacaccgacagaaaauggugcuucgaugggcagcgcaacaaucagauucuggaggaaaacauggacgucgagaucuggacaaaggagggagaaaagaaaaagcugcggccgagauggcucgaugcccgcaccuauuccgacccucuugcucugaaagaguuuaaggauuucgcggccggccggaaaagcaucgcucuggaccucgugacagaaauugggagaguccccucucaccuggcccaucgcacgagaaaugcccuugauaaccuggugaugcuccacaccuccgagcauggaggccgggcuuaccgccacgccguugaagagcugccugagacaauggaaacccugcuccuucugggccugaugauccuccugacagggggagcgaugcuuuuucugauuagcggcaaggggaucggaaagaccuccauuggccucaucugugugaucgccucuagcgggaugcuguggauggcugagauuccccugcaauggaucgccuccgcuauugugcucgaauucuuuaugaugguccuucugaucccugagcccgagaaacagagaacgccgcaggacaaucaacuggccuauguugugauuggaauccucacccuggcggccauuaucgcugccaacgaaaugggccuucuggagacaaccaagcgggaucucggcaugagcaaagaaccugggguggucucucccacauccuaccuggacguggaccugcaccccgcuagcgccuggacccucuacgcuguugccacgacagugaucaccccuaugcuucgccauacaauugagaauucuaccgcgaacgucagccuggccgcuaucgccaaccaggcugugguccugaugggacucgauaagggcuggccgauuuccaaaauggaccugggggugccccuucuggcccucggaugcuauucucagguuaauccucugacccugacagccgcggugcuccuucugaucacgcacuacgcuauuaucggccccgggcugcaggccaaggcuaccagagaagcccaaaagcggacagccgcuggaaucaugaaaaacccuaccgucgauggcauuaugacaaucgaccucgaucccgugauuuaugacagcaaguucgagaaacagcugggccagguuaugcuucuggugcucugugccguccagcugcugcucaugagaaccuccugggcgcuuugcgaggcccugacgcuggcuacagggccuaucaccacccucugggaaggaucuccgggcaaguuuuggaauacaaccauugccgugagcauggcuaacaucuuccgcggguccuaccuggccggagcgggccuugccuuuagcaucaugaaaucuguggggacaggaaagcggggcacgggcucccaaggggagacccugggagaaaaguggaaaaagaaacucaaucagcugagcagaaaggaguucgaucuguauaaaaaguccggcauuacagaaguugaccgcaccgaggcuaaagaggggcucaagcggggagaaacaacccaucacgccgucucuagaggcacggcuaagcuucagugguuuguggagcggaacauggugauccccgaagggcgcgucauugaucugggauguggcagaggcggguggagcuacuauugcgccggacugaaaaagguuaccgaggugcggggcuacacaaaagggggaccuggccaugaagagcccgugccuauguccaccuacggguggaauaucgucaagcucaugucuggaaaagacguguucuaucugcccccggagaagugugauacacuucugugcgacauuggcgaaagcuccccuagccccaccguugaggaaucucgcacaaucagagugcucaagauggucgagcccuggcugaaaaacaaucaguucuguauuaaggugcugaacccuuacaugcccaccguuaucgagcaccucgaacggcuucaacgcaaacacggcgggaugcuggugagaaauccucugucccggaacagcacgcaugagauguauuggaucucuaauggaacaggcaacauugucgcuuccgugaauauggugagccgccuccugcuuaacagauuuaccaugacccaccggagaccgacaaucgaaaaggaugucgaccugggggccggaacgcgccauguuaacgcggagcccgaaaccccuaauauggacgugauuggcgagcggaucaaaagaauuaaggaggaacacaacucuacauggcacuacgaugacgagaaucccuauaagaccugggccuaccaugggagcuaugaagugaaagcuacaggauccgccucuagcaugaucaacggcgucgugaagcuccugaccaaaccuugggauguugugcccauggucacacagauggcuaugaccgacacgaccccguucggccagcaacgcguguuuaaggagaaaguugauacacggaccccuagauccaugcccgggacacgccgggugaugggaaucaccgccgaauggcuguggagaacgcucggccgcaauaagaagccucggcugugcacaagagaggaguucaccaaaaagguccgcacaaacgccgcgaugggggcuguguuuaccgaagagaaucagugggacagcgccaaagccgcuguugaagaugaggacuucuggaagcuuguggaucgggaaagagagcugcacaaacucggaaaguguggcuccugcgucuacaacaugauggggaaacgcgagaagaagcugggcgaauuuggaaaagccaagggcucuagagcuauuugguacauguggcuuggggcccgguaucuggaguucgaagcgcucggauuucugaaugaggaccauugguucagccgcgagaacuccuacucuggcguggaaggggagggacugcacaaacucggcuauauccugagagauauuagcaagauccccgggggcgccauguacgcugacgacacggccggaugggauacccggauuacagaagacgaucuucauaaugaggaaaaaaucacccagcagauggacccugagcacagacaacuggcuaacgccaucuuuaagcucacauaucagaauaaggucgugaaaguucagcggcccaccccgacaggcaccgugauggauauuaucucccgcaaggaccagagagggucuggacaagucggcacguacgggcugaacacauucaccaauauggaggugcagcuuauucggcagauggaaggagagggcgugcugagcaaagcggaucucgaaaacccucaccugcccgagaagaaaaucacccaguggcuggaaacaaaggggguugagcgccucagacggauggccauuuccggcgacgauugcguggucaagcccaucgacgaucgcuuugcuaacgcccugcuugcucugaaugacaugggaaaagugagaaaggauaucccucaauggcagccgagcaaaggcuggcaugacuggcagcagguucccuucuguucucaccauuuccacgagcucauuaugaaggacgggcggaaacugguggucccuugccgcccccaagaugaacuuaucggaagagcccggauuucccagggcgcuggguggagccugcgcgagaccgccugucucggaaaggcguaugcccagauguggucucugauguacuuucacagacgggaccugcgccucgcuuccaacgccaucugcagcgccgugccuguccauugggugcccacaucuagaacgaccugguccauucacgcucaucaccaauggaugacaaccgaagauaugcugacaguuuggaaucggguguggaucgaggacaacccuuggauggaagauaagacccccgucacgaccugggagaaugugccguaccuuggcaaaagagaggaccaguggugugggagccugauuggccucacaucccgcgccaccugggcgcagaacaucccuacagcuauccagcaaguucggagccugauuggaaaugaagaguuccuugauuauaugcccucuaugaagagauuucgcaaagaagaggagagcgaaggcgccaucugguga

SEQ ID NO: 20664 - RNA, 9873 nt, Artificial Sequence
  derived and/or modified CDS sequence (opt5) from DENV-3__EU482558__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcauaugaucgccggcguuuucuuuacauucgugcuucugcucagcgggcagauuaccuggcgcgauauggcucacacacugaucaugauuggauccaauaccagcgacagaaugggcaugggggucacguaccuggcccuuaucgcgacauuuaaaauccagcccuuccuggcucucggauuuuuccugcggaagcucaccucuagagaaaaccugcuucugggcguggggcucgccauggccacaacccugcaacugccugaggauauugaacagauggcuaauggaaucgcccuuggccugauggcucucaaacugauuacccaguuugagacauaucagcucuggacggcccugaucucccuuaccuguagcaacacaauuuucacccugacaguggcguggcgcaccgccacgcucauccuggcuggcgucucccugcuuccgguuugccaaucuagcuccaugcggaagacagacuggcugcccaugaccguggccgcuaugggggugccuccccucccucuguuuaucuucucucucaaggauacccugaaaagacgcagcuggccccuuaaugagggagucauggccgugggccugguuuccauucuggccucuagccuccugagaaacgacgugccuauggcugggccccuugucgcgggaggccugcucaucgccuguuacgugauuacagggaccuccgcugaucugacaguugaaaaggccgccgacgugacgugggaggaagaggcugaacagaccggagucagccauaaccucaugaucacaguggacgaugacggcaccaugcggauuaaagaugacgagacagagaauauccugaccguccuucugaagacggcccugcucaucgugucuggcauuuuuccguacuccaucccugcgacccugcuuguuuggcacacauggcagaaacagacccaacgcagcggggugcugugggauguccccucuccucccgaaacacagaaggcugagcucgaagagggaguguauagaauuaaacagcagggcaucuucgggaagacccaaguuggagugggcguccagaaggaggggguguuucauacaauguggcacgugacgcggggagccguucugaccuacaacggcaaacgccucgaaccgaauugggccuccgucaagaaagaccugauuagcuauggcgggggauggagacuuucugcucaguggcaaaagggcgaggaaguccaggugaucgccgucgagccugggaaaaaccccaagaauuuccagacaaugccuggaaccuuccagaccacaacgggcgaaauuggggcgaucgcucuggauuuuaagcccggaaccuccggcagccccaucauuaaccgggagggcaaagugguugggcuguacggaaauggcguggucacaaagaacgggggauauguguccggcaucgcccaaaccaaugccgagccugacgggccgacacccgaacucgaggaagagauguucaaaaagcgcaaccugaccauuauggaucuucacccuggcagcggaaaaacgagaaaguaccugcccgcuaucguucgggaagccauuaagcgcagacuccggacacugauccucgcuccuaccagaguggucgccgcggagauggaggaagcccugaaaggccuucccauccgcuaucagaccacagcuaccaagucugagcauacagggcgggaaauuguggaccugaugugccacgccaccuuuacgaugagacugcucagcccuguucgcgugccgaauuacaaccugaucauuauggaugaggcucauuucacagaccccgccuccaucgccgcucggggauacauuucuaccagagucggcaugggggaagcggccgcuaucuuuaugacagccaccccucccggaacggccgaugcuuucccucagagcaaugcccccauccaggacgaggagcgcgacauuccggaacgguccuggaacucuggcaaugaguggaucaccgauuuugcggggaaaacagugugguucgugccuagcauuaaggcuggcaacgacaucgccaacugucuucgcaaaaauggaaagaaggucauucaacuguccagaaaaaccuuugauacagaauaucagaagaccaaacucaacgacugggauuucguugugacaaccgacaucucugagaugggcgccaauuuuaaggcugaucgggugauugaccccagacggugccugaaacccgucauccugacggaugggccugagcgcgugauccucgccggacccaugccuguuacagcggccagcgcugcccagagacggggccgcguggggagaaacccgcagaaggaaaaugaccaauacauuuucaccggacagccccuuaacaaugaugaggaccacgcucauuggaccgaagccaagaugcugcuggacaacaucaauacaccugagggcauuauccccgcucucuucgaaccugagcgggagaaauccgccgcgauugauggggaauauagacugaagggcgagagccgcaaaaccuuugucgaacuuaugcggagaggagaccugcccguguggcucgcccacaagguugcuucugagggcaucaaauacacagaucgcaaguggugcuucgacgggcagcggaacaaucagauccuggaagagaacauggauguggagauuuggacgaaagaaggagagaagaagaaacugagaccgcgcuggcucgacgcccggaccuauuccgauccucuugcucugaaggaauuuaaagacuucgccgccggcagaaagagcaucgcucuggaucucgucacagagauugggcgcgugcccucucaccuggcgcauagaacccggaaugcccuugacaaccuggucaugcuccacacauccgaacauggaggcaaggcuuaccgccacgccguggaggagcugccugaaaccauggagacgcugcuccuucugggccugaugauccuccugaccgggggagccaugcuuuuucugauuagcggcaaggggaucggaaagacauccaucggccucauuuguguuaucgcuucuagcgggaugcuguggauggccgaaauuccccugcaauggaucgcguccgccauugugcucgaguucuuuaugauggugcuucugaucccugagcccgaaaaacagagaaccccgcaggauaaucaacuggcuuaugucguuauuggaauccucacacuggccgcuaucauugccgcgaacgagaugggccuucuggaaaccacgaagcgggaccucggcaugagcaaagagccugggguggugucucccacauccuaccuggaugucgaccugcaccccgccagcgcuuggacccucuacgccguggcuacaaccguuaucaccccuaugcuucgccauacaauugaaaauucuacggccaacgugagccuggcugccaucgcgaaccaggccgucgugcugaugggacucgacaagggcuggccgauuuccaaaauggaucugggggucccccuucuggcucucggaugcuauucucaggugaauccucugacccugacagccgcuguucuccuucugaucacccacuacgccaucauuggccccgggcugcaggccaaggcgacaagagaggcucaaaagcggaccgccgcuggaaucaugaaaaacccuacgguggacggcauuaugacaaucgaucucgaccccgucauuuaugauagcaaguucgagaaacagcugggccaggugaugcuucugguucucugugccgugcagcugcugcucaugagaaccuccugggcccuuugcgaagcucugacccuggccacagggccuaucaccacacucugggagggaucuccgggcaaguuuuggaauacgaccaucgcggucagcauggccaacauuuuccgcggguccuaccuggcuggagccggccuugcuuuuagcaucaugaaaucuguggggacaggaaagcggggcaccggcucccaaggggaaacacugggagagaaguggaaaaagaaacucaaucagcugagcagaaaggaguucgaccuguauaaaaaguccggcauuaccgagguggaucgcacggaggccaaagaagggcucaagcggggagagaucacccaucacgcgguuucuagaggcagcgccaaacuucagugguuugucgaacggaacauggugauucccgaggggcgcgugaucgaccugggauguggcagaggcgggugguccuacuauugcgcuggacugaaaaaggucacagaaguucggggcuacaccaaagggggaccuggccaugaggagcccgugccuaugucuacauacggguggaauauugugaagcucaugagcggaaaagaugucuucuaucugcccccggaaaagugugacacccuucugugcgauaucggcgaguccagcccuucucccacaguggaagagucccgcaccaucagaguucucaagaugguggagcccuggcugaaaaacaaucaguucuguauuaagguccugaacccuuacaugcccacggugaucgaacaccucgagcggcuucaacgcaaacacggcgggaugcugguuagaaauccucugagccggaacucuacacaugaaauguauuggauuuccaauggaaccggcaacaucguggccagcgucaauauggugucucgccuccugcuuaacagauuuaccaugacacaccggagaccgacgauugagaaggacguggaucugggggcuggaacccgccaugucaacgccgaacccgagacaccuaauauggacguuaucggcgagcggaucaaaagaauuaaggaagaacacaacagcaccuggcacuacgacgaugaaaaucccuauaagacaugggcuuaccauggguccuaugaggugaaagccaccggaucugcgagcuccaugaucaacggcguggucaagcuccugacaaaaccuugggacgugguucccauggugacccagauggccaugacggauaccacaccguucggccagcaacgcgucuuuaaggaaaaaguggacacccggacaccuagaagcaugcccgggacccgccggguuaugggaauuacggcugaguggcuguggagaacacucggccgcaauaagaagccucggcugugcaccagagaggaguucaccaagaaggugcgcaccaacgccgcuaugggggccgucuuuacggaggaaaaucagugggauuccgccaaagcggcuguggaggacgaagauuucuggaaacuuguugaccgggagagagagcugcacaaacucggaaaguguggcucuugcguguacaacaugauggggaaacgcgaaaagaagcugggcgaguuuggaaaagccaagggcagcagagccaucugguacauguggcuuggggcucgguaucuggaguucgaggcccucggauuucugaaugaggaucauugguucucccgcgaaaacucuuacagcggcgucgagggggaaggacugcacaaacucggcuauauucugagagacaucuccaagauccccgggggcgcuauguacgccgaugacaccgcgggaugggacacacggauuaccgaggaugaccuucauaaugaagagaaaaucacacagcagauggauccugagcacagacaacuggccaacgcuauuuuuaagcucaccuaucagaauaagguggucaaagugcagcggcccacaccgaccggcacgguuauggacaucauuucucgcaaggaucagagagggagcggacaagugggcacauacgggcugaacaccuucaccaauauggaagcccagcuuauccggcagauggagggagaaggcguccuguccaaagcugaccucgagaacccucaucugcccgaaaagaaaaucacacaguggcuggagaccaaggggguggagcgccucaagagaauggccauuagcggcgaugacugcgugguuaaacccaucgaugaccgguuugcgaacgcccugcuugcucugaaugauaugggaaaggugcgcaaagacauuccucaauggcagccgucuaagggcuggcaugauuggcagcagguccccuucuguucccaccauuuccacgaacucaucaugaaagacgggagaaagcuggugguuccuugccggccccaagacgagcuuauuggacgcgccagaaucagccagggcgcuggguggucucugcgggaaacagccugucucggaaaggcuuaugcccagauguggucccugauguacuuucaccgcagagaucugcggcucgcgagcaacgccauuugcucugcugugccuguccauugggugcccacgucccgcaccacauggagcauccacgcccaucaccaauggaugaccacagaggacaugcugaccgucuggaauagaguguggaucgaagauaacccuuggauggaggacaaaacgcccguuaccacaugggagaaugugccguaccuuggcaagcgggaagaucaguggugugggucccugauuggccucaccagcagagccacaugggcucagaacaucccuaccgccauucagcaaguccgcucucugaucggaaaugaggaguuccuugacuauaugcccagcaugaaacgguuuagaaaggaggaggaauccgagggcgcgauuugguga

SEQ ID NO: 20665 - RNA, 9873 nt, Artificial Sequence
  derived and/or modified CDS sequence (opt5) from DENV-3__EU482563__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucgugcugcuuaugcugguuacaccuucuaugaccaugagaugugugggagucggcaaccgggacuuuguggaagggcucagcggagccacauggguggaugucguucuggagcacggcgggugcgugaccaccauggcuaagaauaaacccacacuggacaucgagcuccagaagacggaagccacccaacuggcgacacuucgcaaacuguguauugagggaaagaucaccaacauuacaaccgauuccagaugcccuacgcagggcgaagccgugcucccggaggaacaggaccagaauuaugucuguaaacacacauacguggaucggggcugggggaacggaugcggccuguucgggaagggaagccuuguuaccugcgcuaaguuucaaugucuggagcccaucgagggcaaagugguccaguaugaaaaucucaaguacaccgugauuaucacaguucauaccggggaccagcaccaggugggaaacgagacacaaggcgucacggccgaaaucaccccucaggcuucuacaaccgaggccauucugcccgaauauggcacacuggggcucgagugcuccccucgcaccggacuggacuucaaugagaugauccuucugacgaugaaaaacaaggccuggauggugcauagacagugguuuuucgaucucccccugccguggaccagcggcgcuacaaccgaaacaccuaccuggaaucggaaagagcuucuggucacguuuaagaacgcgcacgccaaaaagcaagaagugguugugcucgggucucaggagggagcuaugcacacagcccugaccggcgccacagaaauucagaauuccgggggcaccagcaucuucgcuggacaucugaagugucgccucaaaauggacaagcuggagcuuaaaggcaugucuuacgccaugugcaccaacacauuuguccugaagaaagagguguccgaaacgcagcacgggaccauucucaucaagguugaguacaagggagaagaugcgcccuguaaaaucccuuucagcacagaggacggccaagggaaggcucauaacggaagacugauuaccgccaaucccguggucacaaaaaaggaggaacccgugaacaucgaggccgaaccuccguucggcgaguccaauauugugaucgggauuggcgauaacgcucugaaaaucaauugguauaagaagggaucuagcaucggcaaaauguuugaagccaccgcucggggggccagacgcauggcgauucuuggagacacggccugggauuucggcuccguugggggaguccucaacagccugggcaagauggugcaccagaucuuugggucugcuuacacagcccuguucuccggcgugagcugggucaugaaaauuggaaucggcgugcuccugaccuggauugggcuuaauucuaagaacaccagcauguccuuuucuugcaucgcuauuggaaucaucacacuguaucucggcgccguugugcaggcggacaccgggugugucauuaauuggaaaggaaaggagcugaagugcggcagcgggaucuucgugacaaacgagguucauacguggaccgaacaguacaaauuucaagccgauucccccaagcggcuggcuacagccauugcuggcgccugggagaauggaguguguggcaucagaagcaccacacgcauggaaaaccuucucuggaaacaggucgccaaugagcugaacuauauucugugggaaaauaacaucaagcucaccgugguugugggggacaucauuggaguccuggagcagggcaaacggacgcuuaccccucagcccauggagcugaaguacucuuggaaaacaugggggaaggcuaagaucgugaccgcggaaacacaaaacuccagcuucauuaucgauggaccuaauacccccgagugcccgucugccuccagagcuuggaacgugugggaagucgaggacuauggcuuuggcguuuucacaaccaauauuuggcucaaacugcgcgaaguguacacgcagcugugugaccaccggcuuaugagcgccgccgugaaggaugagagagcuguccacgccgacaugggguacuggaucgagucccagaaaaacggaucuuggaagcucgaaaaagcgagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauucacgaguggugcugucgcagcugcacgcuuccgccucuccgguacaugggagaagauggcuguugguaugggauggagaucagacccaucucugaaaaggaggagaauaugguuaaaucccuggugagcgccggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcgcacacacugaucaugauuggauccaaugcuagcgacagaaugggcaugggggugaccuaccuggcccuuaucgccacguuuaaaauucagcccuuccuggcucucggauuuuuccugcggaagcucacaucuagagaaaaccugcuucugggcguggggcucgccauggcuaccacacugcaacugccugaggauaucgaacagauggccaauggaaucgcgcuuggccugauggcccucaaacugauuacccaguuugagaccuaucagcucuggacagcucugaucucccuuacguguagcaacaccauuuucacacugaccgucgccuggcgcacagcuacccucauccuggccggcguuucccugcuuccggugugccaaucuagcuccaugcggaagucugacuggcugcccaugacgguggccgcuaugggggucccuccccucccucuguuuauuuucagccucaaggauacacugaaaagacgcuccuggccccuuaaugagggagugauggcgguuggccuggugucuauccuggccagcucccuccugagaaacgacgucccuauggcugggccccuuguggccggaggccugcucaucgccuguuacguuauuaccgggaccagcgcugaucugacaguggaaaaggccgcggacgucaccugggaggaagaggcugaacagacaggagugucucauaaccucaugaucacggucgacgaugacggcaccaugcggauuaaagaugacgagacagagaauauccugaccgugcuucugaagacagcccugcucauuguuuccggcaucuuuccguacagcaucccugccacccugcuuguguggcacacguggcagaaacagacccgcagaucugggguccugugggaugugcccuccccucccgaaacacaaaaggcugagcucgaagagggaguuuaucggauuaaacagcagggcaucuucgggaagacccaggugggagucggcgugcaaaaggaggggguguuucauacaauguggcacguuacccgcggagccguccugacauacaacggcaaaagacucgaaccgaauugggcgagcgugaagaaagaccugauuucuuauggcgggggauggcggcuuuccgcucaguggcagaagggcgaggaagugcaagucaucgccguggagccugggaaaaaccccaagaauuuccagacgaugccuggaaccuuccagacaaccaccggcgaaauuggggccaucgcucuggauuuuaagcccggaacaagcggcucccccauuaucaaccgcgagggcaaaguuguggggcuguacggaaauggcgucgugacgaagaacgggggauauguuagcggcaucgcccagaccaaugcugagccugacgggccgacacccgaacucgaggaagagauguucaaaaagagaaaccugaccauuauggaucuucacccuggcucuggaaaaacacggaaguaccugcccgccaucgugcgcgaagcgauuaagagacggcucagaacccugauccucgccccuacgcgcgucguggcugccgagauggaggaagcucugaaaggccuucccauucgguaucaaacaaccgccaccaagagcgagcauacagggagagaaaucguugaccugaugugccacgccaccuuuacaaugcgccugcucuccccugugcgggucccgaauuacaaccugaucauuauggaugaggcucauuucaccgaccccgcgucuaucgccgcuagaggauacauuagcacgcgcgugggcaugggggaagccgccgcuaucuuuaugacagccaccccucccggaacagcggaugcuuucccucaguccaaugcccccauucaggacgaggagcgggacaucccggaaagaucuuggaacagcggcaaugaguggaucaccgauuuugccgggaaaacggugugguucgucccuuccauuaaggcuggcaacgacaucgccaacugucuucgcaaaaauggaaagaagguuauucagcugucucggaaaaccuuugauacagaauaucaaaagaccaaacucaacgacugggauuucguggugacaaccgacaucagcgagaugggcgcgaauuuuaaggccgauagagucauugacccccggcgcugccugaaacccgugauccugacagaugggccugagagaguuauucucgcuggacccaugccugugaccgccgcuuccgccgcucagcggcgcggcagagucgggcggaacccgcagaaggaaaaugaccaguacaucuucacgggacaaccccuuaacaaugaugaggaccacgcccauuggacagaagcgaagaugcugcuggacaacaucaauaccccugagggcauuauccccgcccucuucgaaccugagagagagaaaagcgcugccauugauggggaauaucgccugaagggcgagucucggaaaaccuuuguggaacuuaugagacgcggagaccugcccguuuggcucgcucacaagguggccuccgagggcaucaaauacacagaucggaaguggugcuucgacgggcagagaaacaaucagauucuggaagagaacauggaugucgagaucuggaccaaagaaggagagaagaagaaacugcgcccgcgguggcucgacgccagaacauauagcgauccucuugcucugaaggaauuuaaagacuucgcggccggccgcaagucuaucgcucuggaucucgugacggagauugggagaguccccucccaccuggcccaucggacccgcaaugcccuugacaaccuggugaugcuccacacaagcgaacauggaggcaaagcuuacagacacgccguugaggagcugccugaaaccauggagacacugcuccuucugggccugaugauccuccugaccgggggagcgaugcuuuuucugauuuccggcaaggggaucggaaagacgucuauuggccucaucugugugaucgccagcuccgggaugcuguggauggcugaaauuccccugcaguggaucgccagcgcuauugugcucgaguucuuuaugaugguccuucugaucccugagcccgaaaaacaacggaccccgcaggauaaucagcuggccuauguugugauuggaauccucacacuggcggccauuaucgcugccaacgagaugggccuucuggaaaccacaaagcgcgaccucggcaugucuaaagagccugggguggucucccccaccagcuaccuggauguggaccugcaccccgcuucugccuggacgcucuacgcuguugccacaaccgugaucacaccuaugcuuagacauaccauugaaaauagcaccgcgaacgucucccuggccgcuaucgccaaccaagcugugguccugaugggacucgacaagggcuggccgauuucuaaaauggaucugggggugccccuucuggcccucggaugcuauagccagguuaauccucugacacugacggccgcggugcuccuucugaucacccacuacgcuauuaucggccccgggcugcaggccaaggcuacacgggaggcccagaagagaaccgccgcuggaaucaugaaaaacccuacagucgacggcauuaugaccaucgaucucgaccccgugauuuaugauuccaaguucgagaaacaacugggccagguuaugcuucuggugcucugugccguccagcugcugcucaugcgcacgucuugggcgcuuugcgaagcccugacacuggcuaccgggccuaucaccacacucugggagggaagcccgggcaaguuuuggaauaccacaauugccguguccauggcuaacaucuuccgggggagcuaccuggccggagcgggccuugccuuuucuaucaugaaauccguggggacgggaaagagaggcaccggcagccagggggaaacacugggagagaaguggaaaaagaaacucaaucaacugucccgcaaggaauucgaccuguauaaaaagucuggcauuaccgagguugaucggacagaggcuaaagaagggcucaagagaggagagaucacccaucacgccgucagccggggcuccgcuaagcuucagugguuuguggaacgcaacauggugauucccgaggggagagucaucgaccugggauguggccggggcggguggucuuacuauugcgccggacugaaaaagguuacggaagugcgcggcuacaccaaagggggaccuggccaugaggagcccgugccuaugagcacauacggguggaauauugucaagcucauguccggaaaagauguguucuaucugcccccggaaaagugugacacccuucugugcgauaucggcgagagcucuccuucccccacaguugaagagagcagaaccauucgggugcucaagauggucgagcccuggcugaaaaacaaucaguucuguaucaaggugcugaacccuuacaugcccacaguuaucgaacaccucgagcgccuucagagaaaacacggcgggaugcuggugcggaauccucugucucgcaacuccacccaugaaauguauuggauuagcaauggaacgggcaacaucgucgcuucugugaauauggugagcagacuccugcuuaaccgguuuacaaugacccacagacgcccgaccauugagaaggacgucgaucugggggccggaacacggcauguuaacgcggaacccgagacgccuaauauggacgugaucggcgagagaauuaaacgcaucaaggaagagcacaacuccaccuggcacuacgacgaugaaaaucccuauaagacaugggccuaccaugggucuuaugaggugaaagcuaccggaagcgccuccagcaugaucaacggcgucgugaagcuccugacaaaaccuugggacguugugcccauggucacccaaauggcuaugacagauaccacgccguucggccagcagcggguguuuaaggaaaaaguugacaccagaacaccucgcuccaugcccgggacccggagagugaugggaauuacagccgaguggcuguggcgcacccucggccggaauaagaagccuagacugugcacgcgcgaggaauucacaaaaaagguccggaccaacgccgcgaugggggcuguguuuacagaggaaaaucaaugggauucugccaaagccgcuguugaggacgaagauuucuggaagcuuguggacagagagcgcgagcugcacaaacucggaaaguguggcagcugcgucuacaacaugauggggaaaagagaaaagaagcugggcgaguuuggaaaagccaagggcucccgggcuaucugguacauguggcuuggggcccgcuaucuggaauucgaggcgcucggauuucugaaugaggaucauugguucucuagagaaaacagcuacuccggcguggagggggaaggacugcacaaacucggcuauauucugcgggacaucucuaagauucccgggggcgccauguacgcugaugacaccgccggaugggacacgagaaucaccgaggaugaccuucauaaugaagagaaaaucacacagcagauggauccugagcaccggcagcuggcuaacgccauuuuuaagcucaccuaucaaaauaaggucgugaaaguucagcgccccacaccgaccggcacagugauggacaucauuagcagaaaggaucagcggggguccggacaggucggcaccuacgggcugaacacguucacaaauauggaagcgcaacuuauccgccagauggagggagaaggcgugcugaccaaagccgaccucgagaacccucaccugagcgaaaagaaaauuacccaguggcuggagacaaaggggguggagagacucaagcggauggcuaucucuggcgaugacugcguugugaaacccaucgaugaccgcuuugccaacgcucugcuugcccugaaugauaugggaaaggucagaaaagacauuccccaguggcaaccuuccaagggcuggcaugauuggcagcaggugccguucuguagccaccauuuccacgaacucaucaugaaagacgggcggaagcugguugugcccugccgcccucaggacgagcuuauuggaagagcucggaucucucaaggcgccggguggucccugcgcgaaaccgcgugucucggaaaggccuaugcucagauguggagccugauguacuuucacagacgggaucugcgccucgccucuaacgccauuugcuccgcuguccccgugcauugggucccuacaagcagaacgaccugguccauccacgcccaucaccaguggaugacaaccgaggacaugcugacaguguggaaucggguuuggauugaagauaaccccuggauggaggacaaaaccccugugacgaccugggagaauguccccuaccuuggcaagagagaagaucaauggugugggagccugaucggccucacaucucgcgcgaccugggcucagaacaucccgacagccauucagcaggugcggagccugaucggaaaugaggaauuccuugacuauaugccuuccaugaaaagauuucgcaaggaggaggaaucugagggcgccauuugguga

SEQ ID NO: 20666 - RNA, 9873 nt, Artificial Sequence
  derived and/or modified CDS sequence (opt5) from DENV-3__EU529696__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggcccggggggcuagacgcauggccauccuuggagacacagcgugggauuucggcuccguggggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggagugaucacccuguaucucggcgcuguugugcaggccgacauggggugugucauuaauuggaaaggaaaggagcugaagugcggcagcgggaucuucgugacaaacgagguucauacguggaccgaacaguacaaauuucaagcggauucccccaagcggcuggccacagcuauugccggcgcuugggagaauggaguguguggcaucagaagcaccacacgcauggaaaaccuucucuggaaacagauugccaaugagcugaacuauauccugugggaaaauaacaucaagcucaccgucgugguuggggacauuaucggagugcuggagcagggcaaacggacgcuuaccccucagcccauggagcugaaguacucuuggaaaacaugggggaaggccaagauugucaccgcugaaauccaaaacuccagcuucauuaucgauggaccuaauacacccgagugcccgucugcguccagagccuggaacgugugggaaguggaggacuauggcuuuggcgucuucaccacaaauaucuggcucaaacugcgcgaaguuuacacccagcugugugaccaccggcuuaugagcgcugccgugaaggaugagagagccgugcacgcugacaugggguacuggauugagucccagaaaaacggaucuuggaagcucgaaaaagccagccugaucgaggucaagacgugcacauggccuaagucccauacccuguggucuaauggcgugcucgaaagcgauaugauuauccccaaaucccuggcggggccuauuagccagcacaacuaucgccccggauaccauacccaaacagcuggcccuuggcaccuugggaagcuggaccucgauuuuaauuauugcgagggaaccacgguugugaucacagagaacuguggcacccggggccccucucugagaacaaccacagucuccgggaaacugauccacgaauggugcugucgcagcugcacccuuccgccucuccgguacaugggagaggacggcuguugguaugggauggaaauuagacccaucucugagaaggaagagaauauggugaaaucccugguuagcgccggaucuggcaagguggauaacuucacgauggggguccugugccucgccauucuguuugaggaagugaugcggggaaaguucggcaaaaagcauaugaucgcuggcguuuucuuuaccuucgugcuucugcucagcgggcagauuacauggcgcgacauggcccacacccugaucaugauuggauccaaugcgagcgauaaaaugggcaugggggucacauaccuggcucuuaucgccaccuuuaagauccagcccuuccuggcccucggauuuuuccugagaaaacucacgucucgggagaaccugcuucugggcguggggcucgcuauggccacaacccugcaacugccugaagacauugagcagauggcuaauggaaucgcccuuggccugauggcgcucaagcugauuacacaguuugaaaccuaucagcucuggaccgcccugaucucccuuacauguagcaacacgauguucacccugacaguggcuuggagaaccgccacacucauucuggcuggcgucucccugcuuccgguuugccaaucuagcuccaugcgcaagaccgauuggcugcccauggccguggccgcuaugggggugccuccccucccucuguuuaucuucucucucaaagacacgcugaagcggagaagcuggccccuuaaugagggagucauggcggugggccugguuuccauccuggccucuagccuccugcgcaacgaugugccuauggcugggccccuugucgccggaggccugcucauugccuguuacgugaucacagggaccuccgcugaccugaccguugagaaagccgcggacauuacaugggaagaggaagcugagcagaccggagugagccauaaccucaugaucacagucgaugacgauggcacgaugagaauuaaggacgaugaaaccgagaauauccugacagugcuucugaaaaccgcccugcucaucgucucuggcguguuuccguacuccauuccugccacacugcuuguuuggcacaccuggcagaagcagacgcaacggagcggggugcugugggacguccccucuccucccgagacccagaaagcugaacucgaggaaggaguguaucgcaucaagcagcagggcauuuucgggaagacacaaguuggagugggcguccagaaagaggggguguuucauaccauguggcacgugacaagaggagccguucugaccuacaacggcaagcggcucgagccgaauugggcguccgucaaaaaggaucugaucagcuauggcgggggauggcgccuuucugcucaguggcaaaaaggcgaagaggugcaggugauugccgucgaaccugggaagaaccccaagaauuuccagacaaugccuggaacguuccagaccacaaccggcgagaucggggccauugcucuggacuuuaaacccggaaccuccggcagccccaucaucaacagagaaggcaaggugguugggcuguacggaaauggcguggucacaaaaaacgggggauauguguccggcauugcccaaacgaaugcugagccugaugggccgacccccgagcucgaagaggaaauguucaagaaacggaaccugacaaucauggaccuucacccuggcagcggaaagacccgcaaguaccugcccgccguugugagagaggcgauuaaacggcgccucagaacacugauccucgccccuacccgggucguggcugccgaaauggaggaggcucugaagggccuucccauuagauaucagacgacagccaccaaaucugaacauaccgggcgcgagaucguugaucugaugugccacgccacauuuaccaugcggcugcucagcccugugagagucccgaauuacaaccugaucauuauggacgaagcucauuucacagaucccgcguccaucgccgcucgcggauacauuucuacccgggugggcaugggggaggccgccgcuaucuuuaugacggccacaccucccggaaccgcggacgcuuucccucagagcaaugcccccauucaggacgaagagagagauaucccggagcgcuccuggaacucuggcaaugaauggaucacagacuuugccgggaagaccgugugguucgucccuagcauuaaagcuggcaacgauaucgccaacugucuucggaagaauggaaagaaaguuauucaacuguccagaaagacguuugacaccgaguaucagaaaacaaagcucaacgauugggacuucguggugaccacagauaucucugaaaugggcgcgaauuuuaaagccgaccgcgucauugauccccggagaugccugaagcccgugauccugaccgacgggccugagcggguuauucucgcuggacccaugccugugacagccgcuagcgccgcucagcgcagaggccgggucgggcgcaacccgcagaaggagaaugaucaauacaucuucaccggacagccccuuaacaaugacgaagaccacgcccauuggacggaggcgaaaaugcugcuggauaacaucaauacaccugaaggcauuauccccgcccucuucgagccugaaagagagaaguccgcugccauugacggggaguaucggcugaaaggcgaaagcagaaagaccuuuguggagcuuaugcgccggggagaucugcccguuuggcucgcucacaaaguggccucugaaggcaucaaguacaccgacagaaaauggugcuucgaugggcagcgcaacaaucagauucuggaggaaaacauggacgucgagaucuggacaaaggagggagaaaagaaaaagcugcggccgagauggcucgaugcccgcaccuauuccgacccucuugcucugaaagaguuuaaggauuucgcggccggccggaaaagcaucgcucuggaccucgugacagaaauugggagaguccccucucaccuggcccaucgcacgagaaaugcccuugauaaccuggugaugcuccacaccuccgagcauggaggccgggcuuaccgccacgccguugaagagcugccugagacaauggaaacccugcuccuucugggccugaugauccuccugacagggggagcgaugcuuuuucugauuagcggcaaggggaucggaaagaccuccauuggccucaucugugugaucgccucuagcgggaugcuguggauggcugagauuccccugcaauggaucgccuccgcuauugugcucgaauucuuuaugaugguccuucugaucccugagcccgagaaacagagaacgccgcaggacaaucaacuggccuauguugugauuggaauccucacccuggcggccauuaucgcugccaacgaaaugggccuucuggagacaaccaagcgggaucucggcaugagcaaagaaccugggguggucucucccacauccuaccuggacguggaccugcaccccgcuagcgccuggacccucuacgcuguugccacgacagugaucaccccuaugcuucgccauacaauugagaauucuaccgcgaacgucagccuggccgcuaucgccaaccaggcugugguccugaugggacucgauaagggcuggccgauuuccaaaauggaccugggggugccccuucuggcccucggaugcuauucucagguuaauccucugacccugacagccgcggugcuccuucugaucacgcacuacgcuauuaucggccccgggcugcaggccaaggcuaccagagaagcccaaaagcggacagccgcuggaaucaugaaaaacccuaccgucgauggcauuaugacaaucgaccucgaucccgugauuuaugacagcaaguucgagaaacagcugggccagguuaugcuucuggugcucugugccguccagcugcugcucaugagaaccuccugggcgcuuugcgaggcccugacgcuggcuacagggccuaucaccacccucugggaaggaucuccgggcaaguuuuggaauacaaccauugccgugagcauggcuaacaucuuccgcggguccuaccuggccggagcgggccuugccuuuagcaucaugaaaucuguggggacaggaaagcggggcacgggcucccaaggggagacccugggagaaaaguggaaaaagaaacucaaucagcugagcagaaaggaguucgaucuguauaaaaaguccggcauuacagaaguugaccgcaccgaggcuaaagaggggcucaagcggggagaaacaacccaucacgccgucucuagaggcacggcuaagcuucagugguuuguggagcggaacauggugauccccgaagggcgcgucauugaucugggauguggcagaggcggguggagcuacuauugcgccggacugaaaaagguuaccgaggugcggggcuacacaaaagggggaccuggccaugaagagcccgugccuauguccaccuacggguggaauaucgucaagcucaugucuggaaaagacguguucuaucugcccccggagaagugugauacacuucugugcgacauuggcgaaagcuccccuagccccaccguugaggaaucucgcacaaucagagugcucaagauggucgagcccuggcugaaaaacaaucaguucuguauuaaggugcugaacccuuacaugcccaccguuaucgagcaccucgaacggcuucaacgcaaacacggcgggaugcuggugagaaauccucugucccggaacagcacgcaugagauguauuggaucucuaauggaacaggcaacauugucgcuuccgugaauauggugagccgccuccugcuuaacagauuuaccaugacccaccggagaccgacaaucgaaaaggaugucgaccugggggccggaacgcgccauguuaacgcggagcccgaaaccccuaauauggacgugauuggcgagcggaucaaaagaauuaaggaggaacacaacucuacauggcacuacgaugacgagaaucccuauaagaccugggccuaccaugggagcuaugaagugaaagcuacaggauccgccucuagcaugaucaacggcgucgugaagcuccugaccaaaccuugggauguugugcccauggucacacagauggcuaugaccgacacgaccccguucggccagcaacgcguguuuaaggagaaaguugauacacggaccccuagauccaugcccgggacacgccgggugaugggaaucaccgccgaauggcuguggagaacgcucggccgcaauaagaagccucggcugugcacaagagaggaguucaccaaaaagguccgcacaaacgccgcgaugggggcuguguuuaccgaagagaaucagugggacagcgccaaagccgcuguugaagaugaggacuucuggaagcuuguggaucgggaaagagagcugcacaaacucggaaaguguggcuccugcgucuacaacaugauggggaaacgcgagaagaagcugggcgaauuuggaaaagccaagggcucuagagcuauuugguacauguggcuuggggcccgguaucuggaguucgaagcgcucggauuucugaaugaggaccauugguucagccgcgagaacuccuacucuggcguggaaggggagggacugcacaaacucggcuauauccugagagauauuagcaagauccccgggggcgccauguacgcugacgacacggccggaugggauacccggauuacagaagacgaucuucauaaugaggaaaaaaucacccagcagauggacccugagcacagacaacuggcuaacgccaucuuuaagcucacauaucagaauaaggucgugaaaguucagcggcccaccccgacaggcaccgugauggauauuaucucccgcaaggaccagagagggucuggacaagucggcacguacgggcugaacacauucaccaauauggaggcgcagcuuauucggcagauggaaggagagggcgugcugagcaaagccgaucucgaaaacccucaccugcccgagaagaaaaucacccaguggcuggaaacaaaggggguggagcgccucagacggauggcuauuuccggcgacgauugcguugugaagcccaucgacgaucgcuuugccaacgcucugcuugcccugaaugacaugggaaaagucagaaaggauaucccucaauggcagccgagcaaaggcuggcaugacuggcagcaggugcccuucuguucucaccauuuccacgagcucauuaugaaggacgggcggaaacugguugugccuugccgcccccaagaugaacuuaucggaagagcucggauuucccagggcgccggguggagccugcgcgagaccgcgugucucggaaaggccuaugcucagauguggucucugauguacuuucacagacgggaccugcgccucgccuccaacgccaucugcagcgcugucccugugcauuggguccccacaucuagaacgaccugguccauucacgcccaucaccaauggaugacaaccgaagauaugcugacaguguggaaucggguuuggaucgaggacaacccuuggauggaagauaagacccccgugacgaccugggagaaugucccguaccuuggcaaaagagaggaccaguggugugggagccugauuggccucacaucccgcgcgaccugggcucagaacaucccuacagccauccagcaagugcggagccugauuggaaaugaagaguuccuugauuauaugcccucuaugaagagauuucgcaaagaagaggagagcgaaggcgccaucugguga

SEQ ID NO: 20667 - RNA, 9873 nt, Artificial Sequence
  derived and/or modified CDS sequence (opt5) from DENV-3__EU529697__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucgugcugcuuaugcugguuacaccuucuaugaccaugagaugugugggagucggcaaccgggacuuuguggaagggcucagcggagccacauggguggaugucguucuggagcacggcgggugcgugaccaccauggcuaagaauaaacccacacuggacaucgagcuccagaagacggaagccacccaacuggcgacacuucgcaaacuguguauugagggaaagaucaccaacauuacaaccgauuccagaugcccuacgcagggcgaagccgcucucccggaggaacaggaccagaauuauguguguaaacacacauacgucgaucggggcugggggaacggaugcggccuguucgggaagggaagccuugugaccugcgccaaguuucaaugucuggagcccaucgagggcaaaguugugcaguaugaaaaucucaaguacaccgucauuaucacagugcauaccggggaccagcaccagguuggaaacgagacacaaggcgugacggcugaaaucaccccucaggccucuacaaccgaggccauucugcccgaauauggcacacuggggcucgagugcuccccucgcaccggacuggacuucaaugagaugauccuucugacgaugaaaaacaaggcuuggaugguccauagacagugguuuuucgaucucccccugccguggaccagcggcgcgacaaccgaaacaccuaccuggaaucggaaagagcuucuggugacguuuaagaacgcccacgcuaaaaagcaagaagucgugguucucgggucucaggagggagccaugcacacagcccugaccggcgcuacagaaauucagaauuccgggggcaccagcaucuucgccggacaucugaagugucgccucaaaauggacaagcuggagcuuaaaggcaugucuuacgcgaugugcaccaacacauuugugcugaagaaagaggucuccgaaacgcagcacgggaccauucucaucaagguggaguacaagggagaagaugcucccuguaaaaucccuuucagcacagaggacggccaagggaaggcccauaacggaagacugauuaccgccaaucccguugugacaaaaaaggaggaacccgucaacaucgaggcugaaccuccguucggcgaguccaauauugugaucgggauuggcgauaacgcccugaaaaucaauugguauaagaagggaucuagcaucggcaaaauguuugaagcuaccgcccggggggcgagacgcauggccauucuuggagacacggcuugggauuucggcuccguggggggaguucucaacagccugggcaagaugguccaccagaucuuugggucugccuacacagcucuguucuccggcgugagcugggugaugaaaauuggaaucggcguccuccugaccuggauugggcuuaauucuaagaacaccagcauguccuuuucuugcaucgccauuggaaucaucacacuguaucucggcgcggugguucaggccgacaccgggugugugauuaauuggaaaggaaaggagcugaagugcggcagcgggaucuucgucacaaacgaggugcauacguggaccgaacaguacaaauuucaagcugauucccccaagcggcuggccacagcuauugccggcgccugggagaauggaguuuguggcaucagaagcaccacacgcauggaaaaccuucucuggaaacagguggcuaaugagcugaacuauauucugugggaaaauaacaucaagcucaccgucgugguuggggacaucauuggagugcuggagcagggcaaacggacgcuuaccccucagcccauggagcugaaguacucuuggaaaacaugggggaaggcgaagaucgucaccgccgaaacacaaaacuccagcuucauuaucgauggaccuaauacccccgagugcccgucugcuuccagagccuggaacgugugggaaguggaggacuauggcuuuggcgucuucacaaccaauauuuggcucaaacugcgcgaaguuuacacgcagcugugugaccaccggcuuaugagcgccgcugugaaggaugagagagccgugcacgcggacaugggguacuggaucgagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgccggcccuuggcaccuugggaagcuggagcucgacuuuaauuauugcgagggaacgacaguugugaucaccgaaaacuguggcacacggggccccucucugagaaccacaaccgucuccgggaaacugauucacgaguggugcugucgcagcugcacgcuuccgccucuccgguacaugggagaagauggcuguugguaugggauggagaucagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcauaugaucgcgggcguuuucuuuacauucgugcuucugcucagcgggcagauuaccuggcgcgauauggcucacacacugaucaugauuggauccaaugccagcgacagaaugggcaugggggucacccaucuggcccuuaucgcuacguuuaaaauucagcccuuccuggcccucggauuuuuccugcggaagcucacaucuagagaaaaccugcuucugggcguggggcucgcuauggccaccacacugcaacugccugaggauaucgaacagauggcgaauggaaucgcccuuggccugauggcucucaaacugauuacccaguuugagaccuaccagcucuggacagcccugaucucccuuacguguagcaacaccauuuucacacugaccguggcuuggcgcacagccacccucauccuggccggcgucucccugcuuccgguuugccaaucuagcuccaugcggaagucugacuggcugcccaugacgguggcugcgaugggggugccuccccucccucuguuuauuuucagccucaaggauacacugaaaagacgcuccuggccccuuaaugagggagucauggccgugggccugguuucuauccuggcuagcucccuccugagaaacgacgugccuauggccgggccccuugucgccggaggccugcucaucgcuuguuaugugauuaccgggaccagcgccgaucugacaguugaaaaggcggcugacgugaccugggaggaagaggccgaacagacaggagucucucacaaccucaugaucacgguggacgaugacggcaccaugcggauuaaagaugacgagacagagaauauccugaccguccuucugaagacagcccugcucauuguguccggcaucuuuccguacagcaucccugcuacccugcuuguuuggcauacguggcagaaacagacccgcagaucuggggugcugugggauguccccuccccucccgaaacacaaaaggccgagcucgaagagggaguguaccggauuaaacagcagggcaucuucgggaagacccagguuggagugggcguccaaaaggaggggguguuucacacaauguggcacgugacccgcggagcgguucugacauauaacggcaaaagacucgaaccgaauugggcuagcgucaagaaagaccugauuucuuacggcgggggauggcggcuuuccgcccaguggcagaagggcgaggaagugcaagugaucgccgucgagccugggaaaaaccccaagaauuuccagacgaugccuggaaccuuccagacaaccaccggcgaaauuggggcuaucgcccuggauuuuaagcccggaacaagcggcucccccauuaucaaccgcgagggcaaagugguugggcuguauggaaauggcguggucacgaagaacgggggauacgugagcggcaucgcucagaccaaugccgagccugacgggccgacacccgaacucgaggaagagauguucaaaaagagaaaccugaccauuauggaucuucauccuggcucuggaaaaacacggaaguaucugcccgcgaucguucgcgaagccauuaagagacggcucagaacccugauccucgcuccuacgcgcguggucgccgcugagauggaggaagcccugaaaggccuucccauucgguaccaaacaaccgccaccaagagcgagcacacagggagagaaaucguggaccugaugugccaugcuaccuuuacaaugcgccugcucuccccuguucgggugccgaauuauaaccugaucauuauggaugaggcgcacuucaccgaccccgccucuaucgcugccagaggauacauuagcacgcgcgucggcaugggggaagccgcugccaucuuuaugacagcgaccccucccggaacagcugaugccuucccucaguccaaugcccccauucaggacgaggagcgggacaucccggaaagaucuuggaacagcggcaaugaguggaucaccgauuuugcugggaaaacggugugguucgugccuuccauuaaggccggcaacgacaucgcgaacugucuucgcaaaaauggaaagaaggucauucagcugucucggaaaaccuuugauacagaauaccaaaagaccaaacucaacgacugggauuucguugugacaaccgacaucagcgagaugggcgccaauuuuaaggcugauagagugauugacccccggcgcugccugaaacccgucauccugacagaugggccugagagagugauucucgccggacccaugccuguuaccgcugccuccgcugcccagcggcgcggcagaguggggcggaacccgcagaaggaaaaugaccaguauaucuucacgggacaaccccuuaacaaugaugaggaccaugcgcacuggacagaagccaagaugcugcuggacaacaucaauaccccugagggcauuauccccgcucucuucgaaccugagagagagaaaagcgccgcuauugauggggaauaccgccugaagggcgagucucggaaaaccuuugucgaacuuaugagacgcggagaccugcccguguggcucgcccacaagguugccuccgagggcaucaaauauacagaucggaaguggugcuucgacgggcagagaaacaaucagauucuggaagagaacauggauguggagaucuggaccaaagaaggagagaagaagaaacugcgcccgcgguggcucgacgcuagaacauacagcgauccucuugcgcugaaggaauuuaaagacuucgccgcuggccgcaagucuaucgcccuggaucucgucacggagauugggagagugcccucccaucuggcccaccggacccgcaaugcucuugacaaccuggucaugcuccauacaagcgaacacggaggcaaagccuauagacacgcgguggaggagcugccugaaaccauggagacacugcuccuucugggccugaugauccuccugaccgggggagccaugcuuuuucugauuuccggcaaggggaucggaaagacgucuauuggccucaucuguguuaucgcuagcuccgggaugcuguggauggccgaaauuccccugcaguggaucgcuagcgccauugugcucgaguucuuuaugauggugcuucugaucccugagcccgaaaaacaacggaccccgcaggauaaucagcuggcguacgucguuauuggaauccucacacuggccgcuauuaucgccgcuaacgagaugggccuucuggaaaccacaaagcgcgaccucggcaugucuaaagagccugggguggugucccccaccagcuaucuggaugucgaccugcaucccgccucugcuuggacgcucuacgccguggcgacaaccguuaucacaccuaugcuuagacacaccauugaaaauagcaccgccaacgugucccuggcugccaucgcuaaccaagccgucgugcugaugggacucaauaagggcuggccgauuucuaaaauggaccugggggucccccuucuggcccucggaugcuacagccaggugaacccucugacacugacggcggcuguucuccuucugaucacccauuaugccauuaucggccccgggcugcaggcuaaggccacacgggaggcccagaagagaaccgcugccggaaucaugaaaaauccuacaguggauggcauuaugaccaucgaccucgaucccgucauuuacgacuccaaguucgagaaacaacugggccaggugaugcuucugguucucugugcggugcagcugcugcucaugcgcacgucuugggcccuuugcgaagcucugacacuggccaccgggccuaucaccacacucugggagggaagcccgggcaaguuuuggaacaccacaauugcugucuccauggccaauaucuuccgggggagcuaucuggcgggagccggccuugcuuuuucuaucaugaaauccguggggacgggaaagagaggcaccggcagccagggggaaacacugggagagaaguggaaaaagaaacucaaccaacugucccgcaaggaauucgaucuguacaaaaagucuggcauuaccgagguggaccggacagaggccaaagaagggcucaagagaggagagaucacccaccaugcuguuagccggggcuccgccaagcuucagugguuugucgaacgcaauauggugauucccgaggggagagugaucgaucugggauguggccggggcggguggucuuauuacugcgcuggacugaaaaaggucacggaaguucgcggcuauaccaaagggggaccuggccacgaggagcccgugccuaugagcacauacggguggaacauugugaagcucauguccggaaaagacgucuucuaccugcccccggaaaagugugauacccuucugugcgacaucggcgagagcucuccuucccccacaguggaagagagcagaaccauucggguucucaagaugguggagcccuggcugaaaaauaaccaguucuguaucaagguccugaauccuuauaugcccacagugaucgaacaccucgagcgccuucagagaaaacauggcgggaugcugguucggaacccucugucucgcaauuccacccacgaaauguacuggauuagcaacggaacgggcaauaucguggccucugucaacauggugagcagacuccugcuuaaccgguuuacaaugacccauagacgcccgaccauugagaaggauguggaccugggggcgggaacacggcacgucaaugccgaacccgagacgccuaacauggauguuaucggcgagagaauuaaacgcaucaaggaagagcacaauuccaccuggcauuaugacgacgaaaaccccuacaagacaugggcuuaucacgggucuuacgaggugaaagccaccggaagcgcuuccagcaugaucaauggcguggucaagcuccugacaaaaccuugggaugugguucccauggugacccaaauggccaugacagacaccacgccguucggccagcagcgggucuuuaaggaaaaaguggauaccagaacaccucgcuccaugcccgggacccggagaguuaugggaauuacagccgaguggcuguggcgcacccucggccggaacaagaagccuagacugugcacgcgcgaggaauucacaaaaaaggugcggaccaaugcggcuaugggggccgucuuuacagaggaaaaccaaugggacucugccaaagcugccguggaggaugaagacuucuggaagcuuguugauagagagcgcgagcugcauaaacucggaaaguguggcagcugcguguauaauaugauggggaaaagagaaaagaagcugggcgaguuuggaaaagcuaagggcucccgggccaucugguacauguggcuuggggcgcgcuaccuggaauucgaggcccucggauuucugaacgaggaccacugguucucuagagaaaauagcuauuccggcgucgagggggaaggacugcauaaacucggcuacauucugcgggauaucucuaagauucccgggggcgcuauguaugccgacgauaccgcuggaugggacacgagaaucaccgaggacgaucuucacaacgaagagaaaaucacacagcagauggacccugagcaccggcagcuggccaaugcgauuuuuaagcucaccuaccaaaacaagguggucaaagugcagcgccccacaccgaccggcacaguuauggauaucauuagcagaaaggaccagcggggguccggacaggugggcaccuaugggcugaauacguucacaaacauggaagcccaacuuauccgccagauggagggagaaggcguccugaccaaagcugaucucgagaacccucaucugagcgaaaagaaaauuacccaguggcuggagacaaaggggguggagagacucaagcggauggccaucucuggcgacgauugcgugguuaaacccaucgacgaucgcuuugcuaaugcccugcuugcucugaacgacaugggaaaggugagaaaagauauuccccaguggcaaccuuccaagggcuggcacgacuggcagcaggucccguucuguagccaucacuuccacgaacucaucaugaaagaugggcggaagcuggugguucccugccgcccucaggacgagcuuauuggaagagcccggaucucucaaggcgcgggguggucccugcgcgaaaccgccugucucggaaaggcuuacgcccagauguggagccugauguauuuucauagacgggaccugcgccucgccucuaaugcuauuugcuccgccgugcccguccacugggugccuacaagcagaacgaccugguccauccaugcgcaccaucaguggaugacaaccgaggauaugcugacagucuggaaccggguguggauugaagacaaucccuggauggaggauaaaaccccuguuacgaccugggagaacgugcccuaccuuggcaagagagaagaccaauggugugggagccugaucggccucacaucucgcgcuaccugggcccagaauaucccgacagccauucagcagguccggagccugaucggaaacgaggaauuccuugauuacaugccuuccaugaaaagauuucgcaaggaggaggaaucugagggcgcuauuugguga

SEQ ID NO: 20668 - RNA, 9873 nt, Artificial Sequence
  derived and/or modified CDS sequence (opt5) from DENV-3__EU482564__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggcccggggggcuagacgcauggccauccuuggagacacagcgugggauuucggcuccguggggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggagugaucacccuguaucucggcgcuguugugcaggccgacauggggugugucauuaauuggaaaggaaaggagcugaagugcggcagcgggaucuucgugacaaacgagguucauacguggaccgaacaguacaaauuucaagcggauucccccaagcggcuggccacagcuauugccggcgcuugggagaauggaguguguggcaucagaagcaccacacgcauggaaaaccuucucuggaaacagauugccaaugagcugaacuauauccugugggaaaauaacaucaagcucaccgucgugguuggggacauuaucggagugcuggagcagggcaaacggacgcuuaccccucagcccauggagcugaaguacucuuggaaaacaugggggaaggccaagauugucaccgcugaaauccaaaacuccagcuucauuaucgauggaccuaauacacccgagugcccgucugcguccagagccuggaacgugugggaaguggaggacuauggcuuuggcgucuucaccacaaauaucuggcucaaacugcgcgaaguuuacacccagcugugugaccaccggcuuaugagcgcugccgugaaggaugagagagccgugcacgcugacaugggguacuggauugagucccagaaaaacggaucuuggaagcucgaaaaagccagccugaucgaggucaagacgugcacauggccuaagucccauacccuguggucuaauggcgugcucgaaagcgauaugauuauccccaaaucccuggcggggccuauuagccagcacaacuaucgccccggauaccauacccaaacagcuggcccuuggcaccuugggaagcuggaccucgauuuuaauuauugcgagggaaccacgguugugaucacagagaacuguggcacccggagacccucucugcgcacaaccacagucuccggcaaacugauccacgaauggugcugucggagcugcacccuuccgccucucagauacaugggggaggacggauguugguauggcauggaaauucggcccaucucugagaaggaagagaauauggugaaaucccugguuagcgccgggucuggaaagguggauaacuucacgaugggcguccugugccucgccauucuguuugaggaagugaugcgcgggaaguucggaaaaaagcauaugaucgcuggcguuuucuuuaccuucgugcuucugcucagcggccagauuacauggagagacauggcccacacccugaucaugauuggguccaaugcgagcgauaaaaugggaaugggcgucacauaccuggcucuuaucgccaccuuuaagauccagcccuuccuggcccucggguuuuuccugcggaaacucacgucuagagagaaccugcuucugggagugggccucgcuauggccacaacccugcaacugccugaagacauugagcagauggcuaaugggaucgcccuuggacugauggcgcucaagcugauuacacaguuugaaaccuaucagcucuggaccgcccugaucucccuuacauguagcaacacgauguucacccugacaguggcuuggcgcaccgccacacucauucuggcuggcgucucccugcuuccgguuugccaaucuagcuccaugcggaagaccgauuggcugcccauggccguggccgcuaugggcgugccuccccucccucuguuuaucuucucucucaaagacacgcugaagagacgcagcuggccccuuaaugagggggucauggcggugggacugguuuccauccuggccucuagccuccugagaaacgaugugccuauggcuggcccccuugucgccgggggacugcucauugccuguuacgugaucacaggcaccuccgcugaccugaccguugagaaagccgcggacauuacaugggaagaggaagcugagcagaccggggugagccauaaccucaugaucacagucgaugacgauggaacgaugcggauuaaggacgaugaaaccgagaauauccugacagugcuucugaaaaccgcccugcucaucgucucuggcguguuuccguacuccauuccugccacacugcuuguuuggcacaccuggcagaagcagacgcaacgcagcggcgugcugugggacguccccucuccucccgagacccagaaagcugaacucgaggaagggguguauagaaucaagcagcagggaauuuucggcaagacacaaguuggggugggaguccagaaagagggcguguuucauaccauguggcacgugacacggggggccguucugaccuacaacggaaagcgccucgagccgaauugggcguccgucaaaaaggaucugaucagcuauggcggcggguggagacuuucugcucaguggcaaaaaggagaagaggugcaggugauugccgucgaaccuggcaagaaccccaagaauuuccagacaaugccugggacguuccagaccacaaccggagagaucggcgccauugcucuggacuuuaaacccgggaccuccggaagccccaucaucaaccgggaaggcaaggugguuggccuguacgggaauggaguggucacaaaaaacggcggguauguguccggaauugcccaaacgaaugcugagccugauggcccgacccccgagcucgaagaggaaauguucaagaaacgcaaccugacaaucauggaccuucacccugggagcggcaagaccagaaaguaccugcccgccguugugcgggaggcgauuaaacgcagacuccggacacugauccucgccccuaccagagucguggcugccgaaauggaggaggcucugaagggacuucccauucgcuaucagacgacagccaccaaaucugaacauaccggccgggagaucguugaucugaugugccacgccacauuuaccaugagacugcucagcccugugcgcgucccgaauuacaaccugaucauuauggacgaagcucauuucacagaucccgcguccaucgccgcucggggguacauuucuaccagagugggaaugggcgaggccgccgcuaucuuuaugacggccacaccucccgggaccgcggacgcuuucccucagagcaaugcccccauucaggacgaagagcgcgauaucccggagcgguccuggaacucuggaaaugaauggaucacagacuuugccggcaagaccgugugguucgucccuagcauuaaagcugggaacgauaucgccaacugucuuagaaagaauggcaagaaaguuauucaacugucccgcaagacguuugacaccgaguaucagaaaacaaagcucaacgauugggacuucguggugaccacagauaucucugaaaugggagcgaauuuuaaagccgaccgggucauugaucccagacggugccugaagcccgugauccugaccgacggcccugagcgcguuauucucgcugggcccaugccugugacagccgcuagcgccgcucagagacggggacgcgucggcagaaacccgcagaaggagaaugaucaauacaucuucaccgggcagccccuuaacaaugacgaagaccacgcccauuggacggaggcgaaaaugcugcuggauaacaucaauacaccugaaggaauuauccccgcccucuucgagccugaacgggagaaguccgcugccauugacggcgaguauagacugaaaggggaaagccgcaagaccuuuguggagcuuaugcggagaggcgaucugcccguuuggcucgcucacaaaguggccucugaaggaaucaaguacaccgaccgcaaauggugcuucgauggccagcggaacaaucagauucuggaggaaaacauggacgucgagaucuggacaaaggagggggaaaagaaaaagcugagaccgcgcuggcucgaugcccggaccuauuccgacccucuugcucugaaagaguuuaaggauuucgcggccggaagaaaaagcaucgcucuggaccucgugacagaaauuggccgcguccccucucaccuggcccauagaacgcggaaugcccuugauaaccuggugaugcuccacaccuccgagcaugggggacgcgcuuacagacacgccguugaagagcugccugagacaauggaaacccugcuccuucugggccugaugauccuccugacaggcggggcgaugcuuuuucugauuagcggaaagggcaucgggaagaccuccauuggacucaucugugugaucgccucuagcggcaugcuguggauggcugagauuccccugcaauggaucgccuccgcuauugugcucgaauucuuuaugaugguccuucugaucccugagcccgagaaacagcggacgccgcaggacaaucaacuggccuauguugugauugggauccucacccuggcggccauuaucgcugccaacgaaaugggacuucuggagacaaccaagcgcgaucucggcaugagcaaagaaccuggcguggucucucccacauccuaccuggacguggaccugcaccccgcuagcgccuggacccucuacgcuguugccacgacagugaucaccccuaugcuuagacauacaauugagaauucuaccgcgaacgucagccuggccgcuaucgccaaccaggcugugguccugauggggcucgauaagggauggccgauuuccaaaauggaccugggcgugccccuucuggcccucgggugcuauucucagguuaauccucugacccugacagccgcggugcuccuucugaucacgcacuacgcuauuaucggacccggccugcaggccaaggcuacccgggaagcccaaaagagaacagccgcugggaucaugaaaaacccuaccgucgauggaauuaugacaaucgaccucgaucccgugauuuaugacagcaaguucgagaaacagcugggccagguuaugcuucuggugcucugugccguccagcugcugcucaugcgcaccuccugggcgcuuugcgaggcccugacgcuggcuacaggcccuaucaccacccucugggaagggucuccgggaaaguuuuggaauacaaccauugccgugagcauggcuaacaucuuccggggcuccuaccuggccggggcgggacuugccuuuagcaucaugaaaucugugggcacagggaagagaggaacgggcucccaaggcgagacccugggggaaaaguggaaaaagaaacucaaucagcugagccgcaaggaguucgaucuguauaaaaaguccggaauuacagaaguugaccggaccgaggcuaaagagggccucaagagaggggaaacaacccaucacgccgucucucggggaacggcuaagcuucagugguuuguggagcgcaacauggugauccccgaaggcagagucauugaucugggguguggacggggcggcuggagcuacuauugcgccgggcugaaaaagguuaccgaggugcgcggauacacaaaaggcgggccuggacaugaagagcccgugccuauguccaccuacggcuggaauaucgucaagcucaugucugggaaagacguguucuaucugcccccggagaagugugauacacuucugugcgacauuggagaaagcuccccuagccccaccguugaggaaucuagaacaauccgggugcucaagauggucgagcccuggcugaaaaacaaucaguucuguauuaaggugcugaacccuuacaugcccaccguuaucgagcaccucgaacgccuucaaagaaaacacggcggcaugcuggugcggaauccucugucccgcaacagcacgcaugagauguauuggaucucuaaugggacaggaaacauugucgcuuccgugaauauggugagcagacuccugcuuaaccgguuuaccaugacccacagacgcccgacaaucgaaaaggaugucgaccugggcgccgggacgcggcauguuaacgcggagcccgaaaccccuaauauggacgugauuggagagagaaucaaacgcauuaaggaggaacacaacucuacauggcacuacgaugacgagaaucccuauaagaccugggccuaccauggcagcuaugaagugaaagcuacaggguccgccucuagcaugaucaacggagucgugaagcuccugaccaaaccuugggauguugugcccauggucacacagauggcuaugaccgacacgaccccguucggccagcaacggguguuuaaggagaaaguugauacaagaaccccucgcuccaugcccggcacacggagagugauggggaucaccgccgaauggcuguggcgcacgcucggacggaauaagaagccuagacugugcacacgcgaggaguucaccaaaaagguccggacaaacgccgcgaugggcgcuguguuuaccgaagagaaucagugggacagcgccaaagccgcuguugaagaugaggacuucuggaagcuuguggauagagaacgcgagcugcacaaacucgggaaguguggauccugcgucuacaacaugaugggcaaaagagagaagaagcugggggaauuuggcaaagccaagggaucucgggcuauuugguacauguggcuuggcgcccgcuaucuggaguucgaagcgcucggguuucugaaugaggaccauugguucagcagagagaacuccuacucuggaguggaaggcgaggggcugcacaaacucggauauauccugcgggauauuagcaagauccccggcggggccauguacgcugacgacacggccggcugggauaccagaauuacagaagacgaucuucauaaugaggaaaaaaucacccagcagauggacccugagcaccggcaacuggcuaacgccaucuuuaagcucacauaucagaauaaggucgugaaaguucagcgccccaccccgacaggaaccgugauggauauuaucuccagaaaggaccagcggggcucugggcaagucggaacguacggccugaacacauucaccaauauggaggcgcagcuuauucgccagauggaaggggagggagugcugagcaaagccgaucucgaaaacccucaccugcccgagaagaaaaucacccaguggcuggaaacaaagggcguggagagacuccggcgcauggcuauuuccggggacgauugcguugugaagcccaucgacgauagauuugccaacgcucugcuugcccugaaugacaugggcaaaguccggaaggauaucccucaauggcagccgagcaaaggauggcaugacuggcagcaggugcccuucuguucucaccauuuccacgagcucauuaugaaggacggccgcaaacugguugugccuugcagaccccaagaugaacuuaucgggcgggcucgcauuucccagggagccggcuggagccugagagagaccgcgugucucgggaaggccuaugcucagauguggucucugauguacuuucaccggcgcgaccugagacucgccuccaacgccaucugcagcgcugucccugugcauuggguccccacaucucggacgaccugguccauucacgcccaucaccaauggaugacaaccgaagauaugcugacaguguggaauagaguuuggaucgaggacaacccuuggauggaagauaagacccccgugacgaccugggagaaugucccguaccuuggaaaacgcgaggaccagugguguggcagccugauugggcucacaucccgggcgaccugggcucagaacaucccuacagccauccagcaagugagaagccugauuggcaaugaagaguuccuugauuauaugcccucuaugaagcgcuuucggaaagaagaggagagcgaaggagccaucugguga

SEQ ID NO: 20669 - RNA, 9873 nt, Artificial Sequence
  derived and/or modified CDS sequence (opt5) from DENV-3__EU529699__SS-prME
acaagccugugccucaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccgugucugaaaaggaggagaauaugguuaaaucccuggugagcgcuggaucuggcaaggucgacaacuucacaaugggggugcugugccucgccauucuguuugaagagguuaugcggggaaaguucggcaaaaagcauaugaucgccggcguguucuuuaccuucguccuucugcucagcgggcagauuacauggcgcgauauggcucacacccugaucaugauuggauccaaugccagcgacagaaugggcaugggggugacguaccuggcgcuuaucgcuacauuuaaaauucagcccuuccuggcccucggauuuuuccugcggaagcucaccucuagagaaaaccugcuucugggcguggggcucgccauggcuacaacccugcaacugccugaggauaucgaacagauggccaauggaaucgcucuuggccugauggcccucaaacugauuacccaguuugagacauaucagcucuggacggcgcugaucucccuuaccuguagcaacacaauuuucacccugacagucgccuggcgcaccgcuacgcucauccuggccggcguuucccugcuuccggugugccaaucuagcuccaugcggaagacagacuggcugcccaugaccguggcugccaugggggucccuccccucccucuguuuauuuucucucucaaggauacccugaaaagacgcagcuggccccuuaaugagggagugauggccguuggccugguguccauccuggcuucuagccuccugagaaacgacgucccuauggcggggccccuuguggccggaggccugcucaucgcuuguuacguuauuacagggaccuccgccgaucugacaguggaaaaggccgcugacgucacgugggaggaagaggccgaacagaccggagugagccauaaccucaugaucacagucgacgaugacggcaccaugcggauuaaagaugacgagacagagaauauccugaccgugcuucugaagacggcgcugcucauuguuucuggcaucuuuccguacuccaucccugcuacccugcuuguguggcacacauggcagaaacagacccaacgcagcgggguccugugggaugugcccucuccucccgaaacacagaaggccgagcucgaagagggaguuuauagaauuaaacagcagggcaucuucgggaagacccaagugggagucggcgugcagaaggaggggguguuucauacaauguggcacguuacgcggggagccguccugaccuacaacggcaaacgccucgaaccgaauugggcuuccgugaagaaagaccugauuagcuauggcgggggauggagacuuucugcccaguggcaaaagggcgaggaagugcaggucaucgcgguggagccugggaaaaaccccaagaauuuccagacaaugccuggaaccuuccagaccacaacgggcgaaauuggggcuaucgcccuggauuuuaagcccggaaccuccggcagccccauuaucaaccgggagggcaaaguuguggggcuguacggaaauggcgucgugacaaagaacgggggauauguuuccggcaucgcccaaaccaaugcugagccugacgggccgacacccgaacucgaggaagagauguucaaaaagcgcaaccugaccauuauggaucuucacccuggcagcggaaaaacgagaaaguaccugcccgccaucgugcgggaagcuauuaagcgcagacuccggacacugauccucgccccuaccagagucguggcggccgagauggaggaagcucugaaaggccuucccauucgcuaucagaccacagccaccaagucugagcauacagggcgggaaaucguugaccugaugugccacgcuaccuuuacgaugagacugcucagcccugugcgcgucccgaauuacaaccugaucauuauggaugaggcccauuucacagaccccgccuccaucgcugcgcggggauacauuucuaccagagugggcaugggggaagccgcugccaucuuuaugacagccaccccucccggaacggcugaugccuucccucagagcaaugcgcccauucaggacgaggagcgcgacaucccggaacgguccuggaacucuggcaaugaguggaucaccgauuuugcugggaaaacagugugguucgucccuagcauuaaggccggcaacgacaucgccaacugucuucgcaaaaauggaaagaagguuauucaacuguccagaaaaaccuuugauacagaauaucagaagaccaaacucaacgacugggauuucguggugacaaccgacaucucugagaugggcgcuaauuuuaaggccgaucgggucauugaccccagacggugccugaaacccgugauccugacggaugggccugagcgcguuauucucgcgggacccaugccugugacagccgcuagcgccgcucagagacggggccgcgucgggagaaacccgcagaaggaaaaugaccaauacaucuucaccggacagccccuuaacaaugaugaggaccacgcccauuggaccgaagcuaagaugcugcuggacaacaucaauacaccugagggcauuauccccgcccucuucgaaccugagcgggagaaauccgcggccauugauggggaauauagacugaagggcgagagccgcaaaaccuuuguggaacuuaugcggagaggagaccugcccguuuggcucgcucacaagguggccucugagggcaucaaauacacagaucgcaaguggugcuucgacgggcagcggaacaaucagauucuggaagagaacauggaugucgagaucuggacgaaagaaggagagaagaagaaacugagaccgcgcuggcucgacgcucggaccuauuccgauccucuugcccugaaggaauuuaaagacuucgccgcuggcagaaagagcaucgcgcuggaucucgugacagagauugggcgcguccccucucaccuggcccauagaacccggaaugcucuugacaaccuggugaugcuccacacauccgaacauggaggcaaagccuaccgccacgccguugaggagcugccugaaaccauggagacgcugcuccuucugggccugaugauccuccugaccgggggagcuaugcuuuuucugauuagcggcaaggggaucggaaagacauccauuggccucaucugugugaucgccucuagcgggaugcuguggauggcggaaauuccccugcaauggaucgccuccgcuauugugcucgaguucuuuaugaugguccuucugaucccugagcccgaaaaacagagaaccccgcaggauaaucaacuggccuauguugugauuggaauccucacacuggcugccauuaucgcggccaacgagaugggccuucuggaaaccacgaagcgggaccucggcaugagcaaagagccugggguggucucucccacauccuaccuggauguggaccugcaccccgcuagcgccuggacccucuacgcuguugccacaaccgugaucaccccuaugcuucgccauacaauugaaaauucuacggcuaacgucagccuggccgcgaucgccaaccaggcugugguccugaugggacucgacaagggcuggccgauuuccaaaauggaucugggggugccccuucuggcccucggaugcuauucucagguuaauccucugacccugacagcugccgugcuccuucugaucacccacuacgccauuaucggccccgggcugcaggcgaaggcuacaagagaggcccaaaagcggaccgcugccggaaucaugaaaaacccuacggucgacggcauuaugacaaucgaucucgaccccgugauuuaugauagcaaguucgagaaacagcugggccagguuaugcuucuggugcucugugccguccagcugcugcucaugagaaccuccugggcucuuugcgaagcccugacccuggcgacagggccuaucaccacacucugggagggaucuccgggcaaguuuuggaauacgaccauugccgugagcauggcuaacaucuuccgcggguccuaccuggccggagcuggccuugccuuuagcaucaugaaaucuguggggacaggaaagcggggcaccggcucccaaggggaaacacugggagagaaguggaaaaagaaacucaaucagcugagcagaaaggaguucgaccuguauaaaaaguccggcauuaccgagguugaucgcacggaggcgaaagaagggcucaagcggggagagaucacccaucacgccgucucuagaggcagcgcuaaacuucagugguuuguggaacggaacauggugauucccgaggggcgcgucaucgaccugggauguggcagaggcgggugguccuacuauugcgccggacugaaaaagguuacagaagugcggggcuacaccaaagggggaccuggccaugaggagcccgugccuaugucuacauacggguggaauauugucaagcucaugagcggaaaagauguguucuaucugcccccggaaaagugugacacccuucugugcgauaucggcgaguccagcccuucucccacaguugaagagucccgcaccauuagagugcucaagauggucgagcccuggcugaaaaacaaucaguucuguaucaaggugcugaacccuuacaugcccacgguuaucgaacaccucgagcggcuucaacgcaaacacggcgggaugcuggugagaaauccucugagccggaacucuacacaugaaauguauuggauuuccaauggaaccggcaacaucgucgcuagcgugaauauggugucucgccuccugcuuaacagauuuaccaugacacaccggagaccgacgauugagaaggacgucgaucugggggccggaacccgccauguuaacgcugaacccgagacaccuaauauggacgugaucggcgagcggauuaaaagaaucaaggaagaacacaacagcaccuggcacuacgacgaugaaaaucccuauaagacaugggccuaccauggguccuaugaggugaaagcgaccggaucugccagcuccaugaucaacggcgucgugaagcuccugacaaaaccuugggacguugugcccauggucacccagauggcuaugacggauaccacaccguucggccagcaacgcguguuuaaggaaaaaguugacacccggacaccuagaagcaugcccgggacccgccgggugaugggaauuacggccgaguggcuguggagaacacucggccgcaauaagaagccucggcugugcaccagagaggaguucaccaagaagguccgcaccaacgcugccaugggggccguguuuacggaggaaaaucagugggauuccgcgaaagcugccguugaggacgaagauuucuggaaacuuguggaccgggagagagagcugcacaaacucggaaaguguggcucuugcgucuacaacaugauggggaaacgcgaaaagaagcugggcgaguuuggaaaagccaagggcagcagagcuaucugguacauguggcuuggggcccgguaucuggaguucgaggcucucggauuucugaaugaggaucauugguucucccgcgaaaacucuuacagcggcguggagggggaaggacugcacaaacucggcuauauucugagagacaucuccaagauucccgggggcgccauguacgcggaugacaccgccggaugggacacacggaucaccgaggaugaccuucauaaugaagagaaaaucacacagcagauggauccugagcacagacaacuggcuaacgccauuuuuaagcucaccuaucagaauaaggucgugaaaguucagcggcccacaccgaccggcacggugauggacaucauuucucgcaaggaucagagagggagcggacaagucggcacauacgggcugaacaccuucaccaauauggaagcucagcuuauccggcagauggagggagaaggcgugcuguccaaagccgaccucgagaacccucaucugcccgaaaagaaaauuacacaguggcuggagaccaaggggguggagcgccucaagagaauggcgaucagcggcgaugacugcguugugaaacccaucgaugaccgguuugccaacgcucugcuugcccugaaugauaugggaaagguccgcaaagacauuccucaauggcagccgucuaagggcuggcaugauuggcaacaggugcccuucuguucccaccauuuccacgaacucaucaugaaagacgggagaaagcugguugugccuugccggccccaagacgagcuuauuggacgcgcuagaaucagccagggcgccggguggucucugcgggaaacagcuugucucggaaaggccuaugcgcagauguggucccugauguacuuucaccgcagagaucugcggcucgccagcaacgcuauuugcucugccgucccugugcauuggguccccacgucccgcaccacauggagcauccacgcccaucaccaauggaugaccacagaggacaugcugaccguguggaauagaguuuggauugaagauaacccuuggauggaggacaaaacgcccgugaccacaugggagaaugucccguaccuuggcaagcgggaagaucaguggugugggucccugaucggccucaccagcagagcuacaugggcccagaacaucccuaccgcgauucagcaagugcgcucucugaucggaaaugaggaguuccuugacuauaugcccagcaugaaacgguuuagaaaggaggaggaauccgagggcgcuauuugguga

SEQ ID NO: 20670 - RNA, 9873 nt, Artificial Sequence
  derived and/or modified CDS sequence (opt5) from DENV-3__EU482566__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucacccugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccaacuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucaaugucuggagcccaucgagggcaaaguugugcaguaugaaaaucucaaguacaccgucauuaucacagugcauacgggggaccagcaccagguuggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucagaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagauguucccuguaaaaucccuuucagcacagaggacggccaagggaaggcccauaacggaagacugauuaccgcgaaucccguggucacgaaaaaggaggaacccgugaacaucgaggcugaaccuccguucggcgaguccaauauugugaucgggauuggcgauaacgcccugaaaaucaauugguauaagaagggaucuagcaucggcaaaauguuugaagccacagcucggggggccagacgcauggcuauucuuggagacaccgccugggauuucggcuccguugggggaguccucaacagccugggcaagauggugcaccagaucuuugggucugcguacaccgcccuguucuccggcgugagcugggucaugaaaauuggaaucggcgugcuccugacauggauugggcuuaauucuaagaacaccagcauguccuuuucuugcaucgcuauuggaaucaucacacuguaucucggcgccguugugcaggcugacauggggugugucauuaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcaccaaaggccccucucugcggacaaccacggucuccgggaagcugauccacgaguggugcuguagaagcugcacccuuccgccucuccgcuacaugggagaagauggcuguugguaugggauggagauccggcccauuucugaaaaagaggagaauauggugaagucccugguuagcgcuggaucuggcaagguggacaacuucacaauggggguccugugccucgccauccuguuugaagaggugaugagaggaaaauucggcaagaaacauaugauugccggcguuuucuuuaccuucgugcuucugcucagcgggcagaucacauggcgggauauggcucacacccugauuaugaucggauccaaugccagcgaccgcaugggcaugggggucacguaccuggcgcuuauugcuacauuuaagauccagcccuuccuggcccucggauuuuuccugagaaaacucaccucucgggaaaaccugcuucugggcguggggcucgccauggcuacaacccugcaacugccugaggauaucgaacagauggccaauggaauugcucuuggccugauggcccucaagcugaucacccaguuugagacauaucagcucuggacggcgcugauuucccuuaccuguagcaacacaaucuucacccugacaguggccuggagaaccgcuacgcucauucuggccggcgucucccugcuuccgguuugccaaucuagcuccaugcgcaagacagacuggcugcccaugaccguggcugccaugggggugccuccccucccucuguuuaucuucucucucaaagauacccugaagcggagaagcuggccccuuaaugagggagucauggccgugggccugguuuccauccuggcuucuagccuccugcgcaacgacgugccuauggcggggccccuugucgccggaggccugcucauugcuuguuacgugaucacagggaccuccgccgaucugacaguugaaaaagccgcugacgugacgugggaggaagaggccgaacagaccggagucagccauaaccucaugauuacaguggacgaugacggcaccaugagaaucaaggaugacgagacagagaauauucugaccguccuucugaaaacggcgcugcucaucgugucuggcaucuuuccguacuccauuccugcuacccugcuuguuuggcacacauggcagaagcagacccaacggagcggggugcugugggauguccccucuccucccgaaacacagaaagccgagcucgaagagggaguguaucgcaucaagcagcagggcauuuucgggaagacccaaguuggagugggcguccagaaagaggggguguuucauacaauguggcacgugacgagaggagccguucugaccuacaacggcaagcggcucgaaccgaauugggcuuccgucaaaaaggaccugaucagcuauggcgggggauggcgccuuucugcccaguggcaaaaaggcgaggaagugcaggugauugcggucgagccugggaagaaccccaagaauuuccagacaaugccuggaaccuuccagaccacaacgggcgaaaucggggcuauugcccuggauuuuaaacccggaaccuccggcagccccaucaucaacagagagggcaaggugguugggcuguacggaaauggcguggucacaaaaaacgggggauauguguccggcauugcccaaaccaaugcugagccugacgggccgacacccgaacucgaggaagagauguucaagaaacggaaccugaccaucauggaucuucacccuggcagcggaaagacgcgcaaguaccugcccgccauuguuagagaagcuaucaaacggcgccucagaacacugauucucgccccuacccggguggucgcggccgagauggaggaagcucugaagggccuucccaucagauaucagaccacagccaccaaaucugagcauacagggcgcgaaaucguggaccugaugugccacgcuaccuuuacgaugcggcugcucagcccuguuagagugccgaauuacaaccugauuaucauggaugaggcccauuucacagaccccgccuccauugcugcgcgcggauacaucucuacccgggucggcaugggggaagccgcugccauuuuuaugacagccaccccucccggaacggcugaugccuucccucagagcaaugcgcccauccaggacgaggagagagacaucccggaacgcuccuggaacucuggcaaugaguggauuaccgauuuugcugggaagacagugugguucgugccuagcaucaaagccggcaacgacauugccaacugucuucggaagaauggaaagaaagucauccaacuguccagaaagaccuuugauacagaauaucagaaaaccaagcucaacgacugggauuucguugugacaaccgacauuucugagaugggcgcuaauuuuaaagccgaucgcgugaucgacccccggagaugccugaagcccgucauucugacggaugggccugagcgggugauccucgcgggacccaugccuguuacagccgcuagcgccgcucagcgcagaggccggguggggcgcaacccgcagaaggaaaaugaccaauacaucuucaccggacagccccuuaacaaugaugaggaccacgcccauuggaccgaagcuaaaaugcugcuggacaacauuaauacaccugagggcaucauucccgcccucuucgaaccugagagagagaaguccgcggccaucgauggggaauaucggcugaaaggcgagagcagaaagaccuuugucgaacuuaugcgccggggagaccugcccguguggcucgcucacaaaguugccucugagggcauuaaguacacagauagaaaauggugcuucgacgggcagcgcaacaaucagauccuggaagagaacauggauguggagaucuggacgaaggaaggagagaagaaaaagcugcggccgagauggcucgacgcucgcaccuauuccgauccucuugcccugaaagaauuuaaggacuucgccgcuggccggaaaagcauugcgcuggaucucgucacagagaucgggagagugcccucucaccuggcccaucgcaccagaaaugcucuugacaaccuggucaugcuccacacauccgaacauggaggcaaggccuaccggcacgccguggaggagcugccugaaaccauggagacgcugcuccuucugggccugaugauucuccugaccgggggagcuaugcuuuuucugaucagcggcaaggggauuggaaaaacauccaucggccucaucuguguuauugccucuagcgggaugcuguggauggcggaaaucccccugcaauggauugccuccgcuaucgugcucgaguucuuuaugauggugcuucugauuccugagcccgaaaagcagcgcaccccgcaggauaaucaacuggccuaugucguuaucggaauucucacacuggcugccaucaucgcggccaacgagaugggccuucuggaaaccacgaaaagagaccucggcaugagcaaggagccugggguggugucucccacauccuaccuggaugucgaccugcaccccgcuagcgccuggacccucuacgcuguggccacaaccguuauuaccccuaugcuucggcauacaaucgaaaauucuacggcuaacgugagccuggccgcgauugccaaccaggcugucgugcugaugggacucgacaaaggcuggccgaucuccaagauggaucugggggucccccuucuggcccucggaugcuauucucaggugaauccucugacccugacagcugccguucuccuucugauuacccacuacgccaucaucggccccgggcugcaggcgaaggcuacacgcgaggcccaaaaaagaaccgcugccggaauuaugaagaacccuacgguggacggcaucaugacaauugaucucgaccccgucaucuaugauagcaaauucgagaagcagcugggccaggugaugcuucugguucucugugccgugcagcugcugcucaugcggaccuccugggcucuuugcgaagcccugacccuggcgacagggccuauuaccacacucugggagggaucuccgggcaaauuuuggaauacgaccaucgccgucagcauggcuaacaucuucagaggguccuaccuggccggagcuggccuugccuuuagcauuaugaagucuguggggacaggaaagcgcggcaccggcucccaaggggaaacacugggagagaaauggaagaaaaagcucaaucagcugagccggaaagaauucgaccuguauaagaaauccggcaucaccgagguggauagaacggaggcgaaggaagggcucaagcgcggagagauuacccaucacgccguuucucggggcagcgcuaaacuucagugguuugucgaaagaaacauggugauccccgaggggcgggugauugaccugggauguggccgcggcgggugguccuacuauugcgccggacugaagaaagucacagaaguuagaggcuacaccaaggggggaccuggccaugaggagcccgugccuaugucuacauacggguggaauaucgugaaacucaugagcggaaaggaugucuucuaucugcccccggaaaagugugacacccuucugugcgauauuggcgaguccagcccuucucccacaguggaagagucccggaccauccgcguucucaaaaugguggagcccuggcugaagaacaaucaguucuguaucaaaguccugaacccuuacaugcccacggugauugaacaccucgagagacuucaacggaagcacggcgggaugcugguucgcaauccucugagcagaaacucuacacaugaaauguauuggaucuccaauggaaccggcaacauuguggcuagcgucaauauggugucucggcuccugcuuaaccgcuuuaccaugacacacagacggccgacgaucgagaaagacguggaucugggggccggaaccagacaugucaacgcugaacccgagacaccuaauauggacguuauuggcgagcgcaucaagcggaucaaggaagagcacaacagcaccuggcacuacgacgaugaaaaucccuauaaaacaugggccuaccauggguccuaugaggugaaggcgaccggaucugccagcuccaugauuaacggcguggucaaacuccugacaaagccuugggacgugguucccauggugacccagauggcuaugacggauaccacaccguucggccagcaaagagucuuuaaagaaaagguggacacccgcacaccucggagcaugcccgggaccagacgcguuaugggaaucacggccgaguggcuguggcggacacucggcagaaauaagaaaccucgccugugcacccgggaggaauucacaaagaaagugagaaccaacgcugccaugggggccgucuuuacggaggaaaaucagugggauuccgcgaaggcugccguggaggacgaagauuucuggaaacuuguugaccgcgagcgggagcugcacaagcucggaaaauguggcucuugcguguacaacaugauggggaagagagaaaagaaacugggcgaguuuggaaaggccaaaggcagccgcgcuauuugguacauguggcuuggggccagauaucuggaauucgaggcucucggauuucugaaugaggaucauugguucucccgggaaaacucuuacagcggcgucgagggggaaggacugcacaagcucggcuauauccugcgcgacauuuccaaaauccccgggggcgccauguacgcggaugacaccgccggaugggacacaagaaucaccgaggaugaccuucauaaugaagagaagauuacacagcagauggauccugagcaccggcaacuggcuaacgccaucuuuaagcucaccuaucagaauaaaguggucaaggugcagagacccacaccgaccggcacgguuauggacauuaucucucggaaagaucagcgcgggagcggacaagugggcacauacgggcugaacaccuucaccaauauggaagcucagcuuauuagacagauggagggagaaggcguccuguccaaggccgaccucgagaacccucaccugcccgaaaaaaagaucacacaguggcuggagaccaaggggguggagcggcucaaacgcauggcgaucagcggcgaugacugcgugguuaagcccauugaugacagauuugccaacgcucugcuugcccugaaugauaugggaaaagugcggaaggacaucccucaauggcagccgucuaaaggcuggcaugauuggcagcagguccccuucuguucccaccauuuccacgaacucauuaugaaggacgggcgcaagcuggugguuccuugcagaccccaagacgagcuuaucggacgggcucgcauuagccagggcgccggguggucucugagagaaacagcuugucucggaaaagccuaugcgcagauguggucccugauguacuuucaccggcgcgaucugagacucgccagcaacgcuaucugcucugccgugccuguccauugggugcccacgucccggaccacauggagcauucacgcccaucaccaauggaugaccacagaggacaugcugaccgucuggaaucgcguguggaucgaagauaacccuuggauggaggacaagacgcccguuaccacaugggagaaugugccguaccuuggcaaaagagaagaucaguggugugggucccugaucggccucaccagccgggcuacaugggcccagaacauuccuaccgcgauccagcaagucagaucucugauuggaaaugaggaauuccuugacuauaugcccagcaugaagcgcuuucggaaagaggaggaauccgagggcgcuaucugguga

SEQ ID NO: 20671 - RNA, 9873 nt, Artificial Sequence
  derived and/or modified CDS sequence (opt5) from DENV-3__EU529702__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacguggggacgucccucacacagaaggucgugaucuucauucugcuuaugcugguuaccccuucuaugacaaugagaugugugggagucggcaaccgggacuuuguggaagggcucagcggagcuaccuggguggaugucguucuggagcacggcgggugcgugaccacaauggccaagaauaaacccacgcuggacaucgagcuccagaagaccgaagcuacacaacuggccacccuucgcaaacuguguauugagggaaagaucacaaacauuaccacggauuccagaugcccuacacagggcgaagcggugcucccggaggaacaggaccagaauuaugucuguaaacacaccuacguggaucggggcugggggaacggaugcggccuguucgggaagggaagccuuguuaccugcgccaaguuucaaugucuggagcccaucgagggcaaagugguccaguaugaaaaucucaaguacacagugauuaucaccguucauacaggggaccagcaccaggugggaaacgagacgcaaggcgucaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaagugguugugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguccugaagaaagagguguccgaaacccagcacgggacaauucucaucaagguugaguacaagggagaagaugugcccuguaaagucccuuucagcaccgaggacggccaagggaaggcccauaacggaagacugaucacagcgaaucccguggugaccaaaaaggaggaacccguuaacauugaggcugaaccuccguucggcgaguccaauaucgucauugggaucggcgauaacgcccugaaaauuaauugguauaagaagggaucuagcaucggcaaaauguuugaagccacggcuagaggggccagacgcauggcuauccuuggagacacagccugggauuucggcuccgucgggggagugcucaacagccugggcaagaugguccaccagauuuuugggucugcguacaccgcccuguucuccggcgugagcuggguuaugaaaaucggaauuggcgugcuccugaccuggaucgggcuuaauucuaagaacacaagcauguccuuuucuugcauugucaucggaauuaucacccuguaucucggcgcugugguucaggccgacauggggugugugaucaauuggaaaggaaaggagcugaagugcggcagcgggauuuucgucacaaacgaggugcauacguggaccgaacaguacaaauuucaagcugauucccccaagcggcuggccacagcgaucgccggcgcuugggagaauggaguuuguggcauuagaagcaccacacgcauggaaaaccuucucuggaaacagaucgccaaugagcugaacuauauucugugggaaaauaacaucaagcucaccguggucgugggggacaucauuggagugcuggagcagggcaaacggacgcuuaccccucagcccauggagcugaaguacucuuggaaaacaugggggaaggcuaagaucgucaccgccgaaacacaaaacuccagcuucauuaucgauggaccuaauacccccgagugcccgucugccuccagagcuuggaacguuugggaaguggaggacuauggcuuuggcguguucagcacaaauauuuggcucaaacugcgcgaagucuacacccagcugugugaccaccggcuuauguccgcggccgugaaggaugagagagcuguucacgccgacaugggguacuggaucgagucucagaaaaacggaagcuggaagcucgaaaaagccucccugaucgaggugaagacgugcacauggccuaagucucauacccuguggagcaauggcguccucgaauccgauaugauuauccccaaaagccuggcugggccuauuucucagcacaacuaucgccccggauaccauacccaaacagccggcccuuggcaccuugggaagcuggagcucgacuuuaauuauugcgagggaaccacggugguuaucacagaaaacuguggcacccggggccccucccugagaacaaccacagugagcgggaaacugauucacgaguggugcugucgcucuugcacccuuccgccucuccgguacaugggagaagauggcuguugguaugggauggagaucagacccaucuccgaaaaggaggagaauauggucaaaagccuggugucugcgggaagcggcaagguugacaacuucacgaugggggcucugugccucgccauucuguuugaagaggugaugcggggaaaguucggcaaaaagcauaugaucgccggcgucuucuuuaccuucgugcuucugcucuccgggcagauuacauggcgcgauauggcucacacccugaucaugauuggaagcaaugccucugacagaaugggcaugggggugacauaccuggcgcuuaucgcuaccuuuaaaauucagcccuuccuggcccucggauuuuuccugcggaagcucacguccagagaaaaccugcuucugggcgucgggcucgccauggcuacaacccugcaacugccugaggauaucgaacagauggccaauggaaucgcucuuggccugauggcccucaaacugauuacacaguuugagaccuaucagcucuggaccgcgcugaucagccuuacauguuccaacacgauuuucacccugacaguugccuggcgcaccgcuacacucauccuggccggcgugucucugcuuccggugugccaaagcuccucuaugcggaagaccgacuggcugcccaugacggucgcugccaugggggugccuccccucccucuguuuauuuucagccucaaggauacacugaaaagacgcuccuggccccuuaaugagggaguuauggccgugggccuggucucuauccuggcuagcucccuccugagaaacgacgugccuauggcggggccccuuguugccggaggccugcucaucgcuuguuacgugauuaccgggaccagcgccgaucugacagucgaaaaggccgcugacgugaccugggaggaagaggccgaacagacaggagucucucauaaccucaugaucacgguggacgaugacggcaccaugcggauuaaagaugacgagacagagaauauccugaccguucuucugaagacagcgcugcucauuguguccggcaucuuuccguacagcaucccugcuacccugcuugucuggcacacguggcagaaacagacccaacgcucuggggugcugugggauguucccuccccucccgaaacacagaaggccgagcucgaagagggaguguauagaauuaaacagcagggcaucuucgggaagacccaagucggagugggcgugcagaaggaggggguuuuucauacaauguggcacgucacccggggagccgugcugacauacaacggcaaacgccucgaaccgaauugggcuagcgugaagaaagaccugauuucuuauggcgggggauggagacuuuccgcccaguggcaaaagggcgaggaaguccaggugaucgcgguugagccugggaaaaaccccaagaauuuccagacgaugccuggaaccuuccagacaaccaccggcgaaauuggggcuaucgcccuggauuuuaagcccggaacaagcggcucccccauuaucaaccgggagggcaaaguggucgggcuguacggaaauggcgugguuacgaagaacgggggauaugugagcggcaucgcccaaaccaaugcugagccugacgggccgacacccgaacucgaggaagagauguucaaaaagcgcaaccugaccauuauggaucuucacccuggcucuggaaaaacaagaaaguaccugcccgccaucguccgggaagcuauuaagcgcagacuccggacccugauccucgccccuacgagagugguugcggccgagauggaggaagcucugaaaggccuucccauucgcuaucagacaaccgccaccaagagcgagcauacagggcgggaaaucguggaccugaugugccacgcuaccuuuacaaugagacugcucuccccuguccgcgugccgaauuacaaccugaucauuauggaugaggcccauuucaccgaccccgccucuaucgcugcgcggggauacauuagcacgagagugggcaugggggaagccgcugccaucuuuaugacagccaccccucccggaacagcugaugccuucccucaguccaaugcgcccauucaggacgaggagcgcgacaucccggaacggucuuggaacagcggcaaugaguggaucaccgauuuugcugggaaaacggucugguucguuccuuccauuaaggccggcaacgacaucgccaacugucuucgcaaaaauggaaagaaggugauucaacugucuagaaaaaccuuugauacagaauaucagaagaccaaacucaacgacugggauuucguggucacaaccgacaucagcgagaugggcgcuaauuuuaaggccgaucgggugauugaccccagacggugccugaaacccguuauccugacagaugggccugagcgcgugauucucgcgggacccaugccugucaccgccgcuuccgccgcucagagacggggccgcguggggagaaacccgcagaaggaaaaugaccaauacaucuucacgggacagccccuuaacaaugaugaggaccacgcccauuggacagaagcuaagaugcugcuggacaacaucaauaccccugagggcauuauccccgcccucuucgaaccugagcgggagaaaagcgcggccauugauggggaauauagacugaagggcgagucucgcaaaaccuuuguugaacuuaugcggagaggagaccugcccguguggcucgcucacaaggucgccuccgagggcaucaaauacacagaucgcaaguggugcuucgacgggcagcggaacaaucagauucuggaagagaacauggauguggagaucuggaccaaagaaggagagaagaagaaacugagaccgcgcuggcucgacgcucggacauauagcgauccucuugcccugaaggaauuuaaagacuucgccgcuggcagaaagucuaucgcgcuggaucucgucacggagauugggcgcgugcccucccaccuggcccauagaacccggaaugcucuugacaaccugguuaugcuccacacaagcgaacauggaggcaaagccuaccgccacgccguggaggagcugccugaaaccauggagacacugcuccuucugggccugaugauccuccugaccgggggagcuaugcuuuuucugauuuccggcaaggggaucggaaagacgucuauuggccucaucugugugaucgccagcuccgggaugcuguggauggcggaaauuccccugcaauggaucgccagcgcuauuguccucgaguucuuuaugaugguucuucugaucccugagcccgaaaaacagagaaccccgcaggauaaucaacuggccuauguggugauuggaauccucacacuggcugccauuaucgcggccaacgagaugggccuucuggaaaccacaaagcgggaccucggcaugucuaaagagccuggggucgugucccccaccagcuaccuggauguugaccugcaccccgcuucugccuggacgcucuacgcuguggccacaaccgucaucacaccuaugcuucgccauaccauugaaaauagcaccgcuaacgugucccuggccgcgaucgccaaccaggcugucgugcugaugggacucgacaagggcuggccgauuucuaaaauggaucuggggguuccccuucuggcccucggaugcuauagccaggugaauccucugacacugacggcugccguccuccuucugaucacccacuacgccauuaucggccccgggcugcaggcgaaggcuacaagagaggcccaaaagcggaccgcugccggaaucaugaaaaacccuacaguggacggcauuaugaccaucgaucucgaccccguuauuuaugauuccaaguucgagaaacagcugggccaggugaugcuucugguccucugugccgugcagcugcugcucaugagaacgucuugggcucuuugcgaagcccugacacuggcgaccgggccuaucaccacacucugggagggaagcccgggcaaguuuuggaauaccacaauugccguguccauggcuaacaucuuccgcgggagcuaccuggccggagcuggccuugccuuuucuaucaugaaauccguugggacgggaaagcggggcaccggcagccaaggggaaacacugggagagaaguggaaaaagaaacucaaucagcuguccagaaaggaguucgaccuguauaaaaagucuggcauuaccgaggucgaucgcacagaggcgaaagaagggcucaagcggggagagaucacccaucacgccgugagcagaggcuccgcuaaacuucagugguuuguggaacggaacauggucauucccgaggggcgcguuaucgaccugggauguggcagaggcggguggucuuacuauugcgccggacugaaaaaggugacggaagugcggggcuacaccaaagggggaccuggccaugaggagcccgucccuaugagcacauacggguggaauauugugaagcucauguccggaaaagauguuuucuaucugcccccggaaaagugugacacccuucugugcgauaucggcgagagcucuccuucccccacaguggaagagagccgcaccauuagaguccucaagaugguggagcccuggcugaaaaacaaucaguucuguaucaagguucugaacccuuacaugcccacagugaucgaacaccucgagcggcuucaacgcaaacacggcgggaugcuggucagaaauccucugucucggaacuccacccaugaaauguauuggauuagcaauggaacgggcaacaucguggcuucugugaauauggucagccgccuccugcuuaacagauuuacaaugacccaccggagaccgaccauugagaaggacguugaucugggggccggaacacgccaugugaacgcugaacccgagacgccuaauauggacgugaucggcgagcggauuaaaagaaucaaggaagaacacaacuccaccuggcacuacgacgaugaaaaucccuauaagacaugggccuaccaugggucuuaugaggucaaagcgaccggaagcgccuccagcaugaucaacggcgugguuaagcuccugacaaaaccuugggacgugguccccauggugacccagauggcuaugacagauaccacgccguucggccagcaacgcguuuuuaaggaaaaaguggacacccggacaccuagauccaugcccgggacccgccgggucaugggaauuacagccgaguggcuguggagaacccucggccgcaauaagaagccucggcugugcacgagagaggaguucaccaagaaggugcgcaccaacgcugccaugggggccguuuuuacagaggaaaaucagugggauucugcgaaagcugccguggaggacgaagauuucuggacccuugucgaccgggagagagagcugcacaagcucggaaaauguggcagcugcguguacaacaugauggggaagcgcgagaaaaagcugggcgaguuuggaaaggccaaaggcuccagagcuaucugguacauguggcuuggggcccgguaucuggaguucgaggcucucggauuucugaaugaggaucauugguucucucgcgaaaacagcuacuccggcgucgagggggaaggacugcacaagcucggcuauauucugagagacaucucuaaaauucccgggggcgccauguacgcggaugacacggccggaugggacacccggaucacagaggaugaccuucauaaugaagagaagaucacccagcagauggauccugagcacagacaacuggcuaacgccauuuuuaaacucacauaucagaauaaggugguuaaggugcagcggcccaccccgacaggcaccgucauggacaucauuagccgcaaagaucagagaggguccggacaagugggcacguacgggcugaacacauucaccaauauggaagcucagcuuauccggcagauggagggagaaggcgugcugagcaaggccgaccucgagaacccucaucugcccgagaaaaagauuacccaguggcuggagacaaaagggguugagcgccucaagagaauggcgaucucuggcgaugacugcguggucaagcccaucgaugaccgguuugccaacgcucugcuugcccugaaugauaugggaaaagugcgcaaggacauuccucaauggcagccguccaaaggcuggcaugauuggcagcagguucccuucuguagccaccauuuccacgaacucaucaugaaggacgggagaaaacugguggucccuugccggccccaagacgagcuuauuggacgcgcuagaaucucucagggcgccggguggucccugcgggaaaccgcuugucucggaaaggccuaugcgcagauguggagccugauguacuuucaccgcagagaucugcggcucgccucuaacgcuauuugcuccgccgugccuguccauugggugcccacaagccgcacgaccugguccauccacgcccaucaccaauggaugacaaccgaggacaugcugacaguuuggaauagaguguggauugaagauaacccuuggauggaggacaagacccccgucacgaccugggagaaugugccguaccuuggcaaacgggaagaucaguggugugggagccugaucggccucacaucuagagcuaccugggcccagaacaucccuacagcgauucagcaaguucgcagccugaucggaaaugaggaguuccuugacuauaugcccuccaugaagcgguuuagaaaagaggaggaaucugagggcgcuauuugguga

SEQ ID NO: 20672 - RNA, 9873 nt, Artificial Sequence
  derived and/or modified CDS sequence (opt5) from DENV-3__EU529703__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggcccucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugcgcccuguaaaauuccuuucagcaccgaggacggccaagggaaggcucauaacggaagacugaucacagccaaucccgugguuaccaaaaaggaggaacccgugaacauugaggccgaaccuccguucggcgaguccaauaucgucauugggaucggcgauaacgcucugaaaaucaauugguauaagaagggaucuagcauuggcaaaauguuugaagccacggcuagaggggccagacgcauggcgauccuuggagacacagccugggauuucggcuccgucgggggagugcucaacagccugggcaagaugguucaccagauuuuugggucugcuuacaccgcccuguucuccggcgucagcugggugaugaaaaucggaauuggcgugcuccugaccuggaucgggcuuaauucuaagaacacaagcauguccuuuucuugcauugcuaucggaaucauuacccuguaucucggcgccgucgugcaggcggacaugggguguguuaucaauuggaaaggaaaggagcugaagugcggcagcgggauuuucgugacaaacgagguccauacguggaccgaacaguacaaauuucaagccgauucccccaagcggcuggcuacagccaucgcuggcgccugggagaauggaguguguggcauuagaagcaccacacgcauggaaaaccuucucuggaaacagaucgccaaugagcugaacuauauccugugggaaaauaacauuaagcucaccguuguggucggggacaucauuggagugcuggagcagggcaaacggacgcuuaccccucagcccauggagcugaaguacucuuggaaaacaugggggaaggcuaagaucguuaccgcggaaacacaaaacuccagcuucauuaucgauggaccuaauacccccgagugcccgucugccuccagagcuuggaacgugugggaagucgaggacuauggcuuuggcguguucacaaccaauaucuggcucaaacugcgcgaaguguacacgcagcugugugaccaccggcuuaugagcgccgccgucaaggaugagagagcuguucacgccgacaugggguacuggauugagucccagaaaaacggaucuuggaagcucgaaaaagcgagccugaucgaggugaagacaugcaccuggccuaagucccauacccuguggucuaauggcgugcucgaaagcgauaugauuauccccaaaucccuggcugggccuauuagccagcacaaccaucgccccggauaucacacacaaaccgccggcccuuggcaccuugggaagcuggagcucgacuuuaauuacugcgagggaacgacagucgugaucaccgaaaacuguggcacacggggccccucucugagaaccacaaccguuuccgggaaacugauccaugaguggugcugucgcagcugcacgcuuccgccucuccgguauaugggagaagauggcuguugguacgggauggagauuagacccaucucugaaaaggaggagaauauggugaaaucccuggucagcgccggaucuggcaagguggacaacuucaccauggggguucugugccucgcuauucuguuugaagaggugaugcggggaaaguucggcaaaaagcacaugaucgccggcgucuucuuuacauucgugcuucugcucagcgggcagauuaccuggcgcgauauggcgcauacacugaucaugauuggauccaaugcuagcgacagaaugggcauggggguuaccuaucuggcccuuaucgccacguuuaaaauccagcccuuccuggcucucggauuuuuccugcggaagcucacaucuagagaaaaccugcuucugggcguggggcucgccauggcuaccacacugcaacugccugaggauauugaacagauggccaauggaaucgcgcuuggccugauggcccucaaacugauuacccaguuugagaccuaccagcucuggacagcucugaucucccuuacguguagcaacaccauuuucacacugaccgucgccuggcgcacagcuacccucauccuggccggcgugucccugcuuccggugugccaaucuagcuccaugcggaagacggacuggcugcccauggccgucgcugcgauggggguuccuccccucccucuguuuaucuucucucucaaggauacacugaaaagacgcagcuggccccuuaaugagggagugauggccgugggccuggucuccauucuggcuucuagccuccugagaaacgacgugccuauggccgggccccuuguugccggaggccugcucaucgcuuguuaugugauuaccgggaccuccgccgaucugacagucgaaaaggcggcugacaucaccugggaggaagaggccgaacagacaggagugagccacaaccucaugauuacgguugacgaugacggcaccaugcggaucaaagaugacgagacagagaauauccugaccgugcuucugaagacagcccugcucauugucucuggcaucuuuccguacuccauuccugcuacccugcuuguguggcauacguggcagaaacagacccaacgcagcgggguccugugggaugugcccucuccucccgaaacacagaaggccgagcucgaagagggaguuuacagaaucaaacagcagggcauuuucgggaagacccaagugggagucggcgugcagaaggaggggguuuuucacacaauguggcacgugacccggggagcgguccugacauauaacggcaaacgccucgaaccgaauugggcuuccgugaagaaagaccugaucagcuacggcgggggauggagacuuucugcccaguggcaaaagggcgaggaagugcagguuauugccgucgagccugggaaaaaccccaagaauuuccagacgaugccuggaaccuuccagacaaccaccggcgaaaucggggcuaucgcccuggauuuuaagcccggaacauccggcagccccauuaucaaccgggagggcaaagugguggggcuguauggaaauggcgucgugacgaagaacgggggauacguuuccggcauugcucaaaccaaugccgagccugacgggccgacacccgaacucgaggaagagauguucaaaaagcgcaaccugaccaucauggaucuucauccuggcagcggaaaaacaagaaaguaucugcccgcgauugugcgggaagccaucaagcgcagacuccggacccugauccucgcuccuacgagagucguggccgcugagauggaggaagcccugaaaggccuucccauucgcuaccagacaaccgccaccaagucugagcacacagggcgggaaaucguugaccugaugugccaugcuaccuuuacaaugagacugcucagcccugugcgcgucccgaauuauaaccugauuaucauggaugaggcgcacuucaccgaccccgccuccauugcugcccggggauacaucucuacgagagugggcaugggggaagccgcugccaucuuuaugacagcgaccccucccggaacagcugaugccuucccucagagcaaugcccccauucaggacgaggagcgcgacaucccggaacgguccuggaacucuggcaaugaguggauuaccgauuuugcugggaaaacgguuugguucgugccuagcaucaaggccggcaacgacauugcgaacugucuucgcaaaaauggaaagaaggucauccaacuguccagaaaaaccuuugauacagaauaccagaagaccaaacucaacgacugggauuucguggugacaaccgacauuucugagaugggcgccaauuuuaaggcugaucgggucaucgaccccagacggugccugaaacccguuauccugacagaugggccugagcgcgugauucucgccggacccaugccugugaccgcugccagcgcugcccagagacggggccgcgucgggagaaacccgcagaaggaaaaugaccaauauaucuucacgggacagccccuuaacaaugaugaggaccaugcgcacuggacagaagccaagaugcugcuggacaacauuaauaccccugagggcaucauucccgcucucuucgaaccugagcgggagaaauccgccgcuaucgauggggaauacagacugaagggcgagagccgcaaaaccuuuguggaacuuaugcggagaggagaccugcccguuuggcucgcccacaagguggccucugagggcaucaaauauacagaucgcaaguggugcuucgacgggcagcggaacaaucagauucuggaagagaacauggaugucgagaucuggaccaaagaaggagagaagaagaaacugagaccgcgcuggcucgacgcucggacauacuccgauccucuugcgcugaaggaauuuaaagacuucgccgcuggcagaaagagcauugcccuggaucucgugacggagaucgggcgcguucccucucaucuggcccacagaacccggaaugcucuugacaaccuggugaugcuccauacauccgaacacggaggccgcgccuauagacacgcggucgaggagcugccugaaaccauggagacacugcuccuucugggccugaugauucuccugaccgggggagccaugcuuuuucugaucagcggcaaagggaucggaaagacguccauuggccucaucugugugauugcuucuagcgggaugcuguggauggccgaaaucccccugcaauggauugcuuccgccaucguccucgaguucuuuaugauggugcuucugauuccugagcccgaaaagcagcggaccccgcaggauaaucaacuggcguacguugugaucggaauccucacacuggccgcuauuaucgccgcuaacgagaugggccuucuggaaaccacaaaacgcgaccucggcaugagcaaggagccugggguggucucucccaccuccuaucuggauguugaccugcaucccgccagcgcuuggacgcucuacgccguggcgacaaccgugauuacaccuaugcuuagacacaccaucgaaaauucuaccgccaacgucagccuggcugccauugcuaaccaggccgugguucugaugggacucgacaaaggcuggccgaucuccaagauggaucugggggugccccuucuggcccucggaugcuacucucaggucaauccucugacacugacggcggcugugcuccuucugaucacccauuaugccauuaucggccccgggcugcaggcuaaagccacacgggaggcccaaaagagaaccgcugccggaauuaugaagaacccuacagucgacggcaucaugaccauugaucucgaccccgugaucuacgauagcaaauucgagaagcagcugggccagguuaugcuucuggugcucugugcgguccagcugcugcucaugcgcacguccugggcccuuugcgaagcucugacacuggccaccgggccuaucaccacacucugggagggaucuccgggcaaauuuuggaauaccacaauugcugugagcauggccaacaucuuccggggguccuaucuggcgggagccggccuugcuuuuagcauuaugaagucuguugggacgggaaaaagaggcaccggcucccaaggggaaacacugggagagaaguggaagaaaaagcucaaucagcugagccgcaaagaguucgaccuguacaagaaauccggcaucaccgagguggaucggacagaggccaaggaagggcucaaaagaggagagauuacccaccaugcugucucucggggcagcgccaaacuucagugguuuguggaacgcaacauggugauccccgaggggagaguuauugaccugggauguggccggggcgggugguccuauuacugcgcuggacugaagaaagucacggaagugcgcggcuauaccaaagggggaccuggccacgaggagcccgugccuaugucuacauacggguggaauaucgucaaacucaugagcggaaaggauguuuucuaccugcccccggaaaaaugugacacccuucugugcgauaucggcgaguccagcccuucucccacaguggaagaguccagaaccauucgggugcucaagauggucgagcccuggcugaagaacaaucaguucuguaucaaagugcugaacccuuauaugcccacaguuauugaacaccucgagcgccuucaaagaaagcauggcgggaugcuggugcggaauccucugagccgcaacucuacccacgaaauguacuggaucuccaauggaacgggcaacauugucgccagcgugaauaugguuucuagacuccugcuuaaccgguuuacaaugacccauagacgcccgaccaucgagaaagacguggaucugggggcgggaacacggcacgucaacgccgaacccgagacgccuaauauggacgugaucggcgagagaauuaagcgcaucaaagaagaacacaacagcaccuggcauuaugacgaugaaaaucccuacaagacaugggcuuaucacggguccuacgaggugaaggccaccggaucugcuagcuccaugauuaacggcgucguuaaacuccugacaaagccuugggacguggugcccauggucacccagauggccaugacagauaccacgccguucggccagcaacggguguuuaaagaaaagguugacaccagaacaccucgcagcaugcccgggacccggagagugaugggaaucacagccgaguggcuguggcgcacccucggccggaauaaaaagccuagacugugcacgcgcgaggaguucacaaagaaaguccggaccaacgcggcuaugggggccguguuuacagaggaaaaucagugggauuccgccaaggcugccguugaggacgaagauuucuggaaacuuguggacagagagcgcgagcugcauaagcucggaaaauguggcucuugcgucuauaacaugauggggaagagagagaagaagcugggcgaguuuggaaaggcuaaaggcagccgggccauuugguacauguggcuuggggcgcgcuaccuggaguucgaggcccucggauuucugaaugaggaucacugguucuccagagaaaacucuuauagcggcguggagggggaaggacugcauaagcucggcuacauccugcgggacaucuccaaaauucccgggggcgcuauguaugccgaugacaccgcuggaugggacacgagaaucaccgaggaugaccuucacaaugaagagaagauuacacagcagauggauccugagcaccggcaacuggccaacgcgaucuuuaaacucaccuaccagaauaagguugugaagguccagcgccccacaccgaccggcacagugauggacauuaucucuagaaaagaucagcgggggagcggacaagucggcaccuaugggcugaacacguucacaaauauggaagcccagcuuauccgccagauggagggagaaggcgugcuguccaaggcugaccucgagagccaucaucugccugagaagaagauuacccaguggcuggagaccaaagggguugagagacucaagcggauggccaucucuggcgaugacugcguggucaagcccauugaugaccgcuuugcuaacgcccugcuugcucugaacgauaugggaaaagugagaaaggacaucccccaauggcagccuuccaaaggcuggcaugauuggcaacaggugccguucuguagccaccacuuccaugaacucauuaugaaggacgggcggaaacugguugugcccugccgcccucaagacgagcuuaucggacgggcccggauuucucagggcgcgggguggucccugcgcgaaacagccugucucggaaaggcuuacgcccagauguggagccugauguauuuucacagacgggaucugcgccucgccucuaaugcuaucugcuccgccguccccgugcauuggguuccuaccagcagaacaacgugguccauccacgcgcaucaccaauggaugaccacagaggacaugcugaccguguggaaccgggucuggauugaagauaaucccuggauggaggacaagacaccugugaccacgugggagaacguccccuaccuuggcaaaagagaagaucaguggugugggagccugaucggccucaccucucgcgcuacaugggcccagaauauuccgaccgccauccagcaagugcggagccugauuggaaacgaggaguuccuugacuacaugccuuccaugaagagauuucgcaaagaggaggaaucugagggcgcuaucugguga

SEQ ID NO: 20673 - RNA, 9873 nt, Artificial Sequence
  derived and/or modified CDS sequence (opt5) from DENV-3__EU529705__SS-prME
accucccugugccucaugaugauccugcccgccgcucuugccuuccaccugacauccagagacggagagccucggaugauuguggggaagaacgaacgcggaaaaucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggcggcaggucgaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggaauuggcaaccgggacuuuguggaagggcucagcggagcuaccugggucgauguggugcuggagcacggcgggugcgucaccacaauggccaagaauaaacccacgcuggacaucgagcuccagaagaccgaagcuacacaacuggccacccuucgcaaacuguguauugagggaaagaucacaaacauuaccacggauuccagaugcccuacacagggcgaagcgguucucccggaggaacaggaccagaauuauguguguaaacacaccuacguggaucggggcugggggaacggaugcggccuguucgggaagggaagccuugugaccugcgccaaguuucaaugucuggagcccaucgagggcaaagugguucaguaugaaaaucucaaguacacagugaucauuaccguccauacaggggaccagcaccaggugggaaacgagacgcaaggcguuaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaaguggucgugcucgggucucaggagggagccaugcacaccgcucugacaggcgccaccgaaauucaaaauuccgggggcaccagcaucuucgccggacaucugaagugucgccucaaaauggacaagcugggccuuaaagggaugucuuacgcuaugugcacaaacacguuuguucugaagaaagagguguccgagacccagcacggaacaauccucauuaaggucgaauacaagggcgaggaugugcccuguaaaguuccuuucagcaccgaagacgggcaaggaaaggcccauuccggcagacugaucacagcgaaccccguggucaccaaaaaggaggagcccgugaauauugaagcugagccuccguucggggaaucuaacaucgugauuggcaucggagauaaugcccugaaaaucaacugguauaagaagggcagcuccauugggaaaauguuugaggccacggcucggggagccagacgcauggcuauccuuggcgacacagccugggauuucgggagcguuggaggcguccucaauucucuggggaagauggugcaccagauuuuuggcuccgcguacaccgcccuguucagcggagugucuugggucaugaaaaucggcauugggauccuccugaccuggauuggacuuaacagcaagaauacauccaugucuuuuagcugcaucgugaucggcauuaucacccuguaucucggggcuguugugcaggccgacaugggaugugucauuaacuggaaaggcaaggaacugaagugcggguccggcaucuucgugacaaaugagguucauacguggaccgagcaguacaaauuucaagcugauagccccaagcggcuggccacagcgauugccggagcuugggaaaacggcgugugugggaucagaucuaccacacgcauggagaaucuucucuggaaacagaucgccaacgaacugaauuauauucugugggagaacaauaucaagcucaccgucgugguuggagacauuaucggcgugcuggaacaggggaaacggacgcuuaccccucagcccauggagcugaaguacuccuggaaggcuuggggaaaggccaagauugucacagccgagacccaaaacagcucuuucaucaucgauggcccuaacacacccgaaugcccguccgcuagcagagcguggaaugugugggagguggaagacuauggcuuuggggucuucaccacaaacauuuggcucaaacugcgcgagguuuacacccagcugugugaccaccggcuuauguccgccgcugugaaggaugaaagagccgugcacgccgacaugggauacuggaucgagucucagaaaaauggcagcuggaagcucgagaaagcuagccugauugaagucaagacgugcacauggccuaagucucauacccuguggagcaacggggugcucgaguccgauaugaucauucccaaaagccuggccggaccuaucucucagcacaauuaucgccccggcuaccauacccaaacagcggggccuuggcaccuuggaaagcuggaacucgacuuuaacuauugcgagggcaccacgguugugaucacagagaauuguggcacccgggggcccucccugagaacaaccacagucagcggaaaacugauucacgaauggugcugucgcucuugcacccuuccgccucuccgguacaugggcgaggauggguguugguauggaauggaaaucagacccauuuccgagaaggaagagaacauggugaaaagccugguuucugcuggcagcgggaagguggacaauuucacgaugggaguccugugccucgccauccuguuugaggaagugaugcggggcaaguucggcaaaaagcauaugauugccgggguuuucuuuaccuucgugcuucugcucuccggacagaucacauggcgcgauauggcucacacccugauuaugaucggcagcaacgccucugacagaauggggaugggagucacauaccuggcgcuuaucgcuaccuuuaaaauucagcccuuccuggcccucggcuuuuuccugcggaagcucacguccagagagaaucugcuucugggggugggacucgccauggcuacaacccugcaacugccugaagauaucgagcagauggccaacggcauugcucuuggccugauggcccucaaacugaucacacaguuugaaaccuaucagcucuggaccgcgcugauuagccuuacauguuccaauacgaucuucacccugacaguggccuggcgcaccgcuacacucauccuggccggggucucucugcuuccgguuugccaaagcuccucuaugcggaagaccgacuggcugcccaugacgguggcugccaugggagugccuccccucccucuguuuauuuucagccucaaggauacacugaaaagacgcuccuggccccuuaacgagggcgucauggccguggggcugguuucuauccuggcuagcucccuccugagaaaugacgugccuauggcgggaccccuugucgccggcgggcugcucauugcuuguuacgugaucaccggaaccagcgccgaucugacaguugagaaggccgcugacgugaccugggaagaggaagccgagcagacaggcgucucucauaaccucaugauuacgguggacgaugacggcaccaugcggaucaaagaugacgaaacagagaacauccugaccguccuucugaagacagcgcugcucauuguguccgggaucuuuccguacagcauuccugcuacccugcuuguuuggcacacguggcagaaacagacccaacgcucuggagugcugugggauguccccuccccucccgagacacagaaggccgaacucgaggaaggcguguauagaaucaaacagcaggggauuuucggaaagacccaaguuggcguggggguccagaaggagggaguguuucauacaauguggcacgugacccggggcgccguucugacauacaauggcaaacgccucgagccgaacugggcuagcgucaagaaagaccugaucucuuaugggggaggcuggagacuuuccgcccaguggcaaaagggggaagagguccaggugauugcggucgaaccuggcaaaaaucccaagaacuuccagacgaugccuggcaccuuccagacaaccaccggggagaucggagcuaucgcccuggauuuuaagcccggcacaagcggcucccccauuaucaaucgggaagggaaagugguuggacuguacggcaacgggguggucacgaagaauggaggcuaugugagcgggauugcccaaaccaacgcugagccugacggcccgacacccgagcucgaagaggaaauguucaaaaagcgcaaucugaccaucauggaucuucacccuggaucuggcaaaacaagaaaguaccugcccgccauuguucgggaggcuaucaagcgcagacuccggacccugauccucgccccuacgagaguggucgcggccgaaauggaggaggcucugaaagggcuucccauucgcuaucagacaaccgccaccaagagcgaacauacaggacgggagaucguggaccugaugugccacgcuaccuuuacaaugagacugcucuccccuguucgcgugccgaacuacaaucugauuaucauggaugaagcccauuucaccgaccccgccucuauugcugcgcggggcuacaucagcacgagagucgggaugggagaggccgcugccaucuuuaugacagccaccccucccggcacagcugaugccuucccucaguccaacgcgcccauucaggacgaagaaagagacaucccggagcggucuuggaauagcgggaacgaauggauuaccgauuuugcuggcaaaacggugugguucgugccuuccaucaaggccggaaaugacauugccaacugucuucgcaaaaacggcaagaaggucauccaacugucucgcaaaaccuuugauacagaguaucagaagaccaaacucaaugacugggauuucguugugacaaccgacauuagcgaaaugggggcuaacuuuaaggccgaucgggugaucgaccccagacggugccugaaacccgucauccugacagauggaccugagcgcgugauucucgcgggccccaugccuguuaccgccgcuuccgccgcucagagacgggggcgcgugggaagaaauccgcagaaggagaacgaccaauacaucuucacgggccagccccuuaauaacgaugaagaccacgcccauuggacagaggcuaagaugcugcuggacaauauuaacaccccugaagggaucauucccgcccucuucgagccugaacgggagaaaagcgcggccaucgauggcgaguauagacugaagggagaaucucgcaaaaccuuugucgagcuuaugcggagaggcgaccugcccguguggcucgcucacaagguugccuccgaagggaucaaauacacagaucgcaaguggugcuucgacggacagcggaauaaccagauucuggaggaaaauauggauguggagaucuggaccaaagagggcgaaaagaagaaacugagaccgcgcuggcucgacgcucggacauauagcgauccucuugcccugaaggaguuuaaagacuucgccgcugggagaaagucuauugcgcuggaucucgucacggaaaucggacgcgugcccucccaccuggcccauagaacccggaacgcucuugacaaucuggucaugcuccacacaagcgagcauggcggccgcgccuacagacacgccguggaagaacugccugagaccauggaaacacugcuccuucuggggcugaugauucuccugaccggaggcgcuaugcuuuuucugaucuccgggaaaggaaucggcaagacgucuauugggcucaucuguguuauugccagcuccggaaugcuguggauggcggagaucccccugcaauggauugccagcgcuaucgugcucgaguucuuuaugauggugcuucugauuccugagcccgagaagcagcggaccccgcaggauaaccaacuggccuaugucguuaucggcauccucacacuggcugccauuaucgcggccaaugaaaugggccuucuggagaccacaaaacgcgaccucgggaugucuaaggaaccuggaguggugucccccaccagcuaccuggaugucgaccugcaccccgcuucugccuggacgcucuacgcuguggccacaaccguuauuacaccuaugcuuagacauaccaucgagaacagcaccgcuaaugugucccuggccgcgauugccaaccaggcugucgugcugaugggccucgacaaaggguggccgaucucuaagauggaucugggagucccccuucuggcccucggcugcuauagccaggugaacccucugacacugacggcugccguucuccuucugaucacccacuacgccauuaucgggcccggacugcaggcgaaagcuacacgggaagcccaaaagagaaccgcugccggcauuaugaagaauccuacaguggacggcaucaugaccauugaucucgaccccgucaucuaugauuccaaauucgagaagcagcugggacaggugaugcuucugguucucugugccgugcagcugcugcucaugcgcacgucuugggcucuuugcgaggcccugacacuggcgaccggaccuaucaccacacucugggaaggcagcccggggaaauuuuggaacaccacaauugccgucuccauggcuaauaucuuccggggaagcuaccuggccggcgcugggcuugccuuuucuauuaugaaguccgugggaacgggcaaaagaggcaccgggagccaaggagagacacugggcgaaaaguggaagaaaaagcucaaccagcugucccgcaaagaguucgaccuguauaagaaaucugggaucaccgaaguggaucggacagaggcgaaggagggacucaaaagaggcgaaauuacccaucacgccguuagccggggguccgcuaaacuucagugguuugucgagcgcaauauggugauccccgaaggaagagugauugaccugggcuguggcagaggcggguggucuuacuauugcgccgggcugaagaaagucacggagguucgcggguacaccaagggaggcccugggcaugaggaacccgugccuaugagcacauacggauggaacaucgugaaacucauguccggcaaggaugucuucuaucugcccccggagaaaugugacacccuucugugcgauaucggcgaaagcucuccuucccccacaguggaggaaagcagaaccauucggguucucaagaugguggagcccuggcugaagaauaaccaguucuguaucaaaguccugaauccuuacaugcccacagugauugagcaccucgaacgccuucaaagaaagcacgggggaaugcugguucggaacccucugucucgcaauuccacccaugagauguauuggaucagcaacggcacggggaauauuguggcuucugucaacauggugagcagacuccugcuuaaucgguuuacaaugacccacagacgcccgaccaucgaaaaagacguggaucugggagccggcacacggcaugucaacgcugagcccgaaacgccuaacauggacguuaucggggagagaauuaagcgcaucaaagaggaacacaauuccaccuggcacuacgacgaugagaaccccuauaagacaugggccuaccauggaucuuaugaagugaaggcgaccggcagcgccuccagcaugauuaauggcguggucaaacuccugacaaagccuugggacgugguucccauggugacccagauggcuaugacagauaccacgccguucgggcagcaacgggucuuuaaagagaagguggacaccagaacaccucgcuccaugcccggaacccggagaguuaugggcaucacagccgaauggcuguggcgcacccucgggcggaacaaaaagccuagacugugcacgcgcgaggaguucacaaagaaagugcggaccaaugcugccaugggagccgucuuuacagaagagaaccagugggauucugcgaaggcugccguggaagacgaggauuucuggauucuuguugacagagaacgcgagcugcacaaacucggcaagugugggagcugcguguacaauaugaugggcaaaagagagaagaaacugggagaauuuggcaaggccaaggggucccgggcuaucugguacauguggcuuggagcccgcuaucuggaguucgaagcucucggcuuucugaacgaggaucauugguucucuagagagaauagcuacuccggggucgaaggagagggccugcacaaacucggguauauccugcgggacauuucuaagauccccggcggagccauguacgcggaugacaccgccggcugggacacgagaauuaccgaagaugaccuucauaacgaggagaaaaucacacagcagauggauccugagcaccggcaacuggcuagcgccauuuuuaagcucaccuaucagaauaaaguggucaaggugcagcgccccacaccgaccgggacaguuauggacaucaucuccagaaaggaucagcggggaagcggccaaguggggaccuacggacugaacacguucacaaauauggaggcucagcuuauucgccagauggaaggcgaggggguccugucuaaagccgaccucgaaaacccucaucugcccgagaagaaaaucacccaguggcuggaaaccaagggcguggagagacucaaacggauggcgauuuccggagaugacugcgugguuaagcccaucgaugaccgcuuugccaaugcucugcuugcccugaacgauaugggcaaggugagaaaagacauuccucaauggcagccgagcaagggguggcaugauuggcagcagguccccuucuguucucaccauuuccacgagcucaucaugaaagacggacggaagcuggugguuccuugccgcccccaagacgaacuuauuggcagagcucggaucucccagggggccggauggagccugcgcgagacagcuugucucggcaaagccuaugcgcagauguggucucugauguacuuucacagacgggaucugcgccucgccuccaacgcuaucugcagcgccgugccuguccauugggugcccaccuccagaacaacguggagcauucacgcccaucaccaauggaugaccacagaagacaugcugaccgucuggaaucggguguggaucgaggauaacccuuggauggaagacaagacacccguuaccacgugggagaaugugccguaccuugggaagagagaggaucagugguguggcucucugauuggacucaccagccgcgcuacaugggcccagaacaucccuaccgcgauucagcaaguccggucccugaucggcaaugaagaguuccuugacuauaugcccucuaugaaaagauuucgcaaggaagaggagagcgaaggggcuaucugguga

SEQ ID NO: 20674 - RNA, 9873 nt, Artificial Sequence
  derived and/or modified CDS sequence (opt5) from DENV-3__EU596492__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucgugcugcuuaugcugguuacaccuucuaugaccaugagaugugugggagucggcaaccgggacuuuguggaagggcucagcggagccacauggguggaugucguucuggagcacggcgggugcgugaccaccauggcuaagaauaaacccacacuggacaucgagcuccagaagacggaagccacccaacuggcgacacuucgcaaacuguguauugagggaaagaucaccaacauuacaaccgauuccagaugcccuacgcagggcgaagccgcucucccggaggaacaggaccagaauuauguguguaaacacacauacgucgaucggggcugggggaacggaugcggccuguucgggaagggaagccuugugaccugcgccaaguuucaaugucuggagcccaucgagggcaaaguugugcaguaugaaaaucucaaguacaccgucauuaucacagugcauaccggggaccagcaccagguuggaaacgagacacaaggcgugacggcugaaaucaccccucaggccucuacaaccgaggccauucugcccgaauauggcacacuggggcucgagugcuccccucgcaccggacuggacuucaaugagaugauccuucugacgaugaaaaacaaggcuuggaugguccauagacagugguuuuucgaucucccccugccguggaccagcggcgcgacaaccgaaacaccuaccuggaaucggaaagagcuucuggugacguuuaagaacgcccacgcuaaaaagcaagaagucgugguucucgggucucaggagggagccaugcacacagcccugaccggcgcuacagaaauucagaauuccgggggcaccagcaucuucgccggacaucugaagugucgccucaaaauggacaagcuggagcuuaaaggcaugucuuacgcgaugugcaccaacacauuugugcugaagaaagaggucuccgaaacgcagcacgggaccauucucaucaagguggaguacaagggagaagaugcucccuguaaaaucccuuucagcacagaggacggccaagggaaggcccauaacggaagacugauuaccgccaaucccguugugacaaaaaaggaggaacccgucaacaucgaggcugaaccuccguucggcgaguccaauauugugaucgggauuggcgauaacgcccugaaaaucaauugguauaagaagggaucuagcaucggcaaaauguuugaagcuaccgcccggggggcgagacgcauggccauucuuggagacacggcuugggauuucggcuccguggggggaguucucaacagccugggcaagaugguccaccagaucuuugggucugccuacacagcucuguucuccggcgugagcugggugaugaaaauuggaaucggcguccuccugaccuggauugggcuuaauucuaagaacaccagcauguccuuuucuugcaucgccauuggaaucaucacacuguaucucggcgcggugguucaggccgacaccggguguguggucaauuggaaaggaaaggagcugaagugcggcagcgggauuuucgugacaaacgagguucauacguggaccgaacaguacaaauuucaagcugauucccccaagcggcuggccacagcuaucgccggcgccugggagaauggaguguguggcauuagaagcaccacacgcauggaaaaccuucucuggaaacaggucgcuaaugagcugaacuauauccugugggaaaauaacauuaagcucaccgugguugugggggacaucaucggaguccuggagcagggcaaacggacgcuuaccccucagcccauggagcugaaguacucuuggaaaacaugggggaaggcgaagauugugaccgccgaaacacaaaacuccagcuucaucauugauggaccuaauacccccgagugcccgucugcuuccagagccuggaacgugugggaagucgaggacuauggcuuuggcguuuucacaaccaauaucuggcucaaacugcgcgaaguguacacgcagcugugugaccaccggcuuaugagcgccgcugugaaggaugagagagccguccacgcggacaugggguacuggauugagucccagaaaaacggaucuuggaagcucgaaaaagcuagccugaucgaggugaagacaugcaccuggccuaagucccauacccuguggucuaauggcguucucgaaagcgauaugaucauucccaaaucccuggccgggccuaucagccagcacaacuaucgccccggauaccauacacaaaccgccggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauaugguuaaaucccuggugagcgcuggaucuggcaaggucgacaacuucaccaugggggugcugugccucgccauccuguuugaagagguuaugcggggaaaguucggcaaaaagcauaugauugcgggcguguucuuuacauucguccuucugcucagcgggcagaucaccuggcgcgauauggcucacacacugauuaugaucggauccaaugccagcgacagaaugggcaugggggugaccuaccuggcccuuauugcuacguuuaaaauccagcccuuccuggcccucggauuuuuccugcggaagcucacaucuagagaaaaccugcuucugggcguggggcucgcuauggccaccacacugcaacugccugaggauauugaacagauggcgaauggaaucgcccuuggccugauggcucucaaacugaucacccaguuugagaccuaucagcucuggacagcccugauuucccuuacguguagcaacaccaucuucacacugaccgucgcuuggcgcacagccacccucauucuggccggcguuucccugcuuccggugugccaaucuagcuccaugcggaagucugacuggcugcccaugacgguggcugcgaugggggucccuccccucccucuguuuaucuucagccucaaggauacacugaaaagacgcuccuggccccuuaaugagggagugauggccguuggccuggugucuauucuggcuagcucccuccugagaaacgacgucccuauggccgggccccuuguggccggaggccugcucaucgcuuguuacguuaucaccgggaccagcgccgaucugacaguggaaaaggcggcugacgucaccugggaggaagaggccgaacagacaggagugucucauaaccucaugauuacggucgacgaugacggcaccaugcggaucaaagaugacgagacagagaauauucugaccgugcuucugaagacagcccugcucaucguuuccggcauuuuuccguacagcaucccugcuacccugcuuguguggcacacguggcagaaacagacccgcagaucugggguccugugggaugugcccuccccucccgaaacacaaaaggccgagcucgaagagggaguuuaucggaucaaacagcagggcauuuucgggaagacccaggugggagucggcgugcaaaaggaggggguguuucauacaauguggcacguuacccgcggagcgguccugacauacaacggcaaaagacucgaaccgaauugggcuagcgugaagaaagaccugaucucuuauggcgggggauggcggcuuuccgcccaguggcagaagggcgaggaagugcaagucauugccguggagccugggaaaaaccccaagaauuuccagacgaugccuggaaccuuccagacaaccaccggcgaaaucggggcuauugcccuggauuuuaagcccggaacaagcggcucccccaucauuaaccgcgagggcaaaguuguggggcuguacggaaauggcgucgugacgaagaacgggggauauguuagcggcaucgcucagaccaaugccgagccugacgggccgacacccgaacucgaggaagagauguucaaaaagagaaaccugaccaucauggaucuucacccuggcucuggaaaaacacggaaguaccugcccgcgauugugcgcgaagccaucaagagacggcucagaacccugauucucgcuccuacgcgcgucguggccgcugagauggaggaagcccugaaaggccuucccauccgguaucaaacaaccgccaccaagagcgagcauacagggagagaaauuguugaccugaugugccacgcuaccuuuacaaugcgccugcucuccccugugcgggucccgaauuacaaccugaucaucauggaugaggcgcauuucaccgaccccgccucuauugcugccagaggauacaucagcacgcgcgugggcaugggggaagccgcugccauuuuuaugacagcgaccccucccggaacagcugaugccuucccucaguccaaugcccccauccaggacgaggagcgggacauuccggaaagaucuuggaacagcggcaaugaguggaucaccgauuuugcugggaaaacggugugguucgucccuuccaucaaggccggcaacgacauugcgaacugucuucgcaaaaauggaaagaagguuauccagcugucucggaaaaccuuugauacagaauaucaaaagaccaaacucaacgacugggauuucguggugacaaccgacauuagcgagaugggcgccaauuuuaaggcugauagagucaucgacccccggcgcugccugaaacccgugauucugacagaugggccugagagaguuauccucgccggacccaugccugugaccgcugccuccgcugcccagcggcgcggcagagucgggcggaacccgcagaaggaaaaugaccaguacauuuucacgggacaaccccuuaacaaugaugaggaccacgcgcauuggacagaagccaagaugcugcuggacaacaucaauaccccugagggcaucauucccgcucucuucgaaccugagagagagaaaagcgccgcuaucgauggggaauaucgccugaagggcgagucucggaaaaccuuuguggaacuuaugagacgcggagaccugcccguuuggcucgcccacaagguggccuccgagggcauuaaauacacagaucggaaguggugcuucgacgggcagagaaacaaucagauccuggaagagaacauggaugucgagauuuggaccaaagaaggagagaagaagaaacugcgcccgcgguggcucgacgcuagaacauauagcgauccucuugcgcugaaggaauuuaaagacuucgccgcuggccgcaagucuaucgcccuggaucucgugacggagaucgggagaguccccucccaccuggcccaucggacccgcaaugcucuugacaaccuggugaugcuccacacaagcgaacauggaggcaaagccuacagacacgcgguugaggagcugccugaaaccauggagacacugcuccuucugggccugaugauucuccugaccgggggagccaugcuuuuucugaucuccggcaaggggauuggaaagacgucuaucggccucauuugugugaucgcuagcuccgggaugcuguggauggccgaaaucccccugcaguggauugcuagcgccaucgugcucgaguucuuuaugaugguccuucugauuccugagcccgaaaaacaacggaccccgcaggauaaucagcuggcguauguugugaucggaauucucacacuggccgcuaucauugccgcuaacgagaugggccuucuggaaaccacaaagcgcgaccucggcaugucuaaagagccugggguggucucccccaccagcuaccuggauguggaccugcaccccgccucugcuuggacgcucuacgccguugcgacaaccgugaucacaccuaugcuuagacauaccaucgaaaauagcaccgccaacgucucccuggcugccauugcuaaccaagccgugguccugaugggacucaauaagggcuggccgaucucuaaaauggaccugggggugccccuucuggcccucggaugcuauagccagguuaacccucugacacugacggcggcugugcuccuucugauuacccacuacgccaucauuggccccgggcugcaggcuaaggccacacgggaggcccagaagagaaccgcugccggaaucaugaaaaauccuacagucgauggcaucaugaccauugaccucgaucccgugaucuaugacuccaaguucgagaaacaacugggccagguuaugcuucuggugcucugugcgguccagcugcugcucaugcgcacgucuugggcccuuugcgaagcucugacacuggccaccgggccuauuaccacacucugggagggaagcccgggcaaguuuuggaacaccacaaucgcuguguccauggccaauauuuuccgggggagcuaccuggcgggagccggccuugcuuuuucuaucaugaaauccguggggacgggaaagagaggcaccggcagccagggggaaacacugggagagaaguggaaaaagaaacucaaccaacugucccgcaaggaauucgaucuguauaaaaagucuggcaucaccgagguugaccggacagaggccaaagaagggcucaagagaggagagauuacccaucacgcugucagccggggcuccgccaagcuucagugguuuguggaacgcaauauggugauccccgaggggagagucauugaucugggauguggccggggcggguggucuuacuauugcgcuggacugaaaaagguuacggaagugcgcggcuacaccaaagggggaccuggccaugaggagcccgugccuaugagcacauacggguggaacaucgucaagcucauguccggaaaagacguguucuaucugcccccggaaaagugugauacccuucugugcgacauuggcgagagcucuccuucccccacaguugaagagagcagaaccauccgggugcucaagauggucgagcccuggcugaaaaauaaccaguucuguauuaaggugcugaauccuuacaugcccacaguuaucgaacaccucgagcgccuucagagaaaacacggcgggaugcuggugcggaacccucugucucgcaauuccacccaugaaauguauuggaucagcaacggaacgggcaauauugucgccucugugaacauggugagcagacuccugcuuaaccgguuuacaaugacccacagacgcccgaccaucgagaaggaugucgaccugggggcgggaacacggcauguuaaugccgaacccgagacgccuaacauggaugugauuggcgagagaaucaaacgcauuaaggaagagcacaauuccaccuggcacuacgacgacgaaaaccccuauaagacaugggcuuaccaugggucuuaugaggugaaagccaccggaagcgcuuccagcaugaucaauggcgucgugaagcuccugacaaaaccuugggauguugugcccauggucacccaaauggccaugacagacaccacgccguucggccagcagcggguguuuaaggaaaaaguugauaccagaacaccucgcuccaugcccgggacccggagagugaugggaaucacagccgaguggcuguggcgcacccucggccggaacaagaagccuagacugugcacgcgcgaggaauucacaaaaaagguccggaccaaugcggcuaugggggccguguuuacagaggaaaaccaaugggacucugccaaagcugccguugaggaugaagacuucuggaagcuuguggauagagagcgcgagcugcacaaacucggaaaguguggcagcugcgucuacaauaugauggggaaaagagaaaagaagcugggcgaguuuggaaaagcuaagggcucccgggccauuugguacauguggcuuggggcgcgcuaucuggaauucgaggcccucggauuucugaacgaggaccauugguucucuagagaaaauagcuacuccggcguggagggggaaggacugcacaaacucggcuauauccugcgggauauuucuaagauccccgggggcgcuauguacgccgacgauaccgcuggaugggacacgagaauuaccgaggacgaucuucauaacgaagagaaaaucacacagcagauggacccugagcaccggcagcuggccaaugcgaucuuuaagcucaccuaucaaaacaaggucgugaaaguucagcgccccacaccgaccggcacagugauggauauuaucagcagaaaggaccagcggggguccggacaggucggcaccuacgggcugaauacguucacaaacauggaagcccaacuuauucgccagauggagggagaaggcgugcugaccaaagcugaucucgagaacccucaccugagcgaaaagaaaaucacccaguggcuggagacaaaggggguggagagacucaagcggauggccauuucuggcgacgauugcguugugaaacccaucgacgaucgcuuugcuaaugcccugcuugcucugaacgacaugggaaaggucagaaaagauaugccccaguggcaaccuuccaagggcuggcaugacuggcagcaggugccguucuguagccaccauuuccacgaacucaucaugaaagaugggcggaagcugguugugcccugccgcccucaggacgagcuuauuggaagagcccggaucucucaaggcgcgggguggucccugcgcgaaaccgccugucucggaaaggcuuaugcccagauguggagccugauguacuuucacagacgggaccugcgccucgccucuaaugcuauuugcuccgccguccccgugcauugggucccuacaagcagaacgaccugguccauccacgcgcaucaccaguggaugacaaccgaggauaugcugacaguguggaaccggguuuggauugaagacaaucccuggauggaggauaaaaccccugugacgaccugggagaacguccccuaccuuggcaagagagaagaccaauggugugggagccugaucggccucacaucucgcgcuaccugggcccagaauauuccgacagccauccagcaggugcggagccugaucggaaacgaggaauuccuugauuauaugccuuccaugaaaagauuucgcaaggaggaggaaucugagggcgcuauuugguga

SEQ ID NO: 20675 - RNA, 9873 nt, Artificial Sequence
  derived and/or modified CDS sequence (opt5) from DENV-3__EU596493__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucgugcugcuuaugcugguuacaccuucuaugaccaugagaugugugggagucggcaaccgggacuuuguggaagggcucagcggagccacauggguggaugucguucuggagcacggcgggugcgugaccaccauggcuaagaauaaacccacacuggacaucgagcuccagaagacggaagccacccaacuggcgacacuucgcaaacuguguauugagggaaagaucaccaacauuacaaccgauuccagaugcccuacgcagggcgaagccgugcucccggaggaacaggaccagaauuaugucuguaaacacacauacguggaucggggcugggggaacggaugcggccuguucgggaagggaagccuuguuaccugcgcuaaguuucaaugucuggagcccaucgagggcaaagugguccaguaugaaaaucucaaguacaccgugauuaucacaguucauaccggggaccagcaccaggugggaaacgagacacaaggcgucacggccgaaaucaccccucaggcuucuacaaccgaggccauucugcccgaauauggcacacuggggcucgagugcuccccucgcaccggacuggacuucaaugagaugauccuucugacgaugaaaaacaaggccuggauggugcauagacagugguuuuucgaucucccccugccguggaccagcggcgcuacaaccgaaacaccuaccuggaaucggaaagagcuucuggucacguuuaagaacgcgcacgccaaaaagcaagaagugguugugcucgggucucaggagggagcuaugcacacagcccugaccggcgccacagaaauucagaauuccgggggcaccagcaucuucgcuggacaucugaagugucgccucaaaauggacaagcuggagcuuaaaggcaugucuuacgccaugugcaccaacacauuuguccugaagaaagagguguccgaaacgcagcacgggaccauucucaucaagguugaguacaagggagaagaugcgcccuguaaaaucccuuucagcacagaggacggccaagggaaggcucauaacggaagacugauuaccgccaaucccguggucacaaaaaaggaggaacccgugaacaucgaggccgaaccuccguucggcgaguccaauauugugaucgggauuggcgauaacgcucugaaaaucaauugguauaagaagggaucuagcaucggcaaaauguuugaagccaccgcucggggggccagacgcauggcgauucuuggagacacggccugggauuucggcuccguugggggaguccucaacagccugggcaagauggugcaccagaucuuugggucugcuuacacagcccuguucuccggcgugagcugggucaugaaaauuggaaucggcgugcuccugaccuggauugggcuuaauucuaagaacaccagcauguccuuuucuugcaucgcuauuggaaucaucacacuguaucucggcgccguugugcaggcggacaccgggugugucauuaauuggaaaggaaaggagcugaagugcggcagcgggaucuucgugacaaacgagguucauacguggaccgaacaguacaaauuucaagccgauucccccaagcggcuggcuacagccauugcuggcgccugggagaauggaguguguggcaucagaagcaccacacgcauggaaaaccuucucuggaaacaggucgccaaugagcugaacuauauucugugggaaaauaacaucaagcucaccgugguugugggggacaucauuggaguccuggagcagggcaaacggacgcuuaccccucagcccauggagcugaaguacucuuggaaaacaugggggaaggcuaagaucgugaccgcggaaacacaaaacuccagcuucauuaucgauggaccuaauacccccgagugcccgucugccuccagagcuuggaacgugugggaagucgaggacuauggcuuuggcguuuucacaaccaauauuuggcucaaacugcgcgaaguguacacgcagcugugugaccaccggcuuaugagcgccgccgugaaggaugagagagcuguccacgccgacaugggguacuggaucgagucccagaaaaacggaucuuggaagcucgaaaaagcgagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauucacgaguggugcugucgcagcugcacgcuuccgccucuccgguacaugggagaagauggcuguugguaugggauggagaucagacccaucucugaaaaggaggagaauaugguuaaaucccuggugagcgccggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcgcacacacugaucaugauuggauccaaugcuagcgacagaaugggcaugggggugaccuaccuggcccuuaucgccacguuuaaaauucagcccuuccuggcucucggauuuuuccugcggaagcucacaucuagagaaaaccugcuucugggcguggggcucgccauggcuaccacacugcaacugccugaggauaucgaacagauggccaauggaaucgcgcuuggccugauggcccucaaacugauuacccaguuugagaccuaucagcucuggacagcucugaucucccuuacguguagcaacaccauuuucacacugaccgucgccuggcgcacagcuacccucauccuggccggcguuucccugcuuccggugugccaaucuagcuccaugcggaagucugacuggcugcccaugacgguggccgcuaugggggucccuccccucccucuguuuauuuucagccucaaggauacacugaaaagacgcuccuggccccuuaaugagggagugauggcgguuggccuggugucuauccuggccagcucccuccugagaaacgacgucccuauggcugggccccuuguggccggaggccugcucaucgccuguuacguuauuaccgggaccagcgcugaucugacaguggaaaaggccgcggacgucaccugggaggaagaggcugaacagacaggagugucucauaaccucaugaucacggucgacgaugacggcaccaugcggauuaaagaugacgagacagagaauauccugaccgugcuucugaagacagcccugcucauuguuuccggcaucuuuccguacagcaucccugccacccugcuuguguggcacacguggcagaaacagacccgcagaucugggguccugugggaugugcccuccccucccgaaacacaaaaggcugagcucgaagagggaguuuaucggauuaaacagcagggcaucuucgggaagacccaggugggagucggcgugcaaaaggaggggguguuucauacaauguggcacguuacccgcggagccguccugacauacaacggcaaaagacucgaaccgaauugggcgagcgugaagaaagaccugauuucuuauggcgggggauggcggcuuaacgcucaguggcagaagggcgaggaagugcaagucaucgccguggagccugggaaaaaucccaagaacuuccagacgaugccuggaaccuuccagacaaccaccggcgaaauuggggccaucgcucuggauuuuaagcccggaacauccggcagccccauuaucaaucgcgagggcaaaguuguggggcuguacggaaacggcgucgugacgaagaaugggggauauguuuccggcaucgcccagaccaacgcugagccugacgggccgacacccgaacucgaggaagagauguucaaaaagagaaaucugaccauuauggaucuucacccuggcagcggaaaaacacggaaguaccugcccgccaucgugcgcgaagcgauuaagagacggcucagaacccugauccucgccccuacgcgcgucguggcugccgagauggaggaagcucugaaaggccuucccauucgguaucaaacaaccgccaccaagucugagcauacagggagagaaaucguugaccugaugugccacgccaccuuuacaaugcgccugcucagcccugugcgggucccgaacuacaaucugaucauuauggaugaggcucauuucaccgaccccgcguccaucgccgcuagaggauacauuucuacgcgcgugggcaugggggaagccgccgcuaucuuuaugacagccaccccucccggaacagcggaugcuuucccucagagcaacgcccccauucaggacgaggagcgggacaucccggaaagauccuggaauucuggcaacgaguggaucaccgauuuugccgggaaaacggugugguucgucccuagcauuaaggcuggcaacgacaucgccaauugucuucgcaaaaacggaaagaagguuauucagcugucccggaaaaccuuugauacagaauaucaaaagaccaaacucaaugacugggauuucguggugacaaccgacaucucugagaugggcgcgaacuuuaaggccgauagagucauugacccccggcgcugccugaaacccgugauccugacagaugggccugagagaguuauucucgcuggacccaugccugugaccgccgcuagcgccgcucagcggcgcggcagagucgggcggaauccgcagaaggaaaacgaccaguacaucuucacgggacaaccccuuaauaacgaugaggaccacgcccauuggacagaagcgaagaugcugcuggacaauaucaacaccccugagggcauuauccccgcccucuucgaaccugagagagagaaauccgcugccauugauggggaauaucgccugaagggcgagagccggaaaaccuuuguggaacuuaugagacgcggagaccugcccguuuggcucgcucacaagguggccucugagggcaucaaauacacagaucggaaguggugcuucgacgggcagagaaauaaccagauucuggaagagaauauggaugucgagaucuggaccaaagaaggagagaagaagaaacugcgcccgcgguggcucgacgccagaacauauuccgauccucuugcucugaaggaauuuaaagacuucgcggccggccgcaagagcaucgcucuggaucucgugacggagauugggagaguccccucucaccuggcccaucggacccgcaacgcccuugacaaucuggugaugcuccacacauccgaacauggaggcaaagcuuacagacacgccguugaggagcugccugaaaccauggagacacugcuccuucugggccugaugauccuccugaccgggggagcgaugcuuuuucugauuagcggcaaggggaucggaaagacguccauuggccucaucugugugaucgccucuagcgggaugcuguggauggcugaaauuccccugcaguggaucgccuccgcuauugugcucgaguucuuuaugaugguccuucugaucccugagcccgaaaaacaacggaccccgcaggauaaccagcuggccuauguugugauuggaauccucacacuggcggccauuaucgcugccaaugagaugggccuucuggaaaccacaaagcgcgaccucggcaugagcaaagagccugggguggucucucccaccuccuaccuggauguggaccugcaccccgcuagcgccuggacgcucuacgcuguugccacaaccgugaucacaccuaugcuuagacauaccauugaaaacucuaccgcgaacgucagccuggccgcuaucgccaaucaagcugugguccugaugggacucgacaagggcuggccgauuuccaaaauggaucugggggugccccuucuggcccucggaugcuauucucagguuaacccucugacacugacggccgcggugcuccuucugaucacccacuacgcuauuaucggccccgggcugcaggccaaggcuacacgggaggcccagaagagaaccgccgcuggaaucaugaaaaauccuacagucgacggcauuaugaccaucgaucucgaccccgugauuuaugauagcaaguucgagaaacaacugggccagguuaugcuucuggugcucugugccguccagcugcugcucaugcgcacguccugggcgcuuugcgaagcccugacacuggcuaccgggccuaucaccacacucugggagggaucuccgggcaaguuuuggaacaccacaauugccgugagcauggcuaauaucuuccggggguccuaccuggccggagcgggccuugccuuuagcaucaugaaaucuguggggacgggaaagagaggcaccggcucccagggggaaacacugggagagaaguggaaaaagaaacucaaccaacugagccgcaaggaauucgaccuguauaaaaaguccggcauuaccgagguugaucggacagaggcuaaagaagggcucaagagaggagagaucacccaucacgccgucucucggggcagcgcuaagcuucagugguuuguggaacgcaauauggugauucccgaggggagagucaucgaccugggauguggccggggcgggugguccuacuauugcgccggacugaaaaagguuacggaagugcgcggcuacaccaaagggggaccuggccaugaggagcccgugccuaugucuacauacggguggaacauugucaagcucaugagcggaaaagauguguucuaucugcccccggaaaagugugacacccuucugugcgauaucggcgaguccagcccuucucccacaguugaagaguccagaaccauucgggugcucaagauggucgagcccuggcugaaaaauaaccaguucuguaucaaggugcugaauccuuacaugcccacaguuaucgaacaccucgagcgccuucagagaaaauauggcgggaugcuggugcggaacccucugagccgcaauucuacccacgaaauguacuggauuuccaacggaacgggcaauaucgucgcuagcgugaacauggugucuagacuccugcuuaaccgguuuacaaugacccauagacgcccgaccauugagaaggacgucgaucugggggccggaacacggcacguuaaugcggaacccgagacgccuaacauggacgugaucggcgagagaauuaaacgcaucaaggaagagcauaauagcaccuggcacuaugacgaugaaaaccccuacaagacaugggccuaucacggguccuacgaggugaaagcuaccggaucugccagcuccaugaucaauggcgucgugaagcuccugacaaaaccuugggacguugugcccauggucacccaaauggcuaugacagauaccacgccguucggccagcagcggguguuuaaggaaaaaguugacaccagaacaccucgcagcaugcccgggacccggagagugaugggaauuacagccgaguggcuguggcgcacccucggccggaacaagaagccuagacugugcacgcgcgaggaauucacaaaaaagguccggaccaaugccgcgaugggggcuguguuuacagaggaaaaccaaugggauuccgccaaagccgcuguugaggacgaagauuucuggaagcuuguggacagagagcgcgagcugcauaaacucggaaaguguggcucuugcgucuacaauaugauggggaaaagagaaaagaagcugggcgaguuuggaaaagccaagggcagccgggcuaucugguauauguggcuuggggcccgcuaccuggaauucgaggcgcucggauuucugaacgaggaucacugguucuccagagaaaauucuuauagcggcguggagggggaaggacugcauaaacucggcuacauucugcgggacaucuccaagauucccgggggcgccauguaugcugaugacaccgccggaugggacacgagaaucaccgaggaugaccuucacaacgaagagaaaaucacacagcagauggauccugagcaucggcagcuggcuaaugccauuuuuaagcucaccuaccaaaacaaggucgugaaaguucagcgccccacaccgaccggcacagugauggacaucauuucuagaaaggaucagcgggggagcggacaggucggcaccuaugggcugaauacguucacaaacauggaagcgcaacuuauccgccagauggagggagaaggcgugcugaccaaagccgaccucgagaacccucaccuguccgaaaagaaaauuacccaguggcuggagacaaaggggguggagagacucaagcggauggcuaucagcggcgaugacugcguugugaaacccaucgaugaccgcuuugccaaugcucugcuugcccugaacgauaugggaaaggucagaaaagacauuccccaguggcaaccuucuaagggcuggcacgauuggcagcaggugccguucuguucccaucacuuccaugaacucaucaugaaagacgggcggaagcugguugugcccugccgcccucaggacgagcuuauuggaagagcucggaucagccaaggcgccggguggucucugcgcgaaaccgcgugucucggaaaggccuacgcucagauguggucccugauguacuuucacagacgggaucugcgccucgccagcaaugccauuugcucugcuguccccgugcacugggucccuacauccagaacgaccuggagcauccaugcccaccaucaguggaugacaaccgaggacaugcugacaguguggaaccggguuuggauugaagauaaucccuggauggaggacaaaaccccugugacgaccugggagaacguccccuaucuuggcaagagagaagaucaauggugugggucccugaucggccucacaagccgcgcgaccugggcucagaauaucccgacagccauucagcaggugcggucucugaucggaaacgaggaauuccuugacuacaugccuagcaugaaaagauuucgcaaggaggaggaauccgagggcgccauuugguga

SEQ ID NO: 20676 - RNA, 9873 nt, Artificial Sequence
  derived and/or modified CDS sequence (opt5) from DENV-3__EU596494__SS-prME
accagccugugccucaugaugauccugcccgcggcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucgccgaaguugaacccgaagacauugauugcugguguaaccucacauccaccugggugacauauggaaccugcaaucaggccggcgaacaccggcgggacaagcgcucuguggcucuggccccucaugucgggaugggacuggauacgcggacccagacauggaugagcgcugaaggcgccuggagacagguggaaaaaguugagaccugggcgcuccgccaccccggcuucacaauccuggcccuuuuucuggcucauuacaucgggaccucccucacgcagaagguggucauuuucgugcugcuuaugcugguuacaccuucuaugaccaugagaugugugggagucggcaaccgggacuuuguggaagggcucagcggagccacauggguggaugucguucuggagcacggcgggugcgugaccaccauggcuaagaauaaacccacacuggacaucgagcuccagaagacggaagccacccaacuggcgacacuucgcaaacuguguauugagggaaagaucaccaacauuacaaccgauuccagaugcccuacgcagggcgaagccgugcucccggaggaacaggaccagaauuaugucuguaaacacacauacguggaucggggcugggggaacggaugcggccuguucgggaagggaagccuuguuaccugcgcuaaguuucaaugucuggagcccaucgagggcaaagugguccaguaugaaaaucucaaguacaccgugauuaucacaguucauaccggggaccagcaccaggugggaaacgagacacaaggcgucacggccgaaaucaccccucaggcuucuacaaccgaggccauucugcccgaauauggcacacuggggcucgagugcuccccucgcaccggacuggacuucaaugagaugauccuucugacgaugaaaaacaaggccuggauggugcauagacagugguuuuucgaucucccccugccguggaccagcggcgcuacaaccgaaacaccuaccuggaaucggaaagagcuucuggucacguuuaagaacgcgcacgccaaaaagcaagaagugguugugcucgggucucaggagggagcuaugcacacagcccugaccggcuccacagaaauucagaauagcgggggcaccucuaucuucgccggacaucugaagugucgccucaaaauggacaagcuggagcuuaaaggcauguccuacgcuaugugcaccaacacauuuguccugaagaaagaggugagcgaaacgcagcacgggaccauucucaucaagguugaguacaagggagaagaugcccccuguaaaaucccuuucuccacagaggacggccaagggaaggcgcauaacggaagacugauuaccgcuaaucccguggucaccaagaaggaggaacccgugaacaucgaggccgaaccuccguucggcgagucuaauauugugaucgggauuggcgauaacgcccugaaaaucaauugguauaagaagggaagcuccaucggcaaaauguuugaagcuaccgccagaggggcuagacgcauggccauucuuggagacacggcgugggauuucggcagcguugggggaguccucaacucucugggcaagauggugcaccagaucuuuggguccgccuacacagcucuguucagcggcgugucuugggucaugaaaauuggaaucggcgugcuccugaccuggauugggcuuaauagcaagaacaccuccaugucuuuuagcugcaucgccauuggaaucaucacacuguaucucggcgcuguugugcaggccgacaccgggugugucauuaauuggaaaggaaaggagcugaagugcggcuccgggaucuucgugacaaacgagguucauacguggaccgaacaguacaaauuucaagcggauagccccaagcggcuggccacagcuauugccggcgcuugggagaauggaguguguggcaucagaucuaccacacgcauggaaaaccuucucuggaaacaggucgccaaugagcugaacuauauucugugggaaaauaacaucaagcucaccgugguugugggggacaucauuggaguccuggagcagggcaaacggacgcuuaccccucagcccauggagcugaaguacuccuggaaaacaugggggaaggccaagaucgugaccgcugaaacacaaaacagcucuuucauuaucgauggaccuaauacccccgagugcccguccgcgagcagagccuggaacgugugggaagucgaggacuauggcuuuggcguuuucacaaccaauauuuggcucaaacugcgcgaaguguacacgcagcugugugaccaccggcuuauguccgcugccgugaaggaugagagagccguccacgcugacaugggguacuggaucgagucucagaaaaacggaagcuggaagcucgaaaaagccucccugaucgaggugaagacaugcaccuggccuaagucucauacccuguggagcaauggcguucucgaauccgauaugauuauccccaaaagccuggcggggccuauuucucagcacaacuaucgccccggauaccauacacaaaccgcuggcccuuggcaccuugggaagcuggagcucgacuuuaauuauugcgagggaacgacaguggucaucaccgaaaacuguggcacacggggccccucccugagaaccacaaccgugagcgggaaacugauucacgaguggugcugucgcucuugcacgcuuccgccucuccgguacaugggagaagauggcuguugguaugggauggagaucagacccaucuccgaaaaggaggagaauaugguuaaaagccuggugucugccggaagcggcaaggucgacaacuucaccaugggggugcugugccucgccauucuguuugaagagguuaugcggggaaaguucggcaaaaagcauaugaucgcuggcguguucuuuacauucguccuucugcucuccgggcagauuaccuggcgcgauauggcccacacacugaucaugauuggaagcaaugcgucugacagaaugggcaugggggugaccuaccuggcucuuaucgccacguuuaaaauucagcccuuccuggcccucggauuuuuccugcggaagcucacauccagagaaaaccugcuucugggcguggggcucgcuauggccaccacacugcaacugccugaggauaucgaacagauggcuaauggaaucgcccuuggccugauggcgcucaaacugauuacccaguuugagaccuaucagcucuggacagcccugaucagccuuacguguuccaacaccauuuucacacugaccgucgcuuggcgcacagccacccucauccuggcuggcguuucucugcuuccggugugccaaagcuccucuaugagaaagagcgacuggcugcccaugacgguggccgccaugggggucccuccccucccucuguuuauuuucucccucaaggauacacugaaaagacgcucuuggccccuuaaugagggagugauggcuguuggccuggugagcauccuggcguccagccuccugagaaacgacgucccuauggccgggccccuuguggcuggaggccugcucaucgccuguuacguuauuaccgggaccucugccgaucugacaguggaaaaggcugccgacgucaccugggaggaagaggcggaacagacaggagugucccauaaccucaugaucacggucgacgaugacggcaccaugcggauuaaagaugacgagacagagaauauccugaccgugcuucugaagacagcucugcucauuguuagcggcaucuuuccguacucuaucccugccacccugcuuguguggcacacguggcagaaacagacccgcagauccgggguccugugggaugugcccagcccucccgaaacacaaaaggccgagcucgaagagggaguuuaucggauuaaacagcagggcaucuucgggaagacccaggugggagucggcgugcaaaaggaggggguguuucauacaauguggcacguuacccgcggagcuguccugacauacaacggcaaaagacucgaaccgaauugggccucugugaagaaagaccugauuuccuauggcgggggauggcggcuuagcgcgcaguggcagaagggcgaggaagugcaagucaucgcuguggagccugggaaaaaccccaagaauuuccagacgaugccuggaaccuuccagacaaccaccggcgaaauuggggccaucgcccuggauuuuaagcccggaacauccggcagccccauuaucaaccgcgagggcaaaguuguggggcuguacggaaauggcgucgugacgaagaacgggggauauguuucuggcaucgcucagaccaaugccgagccugacgggccgacacccgaacucgaggaagagauguucaaaaagagaaaccugaccauuauggaucuucacccuggcagcggaaaaacacggaaguaccugcccgcuaucgugcgcgaagccauuaagagacggcucagaacccugauccucgcgccuacgcgcgucguggccgcugagauggaggaagcccugaaaggccuucccauucgguaucaaacaaccgcuaccagauccgagcauacagggcgcgaaaucguugaccugaugugccacgccaccuuuacaaugcggcugcucucuccugugagagucccgaauuacaaccugaucauuauggaugaggcccauuucaccgaccccgcuagcaucgcggcccgcggauacauuuccacgcgggugggcaugggggaagcugccgccaucuuuaugacagcuaccccucccggaacagccgaugcguucccucagucuaaugcucccauucaggacgaggagagagacaucccggaacgcagcuggaacuccggcaaugaguggaucaccgauuuugccgggaagacggugugguucgucccuucuauuaaagccggcaacgacaucgcuaacugucuucggaagaauggcaaaaagguuauucagcugagcagaaagaccuuugauacagaauaucagaagacaaagcucaacgacugggauuucguggugacaaccgacaucuccgagaugggagccaauuuuaaagcggaucgggucauugacccccgcagaugccugaagcccgugauccugacagaugggccugagcggguuauucucgccggacccaugccugugaccgcugccagcgcugcccagcgcagaggccgggucgggagaaacccgcagaaagaaaaugaccaguacaucuucacgggacaaccccuuaacaaugaugaggaccacgcucauuggacagaagccaagaugcugcuggacaacaucaauaccccugagggcauuauccccgcccucuucgaaccugagcgcgagaagucugccgcuauugauggggaauaucggcugaaaggcgaguccagaaagaccuuuguggaacuuaugcgccggggagaccugcccguuuggcucgcccacaaaguggcuagcgagggcaucaaguacacagauagaaaauggugcuucgacgggcagcgcaacaaucagauucuggaagagaacauggaugucgagaucuggaccaaggaaggagagaaaaagaagcugcggccgagauggcucgacgcccgcacauauucugauccucuugcccugaaagaauuuaaggacuucgcugcgggcagaaaauccaucgcccuggaucucgugacggagauugggcggguccccagccaccuggcucaucgcaccagaaaugcccuugacaaccuggugaugcuccacacauccgaacauggaggcaaggccuaccggcacgcuguugaggagcugccugaaaccauggagacacugcuccuucugggccugaugauccuccugaccgggggagccaugcuuuuucugauuucuggcaaagggaucggaaagacgagcauuggccucaucugugugaucgcguccagcgggaugcuguggauggccgaaauuccccugcaguggaucgcuucugccauugugcucgaguucuuuaugaugguccuucugaucccugagcccgaaaagcaacgcaccccgcaggauaaucagcuggcuuauguugugauuggaauccucacacuggccgcgauuaucgccgcuaacgagaugggccuucuggaaaccacaaaaagagaccucggcauguccaaggagccugggguggucagccccaccucuuaccuggauguggaccugcaccccgccagcgcuuggacgcucuacgccguugcuacaaccgugaucacaccuaugcuucggcauaccauugaaaauuccaccgccaacgucucucuggcggccaucgcuaaccaagccgugguccugaugggacucgacaaaggcuggccgauuagcaagauggaucugggggugccccuucuggcucucggaugcuauucccagguuaauccucugacacugacggccgccgugcuccuucugaucacccacuacgcgauuaucggccccgggcugcaggcuaaagccacaagagaggcucagaagcgcaccgccgccggaaucaugaagaacccuacagucgacggcauuaugaccaucgaucucgaccccgugauuuaugauucuaaauucgagaagcaacugggccagguuaugcuucuggugcucugugcuguccagcugcugcucaugcggacgagcugggcccuuugcgaagcgcugacacuggccaccgggccuaucaccacacucugggagggauccccgggcaaauuuuggaauaccacaauugcugugagcauggccaacaucuucagagggucuuaccuggcuggagccggccuugcguuuuccaucaugaaaagcguggggacgggaaaacgcggcaccggcucccagggggaaacacugggagagaaguggaagaaaaagcucaaucaacugucucggaaagaguucgaccuguauaagaaaagcggcauuaccgagguugauagaacagaggccaaggaagggcucaaacggggagagaucacccaucacgcugucucccgcggcucugccaaacuucagugguuuguggaaagaaacauggugauucccgaggggcgggucaucgaccugggauguggccgcggcggguggagcuacuauugcgcuggacugaagaaaguuacggaagugagaggcuacaccaaagggggaccuggccaugaggagcccgugccuauguccacauacggguggaauauugucaaacucaugagcggaaaggauguguucuaucugcccccggaaaaaugugacacccuucugugcgauaucggcgagucuuccccuagccccacaguugaagagucucggaccauucgcgugcucaagauggucgagcccuggcugaagaacaaucaguucuguaucaaagugcugaacccuuacaugcccacaguuaucgaacaccucgagagacuucagcggaagcacggcgggaugcuggugcgcaauccucuguccagaaacagcacccaugaaauguauuggauuucuaauggaacgggcaacaucgucgccagcgugaauauggugucccggcuccugcuuaacagauuuacaaugacccaccgccggccgaccauugagaaagacgucgaucugggggcuggaacaagacauguuaacgccgaacccgagacgccuaauauggacgugaucggcgagcgcauuaagcggaucaaagaagaacacaacucuaccuggcacuacgacgaugaaaaucccuauaagacaugggcguaccaugggagcuaugaggugaaggccaccggauccgcuagcuccaugaucaacggcgucgugaaacuccugacaaagccuugggacguugugcccauggucacccaaauggccaugacagauaccacgccguucggccagcagagaguguuuaaagaaaagguugacacccgcacaccucggucuaugcccgggaccagacgcgugaugggaauuacagcugaguggcuguggcggacccucggcagaaauaaaaagccucgccugugcacgcgggaggaguucacaaagaaagucagaaccaacgccgccaugggggcgguguuuacagaggaaaaucaaugggauagcgcuaaggccgccguugaggacgaagauuucuggaaacuuguggaccgcgagagagagcugcacaagcucggaaaauguggcuccugcgucuacaacaugauggggaagcgggagaagaagcugggcgaguuuggaaaggcuaaaggcucucgcgccaucugguacauguggcuuggggcuagauaucuggaguucgaggcccucggauuucugaaugaggaucauugguucagccgggaaaacuccuacucuggcguggagggggaaggacugcacaagcucggcuauauucugagagacaucagcaaaauucccgggggcgcgauguacgccgaugacaccgcuggaugggacacgcggaucaccgaggaugaccuucauaaugaagagaagaucacacagcagauggauccugagcaccgccagcuggccaacgcuauuuuuaaacucaccuaucaaaauaaggucgugaagguucagagacccacaccgaccggcacagugauggacaucauuucccggaaagaucagcgcgggagcggacaggucggcaccuacgggcugaacacguucacaaauauggaagcccaacuuaucagacagauggagggagaaggcgugcugaccaaggcggaccucgagaacccucaccugucugagaaaaagauuacccaguggcuggagacaaaagggguggagcggcucaagcgcauggccaucuccggcgaugacugcguugugaagcccaucgaugacagauuugcuaacgcccugcuugcucugaaugauaugggaaaaguccggaaggacauuccccaguggcaaccuagcaaaggcuggcaugauuggcaacaggugccguucuguucucaccauuuccacgaacucaucaugaaggacgggcgcaaacugguugugcccugcagaccucaggacgagcuuauuggacgggcccgcaucucccaaggcgcuggguggagccugagagaaaccgccugucucggaaaggcguaugcccagauguggucucugauguacuuucaccggcgcgaucugagacucgcuuccaacgccauuugcagcgccguccccgugcauugggucccuacaucccggacgaccuggagcauccacgcucaucaccaguggaugacaaccgaggacaugcugacaguguggaauagaguuuggauugaagauaaccccuggauggaggacaagaccccugugacgaccugggagaauguccccuaccuuggcaaacgcgaagaucaauggugugggucucugaucggccucacaagccgggccaccugggcgcagaacaucccgacagcuauucaacaggugagaucccugaucggaaaugaggaguuccuugacuauaugccuucuaugaagcgcuuucggaaagaggaggaaagcgagggcgccauuugguga

SEQ ID NO: 20677 - RNA, 9873 nt, Artificial Sequence
  derived and/or modified CDS sequence (opt5) from DENV-3__EU687218__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaaaaauacaaguuucaggccgauucccccaaacggcuggcgacagccaucgcuggcgccugggagaauggaguguguggcauuagaagcaccacacgcauggaaaaccuucucuggaagcaaaucgcuaaugagcugaacuauauccugugggaaaauaacauuaaacucaccgucgugguuggggacaucauuggagugcuggagcagggcaagcggacgcuuaccccucagcccauggagcugaaauacucuuggaagacaugggggaaggccaaaaucgucaccgccgaaacacagaacuccagcuucauuaucgauggaccuaauacccccgagugcccgucugcuuccagagcguggaacgugugggaaguggaggacuauggcuuuggcgucuucacaaccaauaucuggcucaagcugcgcgaaguuuacacgcaacugugugaccaccggcuuaugagcgccgcugugaaagaugagagagccgugcacgccgacaugggguacuggauugagucccagaagaacggaucuuggaaacucgaaaaggcuagccugaucgaggucaagacaugcaccuggccuaaaucccauacccuguggucuaauggcgugcucgaaagcgauaugauuauccccaagucccuggccgggccuauuagccagcacaacuaucgccccggauaccauacacagaccgcgggcccuuggcaccuugggaaacuggagcucgacuuuaauuauugcgagggaacgacaguugugaucaccgaaaacuguggcacacggggccccucucugagaaccacaaccgucuccgggaagcugauccacgaguggugcugucgcagcugcacgcuuccgccucuccgguacaugggagaagauggcuguugguaugggauggagauuagacccaucucugaaaaagaggagaauauggugaagucccugguuagcgcuggaucuggcaagguggacaacuucaccauggggguccugugccucgccauucuguuugaagaggugaugcggggaaaauucggcaagaaacauaugaucgccggcguuuucuuuacauucgugcuucugcucagcgggcaaauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagaaaaccugcuucugggcguggggcucgccauggcuaccacacugcagcugccugaggauauugaacaaauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccagucuagcuccaugcggaagacggacuggcugcccaugacaguggcugccaugggggugccuccccucccucuguuuaucuucucucucaaagauacccugaagagacgcagcuggccccuuaaugagggagucauggccgugggccugguuuccauucuggcuucuagccuccugagaaacgacgugccuauggcggggccccuugucgccggaggccugcucaucgcuuguuacgugauuaccgggacauccgccgaucugaccguugaaaaagccgcugacgugacaugggaggaagaggccgaacaaacgggagucagccauaaccucaugaucaccguggacgaugacggcacaaugcggauuaaggaugacgagaccgagaauauccugacaguccuucugaaaaccgcgcugcucaucgugucuggcauuuuuccguacuccaucccugcuacgcugcuuguuuggcacaccuggcagaagcagacacagcgcagcggggugcugugggauguccccucuccucccgaaacccaaaaagccgagcucgaagagggaguguauagaauuaagcagcagggcaucuucgggaagacacagguuggagugggcguccaaaaagaggggguguuucauaccauguggcacgugacacggggagccguucugacguacaacggcaagcgccucgaaccgaauugggcuuccgucaaaaaggaccugauuagcuauggcgggggauggagacuuucugcccaguggcagaaaggcgaggaagugcaagugaucgcggucgagccugggaagaaccccaagaauuuccagaccaugccuggaacauuccagaccaccacaggcgaaauuggggcuaucgcccuggauuuuaaacccggaacguccggcagccccaucauuaaccgggagggcaaggugguugggcuguacggaaauggcguggucaccaaaaacgggggauauguguccggcaucgcccagacaaaugcugagccugacgggccgacccccgaacucgaggaagagauguucaagaaacgcaaccugacaauuauggaucuucacccuggcagcggaaagaccagaaaguaccugcccgccaucguucgggaagcuauuaaacgcagacuccggacgcugauccucgccccuacaagaguggucgcggccgagauggaggaagcucugaagggccuucccauccgcuaucaaaccaccgccacaaaaucugagcauaccgggcgggaaauuguggaccugaugugccacgcuacauuuaccaugagacugcucagcccuguucgcgugccgaauuacaaccugaucauuauggaugaggcccauuucacggaccccgccuccaucgcugcgcggggauacauuucuacaagagucggcaugggggaagccgcugccaucuuuaugaccgccacaccucccggaaccgcugaugccuucccucagagcaaugcgcccauccaggacgaggagcgcgacauuccggaacgguccuggaacucuggcaaugaguggaucacggauuuugcugggaagaccgugugguucgugccuagcauuaaagccggcaacgacaucgccaacugucuuagaaagaauggaaagaaagucauucagcugucccgcaagacauuugauaccgaauaucaaaaaacaaagcucaacgacugggauuucguugugaccacagacaucucugagaugggcgcuaauuuuaaagccgaucgggugauugaccccagacggugccugaagcccgucauccugaccgaugggccugagcgcgugauccucgcgggacccaugccuguuacggccgcuagcgccgcucagagacggggccgcguggggagaaacccgcagaaggaaaaugaccaguacauuuucacaggacaaccccuuaacaaugaugaggaccacgcccauuggaccgaagcuaaaaugcugcuggacaacaucaauaccccugagggcauuauccccgcccucuucgaaccugagcgggagaaguccgcggccauugauggggaauauagacugaaaggcgagagccgcaagacauuugucgaacuuaugcggagaggagaccugcccguguggcucgcucacaaaguugccucugagggcaucaaguacaccgaucgcaaauggugcuucgacgggcagcggaacaaucagauccuggaagagaacauggauguggagauuuggacaaaggaaggagagaagaaaaagcugagaccgcgcuggcucgacgcucggacguauuccgauccucuugcccugaaagaauuuaaggacuucgccgcuggcagaaaaagcaucgcgcuggaucucgucaccgagauugggcgcgugcccucucaccuggcccauagaacacggaaugcucuugacaaccuggucaugcuccacaccuccgaacauggaggcaaggccuaccgccacgccguggaggagcugccugaaacaauggagacccugcuccuucugggccugaugauccuccugacggggggagcuaugcuuuuucugauuagcggcaaggggaucggaaaaaccuccaucggccucauuuguguuaucgccucuagcgggaugcuguggauggcggaaauuccccugcaguggaucgccuccgcuauugugcucgaguucuuuaugauggugcuucugaucccugagcccgaaaagcaaagaacaccgcaggauaaucagcuggccuaugucguuauuggaauccucacccuggcugccaucauugcggccaacgagaugggccuucuggaaacaaccaaacgggaccucggcaugagcaaggagccugggguggugucucccacguccuaccuggaugucgaccugcaccccgcuagcgccuggacacucuacgcuguggccaccacaguuaucaccccuaugcuucgccauaccauugaaaauucuacagcuaacgugagccuggccgcgaucgccaaccaagcugucgugcugaugggacucgacaaaggcuggccgauuuccaagauggaucugggggucccccuucuggcccucggaugcuauucucaggugaauccucugacgcugaccgcugccguucuccuucugaucacacacuacgccaucauuggccccgggcugcaggcgaaggcuaccagagaggcccagaaacggacagcugccggaaucaugaagaacccuaccguggacggcauuaugacgaucgaucucgaccccgucauuuaugauagcaaauucgagaagcaacugggccaggugaugcuucugguucucugugccgugcagcugcugcucaugagaacauccugggcucuuugcgaagcccugacccuggcgaccgggccuaucacaacccucugggagggaucuccgggcaaauuuuggaauacaacgaucgccgucagcauggcuaacauuuuccgcggguccuaccuggccggagcuggccuugccuuuagcaucaugaagucuguggggaccggaaagcggggcacaggcucccagggggaaacccugggagagaaauggaagaaaaagcucaaucaacugagcagaaaagaauucgaccuguauaagaaauccggcauuacagagguggaucgcaccgaggcgaaggaagggcucaagcggggagagaucacgcaucacgccguuucuagaggcagcgcuaaacuucagugguuugucgaacggaacauggugauucccgaggggcgcgugaucgaccugggauguggcagaggcgggugguccuacuauugcgccggacugaagaaagucaccgaaguucggggcuacacaaaggggggaccuggccaugaggagcccgugccuaugucuaccuacggguggaauauugugaaacucaugagcggaaaggaugucuucuaucugcccccggaaaagugugacacacuucugugcgauaucggcgaguccagcccuucucccaccguggaagagucccgcacaaucagaguucucaaaaugguggagcccuggcugaagaacaaucaguucuguauuaaaguccugaacccuuacaugcccaccgugaucgaacaccucgagcggcuucagcgcaagcacggcgggaugcugguuagaaauccucugagccggaacucuacgcaugaaauguauuggauuuccaauggaacaggcaacaucguggcuagcgucaauauggugucucgccuccugcuuaacagauuuaccaugacccaccggagaccgacaauugagaaagacguggaucugggggccggaacgcgccaugucaacgcugaacccgagaccccuaauauggacguuaucggcgagcggaucaagagaauuaaggaagagcacaacagcacauggcacuacgacgaugaaaaucccuauaaaaccugggccuaccauggguccuaugaggugaaggcgacaggaucugccagcuccaugaucaacggcguggucaaacuccugaccaagccuugggacgugguucccauggugacacaaauggcuaugaccgauacgaccccguucggccagcagcgcgucuuuaaagaaaagguggacacacggaccccuagaagcaugcccgggacacgccggguuaugggaauuaccgccgaguggcuguggagaacgcucggccgcaauaagaaaccucggcugugcacaagagaggaauucaccaagaaagugcgcacaaacgcugccaugggggccgucuuuaccgaggaaaaucaaugggauuccgcgaaggcugccguggaggacgaagauuucuggaaacuuguugaccgggagagagagcugcacaagcucggaaaauguggcucuugcguguacaacaugauggggaagcgcgaaaagaaacugggcgaguuuggaaaggccaaaggcagcagagcuaucugguacauguggcuuggggcccgguaucuggaauucgaggcucucggauuucugaaugaggaucauugguucucccgcgaaaacucuuacagcggcgucgagggggaaggacugcacaagcucggcuauauucugagagacaucuccaaaauccccgggggcgccauguacgcggaugacacggccggaugggacacccggauuacagaggaugaccuucauaaugaagagaagaucacccagcagauggauccugagcacagacagcuggcuaacgccauuuuuaagcucacauaucaaaauaaaguggucaaggugcagcggcccaccccgacaggcaccguuauggacaucauuucucgcaaagaucagagagggagcggacaggugggcacguacgggcugaacacauucaccaauauggaagcucaacuuauccggcagauggagggagaaggcguccuguccaaggccgaccucgagaacccucaccugcccgaaaaaaagaucacccaguggcuggagacaaaggggguggagcgccucaaaagaauggcgauuagcggcgaugacugcgugguuaagcccaucgaugaccgguuugccaacgcucugcuugcccugaaugauaugggaaaagugcgcaaggacauuccucaguggcaaccgucuaaaggcuggcaugauuggcagcagguccccuucuguucccaccauuuccacgaacucaucaugaaggacgggagaaagcuggugguuccuugccggccccaggacgagcuuauuggacgcgcuagaaucagccaaggcgccggguggucucugcgggaaaccgcuugucucggaaaagccuaugcgcagauguggucccugauguacuuucaccgcagagaucugcggcucgccagcaacgcuauuugcucugccgugccuguccauugggugcccacaucccgcacgaccuggagcauccacgcccaucaccaguggaugacaaccgaggacaugcugacagucuggaauagaguguggaucgaagauaacccuuggauggaggacaagacccccguuacgaccugggagaaugugccguaccuuggcaaacgggaagaucaauggugugggucccugauuggccucacaagcagagcuaccugggcccagaacaucccuacagcgauucagcagguccgcucucugaucggaaaugaggaauuccuugacuauaugcccagcaugaagcgguuuagaaaagaggaggaauccgagggcgcuauuugguga

SEQ ID NO: 20678 - RNA, 9873 nt, Artificial Sequence
  derived and/or modified CDS sequence (opt5) from DENV-3__EU726772__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccaugacaguggcugccaugggggugccuccccucccucuguuuaucuucucucucaaggauacccugaaaagacgcagcuggccccuuaaugagggagucauggccgugggccugguuuccauucuggcuucuagccuccugagaaacgacgugccuauggcggggccccuugucgccggaggccugcucaucgcuuguuacgugauuaccgggacauccgccgaucugaccguugaaaaggccgcugacgugacaugggaggaagaggccgaacagacgggagucagccauaaccucaugaucaccguggacgaugacggcacaaugcggauuaaagaugacgagaccgagaauauccugacaguccuucugaagaccgcgcugcucaucgugucuggcauuuuuccguacuccaucccugcuacgcugcuuguuuggcacaccuggcagaaacagacacaacgcagcggggugcugugggauguccccucuccucccgaaacccagaaggccgagcucgaagagggaguguauagaauuaaacagcagggcaucuucgggaagacacaaguuggagugggcguccagaaggaggggguguuucauaccauguggcacgugacacggggagccguucugacguacaacggcaaacgccucgaaccgaauugggcuuccgucaagaaagaccugauuagcuauggcgggggauggagacuuucugcccaguggcaaaagggcgaggaaguccaggugaucgcggucgagccugggaaaaaccccaagaauuuccagaccaugccuggaacauuccagaccaccacaggcgaaauuggggcuaucgcccuggauuuuaagcccggaacguccggcagccccaucauuaaccgggagggcaaagugguugggcuguacggaaauggcguggucaccaagaacgggggauauguguccggcaucgcccaaacaaaugcugagccugacgggccgacccccgaacucgaggaagagauguucaaaaagcgcaaccugacaauuauggaucuucacccuggcagcggaaaaaccagaaaguaccugcccgccaucguucgggaagcuauuaagcgcagacuccggacgcugauccucgccccuacaagaguggucgcggccgagauggaggaagcucugaaaggccuucccauccgcuaucagaccaccgccacaaagucugagcauaccgggcgggaaauuguggaccugaugugccacgcuacauuuaccaugagacugcucagcccuguucgcgugccgaauuacaaccugaucauuauggaugaggcccauuucacggaccccgccuccaucgcugcgcggggauacauuucuacaagagucggcaugggggaagccgcugccaucuuuaugaccgccacaccucccggaaccgcugaugccuucccucagagcaaugcgcccauccaggacgaggagcgcgacauuccggaacgguccuggaacucuggcaaugaguggaucacggauuuugcugggaaaaccgugugguucgugccuagcauuaaggccggcaacgacaucgccaacugucuucgcaaaaauggaaagaaggucauucaacuguccagaaaaacauuugauaccgaauaucagaagacaaaacucaacgacugggauuucguugugaccacagacaucucugagaugggcgcuaauuuuaaggccgaucgggugauugaccccagacggugccugaaacccgucauccugaccgaugggccugagcgcgugauccucgcgggacccaugccuguuacggccgcuagcgccgcucagagacggggccgcguggggagaaacccgcagaaggaaaaugaccaauacauuuucacaggacagccccuuaacaaugaugaggaccacgcccauuggaccgaagcuaagaugcugcuggacaacaucaauaccccugagggcauuauccccgcccucuucgaaccugagcgggagaaauccgcggccauugauggggaauauagacugaagggcgagagccgcaaaacauuugucgaacuuaugcggagaggagaccugcccguguggcucgcucacaagguugccucugagggcaucaaauacaccgaucgcaaguggugcuucgacgggcagcggaacaaucagauccuggaagagaacauggauguggagauuuggacaaaagaaggagagaagaagaaacugagaccgcgcuggcucgacgcucggacguauuccgauccucuugcccugaaggaauuuaaagacuucgccgcuggcagaaagagcaucgcgcuggaucucgucaccgagauugggcgcgugcccucucaccuggcccauagaacacggaaugcucuugacaaccuggucaugcuccacaccuccgaacauggaggcaaagccuaccgccacgccguggaggagcugccugaaacaauggagacccugcuccuucugggccugaugauccuccugacagggggagcuaugcuuuuucugauuagcggcaaggggaucggaaagaccuccaucggccucauuuguguuaucgccucuagcgggaugcuguggauggcggaaauuccccugcaauggaucgccuccgcuauugugcucgaguucuuuaugauggugcuucugaucccugagcccgaaaaacagagaacaccgcaggauaaucaacuggccuaugucguuauuggaauccucacccuggcugccaucauugcggccaacgagaugggccuucuggaaacaaccaagcgggaccucggcaugagcaaagagccugggguggugucucccacguccuaccuggaugucgaccugcaccccgcuagcgccuggacacucuacgcuguggccaccacaguuaucaccccuaugcuucgccauaccauugaaaauucuacagcuaacgugagccuggccgcgaucgccaaccaggcugucgugcugaugggacucgacaagggcuggccgauuuccaaaauggaucugggggucccccuucuggcccucggaugcuauucucaggugaauccucugacgcugaccgcugccguucuccuucugaucacacacuacgccaucauuggccccgggcugcaggcgaaggcuaccagagaggcccaaaagcggacagcugccggaaucaugaaaaacccuaccguggacggcauuaugacgaucgaucucgaccccgucauuuaugauagcaaguucgagaaacagcugggccaggugaugcuucugguucucugugccgugcagcugcugcucaugagaacauccugggcucuuugcgaagcccugacccuggcgaccgggccuaucacaacccucugggagggaucuccgggcaaguuuuggaauacaacgaucgccgucagcauggcuaacauuuuccgcggguccuaccuggccggagcuggccuugccuuuagcaucaugaaaucuguggggaccggaaagcggggcacaggcucccaaggggaaacccugggagagaaguggaaaaagaaacucaaucagcugagcagaaaggaguucgaccuguauaaaaaguccggcauuacagagguggaucgcaccgaggcgaaagaagggcucaagcggggagagaucacgcaucacgccguuucuagaggcagcgcuaaacuucagugguuugucgaacggaacauggugauucccgaggggcgcgugaucgaccugggauguggcagaggcgggugguccuacuauugcgccggacugaaaaaggucaccgaaguucggggcuacacaaaagggggaccuggccaugaggagcccgugccuaugucuaccuacggguggaauauugugaagcucaugagcggaaaagaugucuucuaucugcccccggaaaagugugacacacuucugugcgauaucggcgaguccagcccuucucccaccguggaagagucccgcacaaucagaguucucaagaugguggagcccuggcugaaaaacaaucaguucuguauuaagguccugaacccuuacaugcccaccgugaucgaacaccucgagcggcuucaacgcaaacacggcgggaugcugguuagaaauccucugagccggaacucuacgcaugaaauguauuggauuuccaauggaacaggcaacaucguggcuagcgucaauauggugucucgccuccugcuuaacagauuuaccaugacccaccggagaccgacaauugagaaggacguggaucugggggccggaacgcgccaugucaacgcugaacccgagaccccuaauauggacguuaucggcgagcggaucaaaagaauuaaggaagaacacaacagcacauggcacuacgacgaugaaaaucccuauaagaccugggccuaccauggguccuaugaggugaaagcgacaggaucugccagcuccaugaucaacggcguggucaagcuccugaccaaaccuugggacgugguucccauggugacacagauggcuaugaccgauacgaccccguucggccagcaacgcgucuuuaaggaaaaaguggacacacggaccccuagaagcaugcccgggacacgccggguuaugggaauuaccgccgaguggcuguggagaacgcucggccgcaauaagaagccucggcugugcacaagagaggaguucaccaaaaaggugcgcacaaacgcugccaugggggccgucuuuaccgaggaaaaucagugggauuccgcgaaagcugccguggaggacgaagauuucuggaaacuuguugaccgggagagagagcugcacaaacucggaaaguguggcucuugcguguacaacaugauggggaaacgcgaaaagaagcugggcgaguuuggaaaagccaagggcagcagagcuaucugguacauguggcuuggggcccgguaucuggaguucgaggcucucggauuucugaaugaggaucauugguucucccgcgaaaacucuuacagcggcgucgagggggaaggacugcacaaacucggcuauauucugagagacaucuccaagauccccgggggcgccauguacgcggaugacacggccggaugggacacccggauuacagaggaugaccuucauaaugaagagaaaaucacccagcagauggauccugagcacagacaacuggcuaacgccauuuuuaagcucacauaucagaauaagguggucaaagugcagcggcccaccccgacaggcaccguuauggacaucauuucucgcaaggaucagagagggagcggacaagugggcacguacgggcugaacacauucaccaauauggaagcucagcuuauccggcagauggagggagaaggcguccuguccaaagccgaccucgagaacccucaucugcccgaaaagaaaaucacccaguggcuggagacaaaggggguggagcgccucaagagaauggcgauuagcggcgaugacugcgugguuaaacccaucgaugaccgguuugccaacgcucugcuugcccugaaugauaugggaaagggccgcaaagacauuccucaauggcagccgucuaagggguggcaugauuggcaacaggugcccuucuguucccaccauuuccacgaacucaucaugaaagacggaagaaagcuggucgugccuugccggccccaagacgagcuuauuggccgcgcuagaaucagccagggggccggauggucucugcgggaaaccgcuugucucggcaaggccuaugcgcagauguggucccugauguacuuucaccgcagagaucugcggcucgccagcaacgcuauuugcucugccguuccugugcauuggguccccacaucccgcacgaccuggagcauccacgcccaucaccaauggaugacaaccgaggacaugcugacaguguggaauagagucuggaucgaagauaacccuuggauggaggacaaaacccccgugacgaccugggagaauguuccguaccuugggaagcgggaagaucagugguguggcucccugauuggacucacaagcagagcuaccugggcccagaacaucccuacagcgauucagcaagugcgcucucugaucggcaaugaggaguuccuugacuauaugcccagcaugaaacgguuuagaaaggaggaggaauccgagggggcuauuugguga

SEQ ID NO: 20679 - RNA, 9873 nt, Artificial Sequence
  derived and/or modified CDS sequence (opt5) from DENV-3__FJ182013__SS-prME
acaagccugugccucaugaugauccugcccgccgcucuugccuuccaccugacaucccgggacggagaaccucggaugauuguggggaagaacgaacgcggaaagucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacguggggacgucccucacacagaaggucgugaucuucauucugcuuaugcugguuaccccuucuaugacaaugagaugugugggagucggcaaccgggacuuuguggaagggcucagcggagcuaccuggguggaugucguucuggagcacggcgggugcgugaccacaauggccaagaauaaacccacgcuggacaucgagcuccagaagaccgaagcuacacagcuggccacccuucgcaaacuguguauugagggaaagaucacaaacauuaccacggauuccagaugcccuacacagggcgaagcggugcucccggaggaacaggaccagaauuaugucuguaaacacaccuacguggaucggggcugggggaacggaugcggccuguucgggaagggaagccuuguuaccugcgccaaguuucaaugucuggagcccaucgagggcaaagugguccaguaugaaaaucucaaguacacagugauuaucaccguucauacaggggaccagcaccaggugggaaacgagacgcaaggcgucaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaagugguugugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguccugaagaaagagguguccgaaacccagcacgggacaauucucaucaagguugaguacaagggagaagaugugcccuguaaaaucccuuucagcaccgaggacggccaagggaaggcccauaacggaagacugauuacagcgaaucccgucgugaccaaaaaggaggaacccgugaacaucgaggcugaaccuccguucggcgaguccaauauuguuaucgggauuggcgauaacgcccugaaaaucaauugguauaagaagggaucuagcaucggcaaaauguuugaagccacggcuagaggggcgagacgcauggcuauucuuggagacacagccugggauuucggcuccgucgggggagugcucaacagccugggcaagauggugcaccagaucuuugggucugcguacaccgcccuguucuccggcgucagcugggugaugaaaauuggaaucggcguucuccugaccuggauugggcuuaauucuaagaacacaagcauguccuuuucuugcaucgcuauuggaaucaucacccuguaucucggcgccgugguccaggcugacauggggugugugauuaauuggaaaggaaaggagcugaagugcggcagcgggaucuucguuacaaacgaggugcauacguggaccgaacaguacaaauuucaagccgauucccccaagcggcuggcgacagccauugcuggcgccugggagaauggagucuguggcaucagaagcaccacacgcauggaaaaccuucucuggaaacagauugcuaaugagcugaacuauauccugugggaaaauaacaucaagcucaccgugguugugggggacauuaucggaguccuggagcagggcaaacggacgcuuaccccucagcccauggagcugaaguacucuuggaaaacaugggggaaggccaagauugugaccgccgaaacacaaaacuccagcuucaucauugauggaccuaauacccccgagugcccgucugcuuccagagcguggaacgugugggaagucgaggacuauggcuuuggcguuuucacaaccaauaucuggcucaaacugcgcgaaguguacacgcagcugugugaccaccggcuuaugagcgccgcugugaaggaugagagagccguccacgccgacaugggguacuggaucgagucccagaaaaacggaucuuggaagcucgaaaaagcuagccugauugaggugaagacaugcaccuggccuaagucccauacccuguggucuaauggcguucucgaaagcgauaugaucauucccaaaucccuggccgggccuaucagccagcacaacuaucgccccggauaccauacacaaaccgcgggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagaucagacccauuucugaaaaggaggagaauaugguuaaaucccuggugagcgcuggaucuggcaaggucgacaacuucaccaugggggugcugugccucgccauccuguuugaagagguuaugcggggaaaguucggcaaaaagcauaugauugccggcguguucuuuacauucguccuucugcucagcgggcagaucaccuggcgcgauauggcucacacacugauuaugaucggauccaaugccagcgacagaaugggcaugggggugaccuaccuggcgcuuauugcuacguuuaaaauccagcccuuccuggcccucggauuuuuccugcggaagcucacaucuagagaaaaccugcuucugggcguggggcucgccauggcuaccacacugcaacugccugaggauaucgaacagauggccaauggaauugcucuuggccugauggcccucaaacugaucacccaguuugagaccuaucagcucuggacagcgcugauuucccuuacguguagcaacaccaucuucacacugaccgucgccuggcgcacagcuacccucauucuggccggcguuucccugcuuccggugugccaaucuagcuccaugcggaagacggacuggcugcccauggcuguggccgccaugggggucccuccccucccucuguuuaucuucucucucaaggauacacugaaaagacgcagcuggccccuuaaugagggagugauggcuguuggccugguguccauccuggcgucuagccuccugagaaacgacgucccuauggccgggccccuuguggcuggaggccugcucauugccuguuacguuaucaccgggaccuccgccgaucugacaguggaaaaggcugccgacgucaccugggaggaagaggcggaacagacaggagugagccauaaccucaugauuacggucgacgaugacggcaccaugcggaucaaagaugacgagacagagaauauucugaccgugcuucugaagacagcucugcucaucguuucuggcaucuuuccguacuccauuccugccacccugcuuguguggcacacguggcagaaacagacccaacgcagcgggguccugugggaugugcccucuccucccgaaacacagaaggccgagcucgaagagggaguuuauagaaucaaacagcagggcauuuucgggaagacccaagugggagucggcgugcagaaggaggggguguuucauacaauguggcacguuacccggggagcuguccugacauacaacggcaaacgccucgaaccgaauugggccuccgugaagaaagaccugaucagcuauggcgggggauggagacuuucugcgcaguggcaaaagggcgaggaagugcaggucauugcuguggagccugggaaaaaccccaagaauuuccagacgaugccuggaaccuuccagacaaccaccggcgaaaucggggccauugcccuggauuuuaagcccggaacauccggcagccccaucaucaaccgggagggcaaaguuguggggcuguacggaaauggcgucgugacgaagaacgggggauauguuuccggcauugcucaaaccaaugccgagccugacgggccgacacccgaacucgaggaagagauguucaaaaagcgcaaccugaccaucauggaucuucacccuggcagcggaaaaacaagaaaguaccugcccgcuauugugcgggaagccaucaagcgcagacuccggacccugauucucgcgccuacgagagucguggccgcugagauggaggaagcccugaaaggccuucccauccgcuaucagacaaccgcuaccaagucugagcauacagggcgggaaaucguugaccugaugugccacgccaccuuuacaaugagacugcucagcccugugcgcgucccgaauuacaaccugauuaucauggaugaggcccauuucaccgaccccgcuuccauugcggcccggggauacaucucuacgagagugggcaugggggaagcugccgccauuuuuaugacagcuaccccucccggaacagccgaugcguucccucagagcaaugcucccauccaggacgaggagcgcgacaucccggaacgguccuggaacucuggcaaugaguggauuaccgauuuugccgggaaaacggugugguucgucccuagcaucaaggccggcaacgacauugcuaacugucuucgcaaaaauggaaagaagguuauccaacuguccagaaaaaccuuugauacagaauaucagaagaccaaacucaacgacugggauuucguggugacaaccgacauuucugagaugggcgccaauuuuaaggcggaucgggucaucgaccccagacggugccugaaacccgugauucugacagaugggccugagcgcguuauccucgccggacccaugccugugaccgcugccagcgcugcccagagacggggccgcgucgggagaaacccgcagaaggaaaaugaccaauacaucuucacgggacagccccuuaacaaugaugaggaccacgcucauuggacagaagccaagaugcugcuggacaacauuaauaccccugagggcaucauucccgcccucuucgaaccugagcgggagaaauccgccgcuaucgauggggaauauagacugaagggcgagagccgcaaaaccuuuguggaacuuaugcggagaggagaccugcccguuuggcucgcccacaagguggcuucugagggcauuaaauacacagaucgcaaguggugcuucgacgggcagcggaacaaucagauccuggaagagaacauggaugucgagaucuggaccaaagaaggagagaagaagaaacugagaccgcgcuggcucgacgcccggacauauuccgauccucuugcccugaaggaauuuaaagacuucgcugcgggcagaaagagcauugcccuggaucucgugacggagaucgggcgcguccccucucaccuggcucauagaacccggaaugcccuugacaaccuggugaugcuccacacauccgaacauggaggcaaagccuaccgccacgcuguugaggagcugccugaaaccauggagacacugcuccuucugggccugaugauucuccugaccgggggagccaugcuuuuucugaucagcggcaaggggauuggaaagacguccaucggccucaucugugugauugcgucuagcgggaugcuguggauggccgaaaucccccugcaauggauugcuuccgccaucgugcucgaguucuuuaugaugguccuucugauuccugagcccgaaaaacagagaaccccgcaggauaaucaacuggcuuauguugugaucggcauucucacacuggccgcgaucaucgccgcuaacgagaugggccuucuggaaaccacaaagcgggaccucggcaugagcaaagagccugggguggucucucccaccuccuaccuggauguggaccugcaccccgccagcgcuuggacgcucuacgccguugcuacaaccgugauuacaccuaugcuucgccauaccaucgaaaauucuaccgccaacgucagccuggcggccauugcuaaccaggccgugguccugaugggacucgacaagggcuggccgaucuccaaaauggaucugggggugccccuucuggcucucggaugcuauucucagguuaauccucugacacugacggccgccgugcuccuucugauuacccacuacgcgaucaucggccccgggcugcaggcuaaggccacaagagaggcucaaaagcggaccgccgccggaauuaugaaaaacccuacagucgacggcaucaugaccauugaucucgaccccgugaucuaugauagcaaguucgagaaacagcugggccagguuaugcuucuggugcucugugcuguccagcugcugcucaugagaacguccugggcccuuugcgaagcgcugacacuggccaccgggccuauuaccacacucugggagggaucuccgggcaaguuuuggaauaccacaaucgcugugagcauggccaacaucuuccgcggguccuaccuggcuggagccggccuugcguuuagcauuaugaaaucuguggggacgggaaagcggggcaccggcucccaaggggaaacacugggagagaaguggaaaaagaaacucaaucagcugagcagaaaggaguucgaccuguauaaaaaguccggcaucaccgagguugaucgcacagaggccaaagaagggcucaagcggggagagauuacccaucacgcugucucuagaggcagcgccaaacuucagugguuuguggaacggaacauggugauccccgaggggcgcgucauugaccugggauguggcagaggcgggugguccuacuauugcgcuggacugaaaaagguuacggaagugcggggcuacaccaaagggggaccuggccaugaggagcccgugccuaugucuacauacggguggaauaucgucaagcucaugagcggaaaagauguguucuaucugcccccggaaaagugugacacccuucugugcgauauuggcgaguccagcccuucucccacaguugaagagucccgcaccaucagagugcucaagauggucgagcccuggcugaaaaacaaucaguucuguaucaaggugcugaacccuuacaugcccacaguuauugaacaccucgagcggcuucaacgcaaacacggcgggaugcuggugagaaauccucugagccggaacucuacccaugaaauguauuggaucuccaauggaacgggcaacauugucgccagcgugaauauggugucucgccuccugcuuaacagauuuacaaugacccaccggagaccgaccaucgagaaggacgucgaucugggggcuggaacacgccauguuaacgccgaacccgagacgccuaauauggacgugauuggcgagcggaucaaaagaaucaaggaagaacacaacagcaccuggcacuacgacgaugaaaaucccuauaagacaugggcguaccauggguccuaugaggugaaagccaccggaucugcuagcuccaugauuaacggcgucgugaagcuccugacaaaaccuugggacguugugcccauggucacccagauggccaugacagauaccacgccguucggccagcaacgcguguuuaaggaaaaaguugacacccggacaccuagaagcaugcccgggacccgccgggugaugggaaucacagcugaguggcuguggagaacccucggccgcaauaagaagccucggcugugcacgagagaggaguucaccaagaagguccgcaccaacgccgccaugggggcgguguuuacagaggaaaaucagugggauuccgcuaaagccgccguugaggacgaagauuucuggaaacuuguggaccgggagagagagcugcacaaacucggaaaguguggcucuugcgucuacaacaugauggggaaacgcgaaaagaagcugggcgaguuuggaaaagcuaagggcagcagagccauuugguacauguggcuuggggcucgguaucuggaguucgaggcccucggauuucugaaugaggaucauugguucucccgcgaaaacucuuacagcggcguggagggggaaggacugcacaaacucggcuauauccugagagacauuuccaagauccccgggggcgcgauguacgccgaugacaccgcuggaugggacacgcggaucaccgaggaugaccuucauaaugaagagaaaauuacacagcagauggauccugagcacagacaacuggccaacgcuaucuuuaagcucaccuaucagaauaaggucgugaaaguucagcggcccacaccgaccggcacagugauggacauuaucucucgcaaggaucagagagggagcggacaagucggcaccuacgggcugaacacguucacaaauauggaagcccagcuuauucggcagauggagggagaaggcgugcuguccaaagcggaccucgagaacccucaucugcccgaaaagaaaaucacccaguggcuggagaccaaggggguggagcgccucaagagaauggccaucagcggcgaugacugcguugugaaacccauugaugaccgguuugcuaacgcccugcuugcucugaaugauaugggaaagguccgcaaagacaucccucaauggcagccgucuaagggcuggcaugauuggcaacaggugcccuucuguucccaccauuuccacgaacucauuaugaaagacgggagaaagcugguugugccuugccggccccaagacgagcuuaucggacgcgccagaauuagccagggcgcuggguggucucugcgggaaacagccugucucggaaaggcguaugcccagauguggucccugauguacuuucaccgcagagaucugcggcucgcuagcaacgccaucugcucugccgucccugugcauuggguccccaccucccgcacaacguggagcauucacgcucaucaccaauggaugaccacagaggacaugcugaccguguggaauagaguuuggaucgaagauaacccuuggauggaggacaaaacacccgugaccacgugggagaaugucccguaccuuggcaagcgggaagaucaguggugugggucccugaucggccucaccagcagagccacaugggcgcagaacauuccuaccgcuauccagcaagugcgcucucugauuggaaaugaggaguuccuugacuauaugcccagcaugaaacgguuuagaaaggaggaggaauccgagggcgccaucugguga

SEQ ID NO: 20680 - RNA, 9873 nt, Artificial Sequence
  derived and/or modified CDS sequence (opt5) from DENV-3__EU781136__SS-prME
accagccugugccucaugaugauccugcccgccgcucuugccuuccaccugacgucccgggacggagaaccucggaugauuguggggaagaacgaacgcggaaagucucuccuguuuaagacggcgagcggcaucaauauguguacccuuauugcuauggaucugggggaaaugugcgacgauacagucaccuacaaguguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucgugaauuggaaaggaaaggagcugaagugcggcagcgggaucuucguuacaaacgaggugcauacguggaccgaacaguacaaauuucaagccgauucccccaagcggcuggcgacagccauugcuggcgccugggagaauggagucuguggcaucagaagcaccacacgcauggaaaaccuucucuggaaacagauugcuaaugagcugaacuauauccugugggaaaauaacaucaagcucaccgugguugugggggacauuaucggaguccuggagcagggcaaacggacgcuuaccccucagcccauggagcugaaguacucuuggaaaacaugggggaaggccaagauugugaccgccgaaacacaaaacuccagcuucaucauugauggaccuaauacccccgagugcccgucugcuuccagagcguggaacgugugggaagucgaggacuauggcuuuggcguuuucacaaccaauaucuggcucaaacugcgcgaaguguacacgcagcugugugaccaccggcuuaugagcgccgcugugaaggaugagagagccguccacgccgacaugggguacuggaucgagucccagaaaaacggaucuuggaagcucgaaaaagcuagccugauugaggugaagacaugcaccuggccuaagucccauacccuguggucuaauggcguucucgaaagcgauaugaucauucccaaaucccuggccgggccuaucagccagcacaacuaucgccccggauaccauacacaaaccgcgggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagaucagacccauuucugaaaaggaggagaauaugguuaaaucccuggugagcgcuggaucuggcaaggucgacaacuucaccaugggggugcugugccucgccauccuguuugaagagguuaugcggggaaaguucggcaaaaagcauaugauugccggcguguucuuuacauucguccuucugcucagcgggcagaucaccuggcgcgauauggcucacacacugauuaugaucggauccaaugccagcgacagaaugggcaugggggugaccuaccuggcgcuuauugcuacguuuaaaauccagcccuuccuggcccucggauuuuuccugcggaagcucacaucuagagaaaaccugcuucugggcguggggcucgccauggcuaccacacugcaacugccugaggauaucgaacagauggccaauggaauugcucuuggccugauggcccucaaacugaucacccaguuugagaccuaucagcucuggacagcgcugauuucccuuacguguagcaacaccaucuucacacugaccgucgccuggcgcacagcuacccucauucuggccggcguuucccugcuuccggugugccaaucuagcuccaugcggaagacggacuggcugcccaugacaguggcugccaugggggucccuccccucccucuguuuaucuucucucucaaggauacccugaaaagacgcagcuggccccuuaaugagggagugauggccguuggccugguguccauccuggcuucuagccuccugagaaacgacgucccuauggcggggccccuuguggccggaggccugcucauugcuuguuacguuaucaccgggacauccgccgaucugaccguggaaaaggccgcugacgucacaugggaggaagaggccgaacagacgggagugagccauaaccucaugauuaccgucgacgaugacggcacaaugcggaucaaagaugacgagaccgagaauauucugacagugcuucugaagaccgcgcugcucaucguuucuggcaucuuuccguacuccauuccugcuacgcugcuuguguggcacaccuggcagaaacagacacaacgcagcgggguccugugggaugugcccucuccucccgaaacccagaaggccgagcucgaagagggaguuuauagaaucaaacagcagggcauuuucgggaagacacaagugggagucggcgugcagaaggaggggguguuucauaccauguggcacguuacacggggagccguccugacguacaacggcaaacgccucgaaccgaauugggcuuccgugaagaaagaccugaucagcuauggcgggggauggagacuuucugcccaguggcaaaagggcgaggaagugcaggucauugcgguggagccugggaaaaaccccaagaauuuccagaccaugccuggaacauuccagaccaccacaggcgaaaucggggcuauugcccuggauuuuaagcccggaacguccggcagccccaucaucaaccgggagggcaaaguuguggggcuguacggaaauggcgucgugaccaagaacgggggauauguuuccggcauugcccaaacaaaugcugagccugacgggccgacccccgaacucgaggaagagauguucaaaaagcgcaaccugacaaucauggaucuucacccuggcagcggaaaaaccagaaaguaccugcccgccauugugcgggaagcuaucaagcgcagacuccggacgcugauucucgccccuacaagagucguggcggccgagauggaggaagcucugaaaggccuucccauccgcuaucagaccaccgccacaaagucugagcauaccgggcgggaaaucguugaccugaugugccacgcuacauuuaccaugagacugcucagcccugugcgcgucccgaauuacaaccugauuaucauggaugaggcccauuucacggaccccgccuccauugcugcgcggggauacaucucuacaagagugggcaugggggaagccgcugccauuuuuaugaccgccacaccucccggaaccgcugaugccuucccucagagcaaugcgcccauccaggacgaggagcgcgacaucccggaacgguccuggaacucuggcaaugaguggauuacggauuuugcugggaaaaccgugugguucgucccuagcaucaaggccggcaacgacauugccaacugucuucgcaaaaauggaaagaagguuauccaacuguccagaaaaacauuugauaccgaauaucagaagacaaaacucaacgacugggauuucguggugaccacagacauuucugagaugggcgcuaauuuuaaggccgaucgggucaucgaccccagacggugccugaaacccgugauucugaccgaugggccugagcgcguuauccucgcgggacccaugccugugacggccgcuagcgccgcucagagacggggccgcgucgggagaaacccgcagaaggaaaaugaccaauacaucuucacaggacagccccuuaacaaugaugaggaccacgcccauuggaccgaagcuaagaugcugcuggacaacauuaauaccccugagggcaucauucccgcccucuucgaaccugagcgggagaaauccgcggccaucgauggggaauauagacugaagggcgagagccgcaaaacauuuguggaacuuaugcggagaggagaccugcccguuuggcucgcucacaagguggccucugagggcauuaaauacaccgaucgcaaguggugcuucgacgggcagcggaacaaucagauccuggaagagaacauggaugucgagaucuggacaaaagaaggagagaagaagaaacugagaccgcgcuggcucgacgcucggacguauuccgauccucuugcccugaaggaauuuaaagacuucgccgcuggcagaaagagcauugcgcuggaucucgugaccgagaucgggcgcguccccucucaccuggcccauagaacacggaaugcucuugacaaccuggugaugcuccacaccuccgaacauggaggcaaagccuaccgccacgccguugaggagcugccugaaacaauggagacccugcuccuucugggccugaugauucuccugacagggggagcuaugcuuuuucugaucagcggcaaggggauuggaaagaccuccaucggccucaucugugugauugccucuagcgggaugcuguggauggcggaaaucccccugcaauggauugccuccgcuaucgugcucgaguucuuuaugaugguccuucugauuccugagcccgaaaaacagagaacaccgcaggauaaucaacuggccuauguugugaucggcauucucacccuggcugccaucaucgcggccaacgagaugggccuucuggaaacaaccaagcgggaccucggcaugagcaaagagccugggguggucucucccacguccuaccuggauguggaccugcaccccgcuagcgccuggacacucuacgcuguugccaccacagugauuaccccuaugcuucgccauaccaucgaaaauucuacagcuaacgucagccuggccgcgauugccaaccaggcugugguccugaugggacucgacaagggcuggccgaucuccaaaauggaucugggggugccccuucuggcccucggaugcuauucucagguuaauccucugacgcugaccgcugccgugcuccuucugauuacacacuacgccaucaucggccccgggcugcaggcgaaggcuaccagagaggcccaaaagcggacagcugccggaauuaugaaaaacccuaccgucgacggcaucaugacgauugaucucgaccccgugaucuaugauagcaaguucgagaaacagcugggccagguuaugcuucuggugcucugugccguccagcugcugcucaugagaacauccugggcucuuugcgaagcccugacccuggcgaccgggccuauuacaacccucugggagggaucuccgggcaaguuuuggaauacaacgaucgccgugagcauggcuaacaucuuccgcggguccuaccuggccggagcuggccuugccuuuagcauuaugaaaucuguggggaccggaaagcggggcacaggcucccaaggggaaacccugggagagaaguggaaaaagaaacucaaucagcugagcagaaaggaguucgaccuguauaaaaaguccggcaucacagagguugaucgcaccgaggcgaaagaagggcucaagcggggagagauuacgcaucacgccgucucuagaggcagcgcuaaacuucagugguuuguggaacggaacauggugauccccgaggggcgcgucauugaccugggauguggcagaggcgggugguccuacuauugcgccggacugaaaaagguuaccgaagugcggggcuacacaaaagggggaccuggccaugaggagcccgugccuaugucuaccuacggguggaauaucgucaagcucaugagcggaaaagauguguucuaucugcccccggaaaagugugacacacuucugugcgauauuggcgaguccagcccuucucccaccguugaagagucccgcacaaucagagugcucaagauggucgagcccuggcugaaaaacaaucaguucuguaucaaggugcugaacccuuacaugcccaccguuauugaacaccucgagcggcuucaacgcaaacacggcgggaugcuggugagaaauccucugagccggaacucuacgcaugaaauguauuggaucuccaauggaacaggcaacauugucgcuagcgugaauauggugucucgccuccugcuuaacagauuuaccaugacccaccggagaccgacaaucgagaaggacgucgaucugggggccggaacgcgccauguuaacgcugaacccgagaccccuaauauggacgugauuggcgagcggaucaaaagaaucaaggaagaacacaacagcacauggcacuacgacgaugaaaaucccuauaagaccugggccuaccauggguccuaugaggugaaagcgacaggaucugccagcuccaugauuaacggcgucgugaagcuccugaccaaaccuugggacguugugcccauggucacacagauggcuaugaccgauacgaccccguucggccagcaacgcguguuuaaggaaaaaguugacacacggaccccuagaagcaugcccgggacacgccgggugaugggaaucaccgccgaguggcuguggagaacgcucggccgcaauaagaagccucggcugugcacaagagaggaguucaccaaaaagguccgcacaaacgcugccaugggggccguguuuaccgaggaaaaucagugggauuccgcgaaagcugccguugaggacgaagauuucuggaaacuuguggaccgggagagagagcugcacaaacucggaaaguguggcucuugcgucuacaacaugauggggaaacgcgaaaagaagcugggcgaguuuggaaaagccaagggcagcagagcuauuugguacauguggcuuggggcccgguaucuggaguucgaggcucucggauuucugaaugaggaucauugguucucccgcgaaaacucuuacagcggcguggagggggaaggacugcacaaacucggcuauauccugagagacauuuccaagauccccgggggcgccauguacgcggaugacacggccggaugggacacccggaucacagaggaugaccuucauaaugaagagaaaauuacccagcagauggauccugagcacagacaacuggcuaacgccaucuuuaagcucacauaucagaauaaggucgugaaaguucagcggcccaccccgacaggcaccgugauggacauuaucucucgcaaggaucagagagggagcggacaagucggcacguacgggcugaacacauucaccaauauggaagcucagcuuauucggcagauggagggagaaggcgugcuguccaaagccgaccucgagaacccucaucugcccgaaaagaaaaucacccaguggcuggagacaaaggggguggagcgccucaagagaauggcgaucagcggcgaugacugcguugugaaacccauugaugaccgguuugccaacgcucugcuugcccugaaugauaugggaaagguccgcaaagacaucccucaauggcagccgucuaagggcuggcaugauuggcaacaggugcccuucuguucccaccauuuccacgaacucauuaugaaagacgggagaaagcugguugugccuugccggccccaagacgagcuuaucggacgcgcuagaauuagccagggcgccggguggucucugcgggaaaccgcuugucucggaaaggccuaugcgcagauguggucccugauguacuuucaccgcagagaucugcggcucgccagcaacgcuaucugcucugccgucccugugcauuggguccccacaucccgcacgaccuggagcauucacgcccaucaccaauggaugacaaccgaggacaugcugacaguguggaauagaguuuggaucgaagauaacccuuggauggaggacaaaacccccgugacgaccugggagaaugucccguaccuuggcaagcgggaagaucaguggugugggucccugaucggccucacaagcagagcuaccugggcccagaacauuccuacagcgauccagcaagugcgcucucugauuggaaaugaggaguuccuugacuauaugcccagcaugaaacgguuuagaaaggaggaggaauccgagggcgcuaucugguga

SEQ ID NO: 20681 - RNA, 9873 nt, Artificial Sequence
  derived and/or modified CDS sequence (opt5) from DENV-3__EU781137__SS-prME
acaagccugugccucaugaugauccugcccgccgcucuugccuuccaccugacaucccgggacggagaaccucggaugauuguggggaagaacgaacgcggaaagucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucacccugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccaacuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucaaugucuggagcccaucgagggcaaaguugugcaguaugaaaaucucaaguacaccgucauuaucacagugcauacgggggaccagcaccagguuggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagauguucccuguaaaaucccuuucagcacagaggacggccaagggaaggcccauaacggaagacugauuaccgcgaaucccguggucacgaaaaaggaggaacccgugaacaucgaggcugaaccuccguucggcgaguccaauauugugaucgggauuggcgauaacgcccugaaaaucaauugguauaagaagggaucuagcaucggcaaaauguuugaagccacagcuagaggggccagacgcauggcuauucuuggagacaccgccugggauuucggcuccguugggggaguccucaacagccugggcaagauggugcaccagaucuuugggucugcguacaccgcccuguucuccggcgugagcugggucaugaaaauuggaaucggcgugcuccugacauggauugggcuuaauucuaagaacaccagcauguccuuuucuugcaucgcuauuggaaucaucacacuguaucucggcgccguugugcaggcugacauggggugugucauuaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcaagguggacaacuucacaauggggguccugugccucgccauccuguuugaagaggugaugcggggaaaguucggcaaaaagcauaugauugccggcguuuucuuuaccuucgugcuucugcucagcgggcagaucacauggcgcgauauggcucacacccugauuaugaucggauccaaugccagcgacagaaugggcaugggggucacguaccuggcgcuuauugcuacauuuaaaauccagcccuuccuggcccucggauuuuuccugcggaagcucaccucuagagaaaaccugcuucugggcguggggcucgccauggcuacaacccugcaacugccugaggauaucgaacagauggccaauggaauugcucuuggccugauggcccucaaacugaucacccaguuugagacauaucagcucuggacggcgcugauuucccuuaccuguagcaacacaaucuucacccugacaguggccuggcgcaccgcuacgcucauucuggccggcgucucccugcuuccgguuugccaaucuagcuccaugcggaagacagacuggcugcccaugaccguggcugccaugggggugccuccccucccucuguuuaucuucucucucaaggauacccugaaaagacgcagcuggccccuuaaugagggagucauggccgugggccugguuuccauccuggcuucuagccuccugagaaacgacgugccuauggcggggccccuugucgccggaggccugcucauugcuuguuacgugaucacagggaccuccgccgaucugacaguugaaaaggccgcugacgugacgugggaggaagaggccgaacagaccggagucagccauaaccucaugauuacaguggacgaugacggcaccaugcggaucaaagaugacgagacagagaauauucugaccguccuucugaagacggcgcugcucaucgugucuggcaucuuuccguacuccauuccugcuacccugcuuguuuggcacacauggcagaaacagacccaacgcagcggggugcugugggauguccccucuccucccgaaacacagaaggccgagcucgaagagggaguguauagaaucaaacagcagggcauuuucgggaagacccaaguuggagugggcguccagaaggaggggguguuucauacaauguggcacgugacgcggggagccguucugaccuacaacggcaaacgccucgaaccgaauugggcuuccgucaagaaagaccugaucagcuauggcgggggauggagacuuucugcccaguggcaaaagggcgaggaaguccaggugauugcggucgagccugggaaaaaccccaagaauuuccagacaaugccuggaaccuuccagaccacaacgggcgaaaucggggcuauugcccuggauuuuaagcccggaaccuccggcagccccaucaucaaccgggagggcaaagugguugggcuguacggaaauggcguggucacaaagaacgggggauauguguccggcauugcccaaaccaaugcugagccugacgggccgacacccgaacucgaggaagagauguucaaaaagcgcaaccugaccaucauggaucuucacccuggcagcggaaaaacgagaaaguaccugcccgccauuguucgggaagcuaucaagcgcagacuccggacacugauucucgccccuaccagaguggucgcggccgagauggaggaagcucugaaaggccuucccauccgcuaucagaccacagccaccaagucugagcauacagggcgggaaaucguggaccugaugugccacgcuaccuuuacgaugagacugcucagcccuguucgcgugccgaauuacaaccugauuaucauggaugaggcccauuucacagaccccgccuccauugcugcgcggggauacaucucuaccagagucggcaugggggaagccgcugccauuuuuaugacagccaccccucccggaacggcugaugccuucccucagagcaaugcgcccauccaggacgaggagcgcgacaucccggaacgguccuggaacucuggcaaugaguggauuaccgauuuugcugggaaaacagugugguucgugccuagcaucaaggccggcaacgacauugccaacugucuucgcaaaaauggaaagaaggucauccaacuguccagaaaaaccuuugauacagaauaucagaagaccaaacucaacgacugggauuucguugugacaaccgacauuucugagaugggcgcuaauuuuaaggccgaucgggugaucgaccccagacggugccugaaacccgucauucugacggaugggccugagcgcgugauccucgcgggacccaugccuguuacagccgcuagcgccgcucagagacggggccgcguggggagaaacccgcagaaggaaaaugaccaauacaucuucaccggacagccccuuaacaaugaugaggaccacgcccauuggaccgaagcuaagaugcugcuggacaacauuaauacaccugagggcaucauucccgcccucuucgaaccugagcgggagaaauccgcggccaucgauggggaauauagacugaagggcgagagccgcaaaaccuuugucgaacuuaugcggagaggagaccugcccguguggcucgcucacaagguugccucugagggcauuaaauacacagaucgcaaguggugcuucgacgggcagcggaacaaucagauccuggaagagaacauggauguggagaucuggacgaaagaaggagagaagaagaaacugagaccgcgcuggcucgacgcucggaccuauuccgauccucuugcccugaaggaauuuaaagacuucgccgcuggcagaaagagcauugcgcuggaucucgucacagagaucgggcgcgugcccucucaccuggcccauagaacccggaaugcucuugacaaccuggucaugcuccacacauccgaacauggaggcaaagccuaccgccacgccguggaggagcugccugaaaccauggagacgcugcuccuucugggccugaugauucuccugaccgggggagcuaugcuuuuucugaucagcggcaaggggauuggaaagacauccaucggccucaucuguguuauugccucuagcgggaugcuguggauggcggaaaucccccugcaauggauugccuccgcuaucgugcucgaguucuuuaugauggugcuucugauuccugagcccgaaaaacagagaaccccgcaggauaaucaacuggccuaugucguuaucggcauucucacacuggcugccaucaucgcggccaacgagaugggccuucuggaaaccacgaagcgggaccucggcaugagcaaagagccugggguggugucucccacauccuaccuggaugucgaccugcaccccgcuagcgccuggacccucuacgcuguggccacaaccguuauuaccccuaugcuucgccauacaaucgaaaauucuacggcuaacgugagccuggccgcgauugccaaccaggcugucgugcugaugggacucgacaagggcuggccgaucuccaaaauggaucugggggucccccuucuggcccucggaugcuauucucaggugaauccucugacccugacagcugccguucuccuucugauuacccacuacgccaucaucggccccgggcugcaggcgaaggcuacaagagaggcccaaaagcggaccgcugccggaauuaugaaaaacccuacgguggacggcaucaugacaauugaucucgaccccgucaucuaugauagcaaguucgagaaacagcugggccaggugaugcuucugguucucugugccgugcagcugcugcucaugagaaccuccugggcucuuugcgaagcccugacccuggcgacagggccuauuaccacacucugggagggaucuccgggcaaguuuuggaauacgaccaucgccgucagcauggcuaacaucuuccgcggguccuaccuggccggagcuggccuugccuuuagcauuaugaaaucuguggggacaggaaagcggggcaccggcucccaaggggaaacacugggagagaaguggaaaaagaaacucaaucagcugagcagaaaggaguucgaccuguauaaaaaguccggcaucaccgagguggaucgcacggaggcgaaagaagggcucaagcggggagagauuacccaucacgccguuucuagaggcagcgcuaaacuucagugguuugucgaacggaacauggugauccccgaggggcgcgugauugaccugggauguggcagaggcgggugguccuacuauugcgccggacugaaaaaggucacagaaguucggggcuacaccaaagggggaccuggccaugaggagcccgugccuaugucuacauacggguggaauaucgugaagcucaugagcggaaaagaugucuucuaucugcccccggaaaagugugacacccuucugugcgauauuggcgaguccagcccuucucccacaguggaagagucccgcaccaucagaguucucaagaugguggagcccuggcugaaaaacaaucaguucuguaucaagguccugaacccuuacaugcccacggugauugaacaccucgagcggcuucaacgcaaacacggcgggaugcugguuagaaauccucugagccggaacucuacacaugaaauguauuggaucuccaauggaaccggcaacauuguggcuagcgucaauauggugucucgccuccugcuuaacagauuuaccaugacacaccggagaccgacgaucgagaaggacguggaucugggggccggaacccgccaugucaacgcugaacccgagacaccuaauauggacguuauuggcgagcggaucaaaagaaucaaggaagaacacaacagcaccuggcacuacgacgaugaaaaucccuauaagacaugggccuaccauggguccuaugaggugaaagcgaccggaucugccagcuccaugauuaacggcguggucaagcuccugacaaaaccuugggacgugguucccauggugacccagauggcuaugacggauaccacaccguucggccagcaacgcgucuuuaaggaaaaaguggacacccggacaccuagaagcaugcccgggacccgccggguuaugggaaucacggccgaguggcuguggagaacacucggccgcaauaagaagccucggcugugcaccagagaggaguucaccaagaaggugcgcaccaacgcugccaugggggccgucuuuacggaggaaaaucagugggauuccgcgaaagcugccguggaggacgaagauuucuggaaacuuguugaccgggagagagagcugcacaaacucggaaaguguggcucuugcguguacaacaugauggggaaacgcgaaaagaagcugggcgaguuuggaaaagccaagggcagcagagcuauuugguacauguggcuuggggcccgguaucuggaguucgaggcucucggauuucugaaugaggaucauugguucucccgcgaaaacucuuacagcggcgucgagggggaaggacugcacaaacucggcuauauccugagagacauuuccaagauccccgggggcgccauguacgcggaugacaccgccggaugggacacacggaucaccgaggaugaccuucauaaugaagagaaaauuacacagcagauggauccugagcacagacaacuggcuaacgccaucuuuaagcucaccuaucagaauaagguggucaaagugcagcggcccacaccgaccggcacgguuauggacauuaucucucgcaaggaucagagagggagcggacaagugggcacauacgggcugaacaccuucaccaauauggaagcucagcuuauucggcagauggagggagaaggcguccuguccaaagccgaccucgagaacccucaucugcccgaaaagaaaaucacacaguggcuggagaccaaggggguggagcgccucaagagaauggcgaucagcggcgaugacugcgugguuaaacccauugaugaccgguuugccaacgcucugcuugcccugaaugauaugggaaaggugcgcaaagacaucccucaauggcagccgucuaagggcuggcaugauuggcagcagguccccuucuguucccaccauuuccacgaacucgugaugaaagacgggagaaagcugguugugccuugccggccccaagacgagcuuauuggacgcgcuagaaucagccagggcgccggguggucucugcgggaaacagcuugucucggaaaggccuaugcgcagauguggucccugauguacuuucaccgcagagaucugcggcucgccagcaacgcuauuugcucugccgucccugugcauuggguccccacgucccgcaccacauggagcauccacgcccaucaccaauggaugaccacagaggacaugcugaccguguggaauagaguuuggauugaagauaacccuuggauggaggacaaaacgcccgugaccacaugggagaaugucccguaccuuggcaagcgggaagaucaguggugugggucccugaucggccucaccagcagagcuacaugggcccagaacaucccuaccgcgauucagcaagugcgcucucugaucggaaaugaggaguuccuugacuauaugcccagcaugaaacgguuuagaaaggaggaggaauccgagggcgcuauuugguga

SEQ ID NO: 20682 - RNA, 9873 nt, Artificial Sequence
  derived and/or modified CDS sequence (opt5) from DENV-3__EU726773__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauuguuaucggaaucauuacccuguaucucggcgcugugguccaggccgacauggggugugugaucaauuggaaaggaaaggagcugaagugcggcagcgggauuuucguuacaaacgaggugcauacguggaccgaacaguacaaauuucaagcugauucccccaagcggcuggccacagcgaucgccggcgcuugggagaauggagucuguggcauuagaagcaccacacgcauggaaaaccuucucuggaaacagaucgccaaugagcugaacuauauccugugggaaaauaacauuaagcucaccgugguugugggggacaucauuggaguccuggagcagggcaaacggacgcuuaccccucagcccauggagcugaaguacucuuggaaaacaugggggaaggcuaagaucgugaccgccgaaacacaaaacuccagcuucauuaucgauggaccuaauacccccgagugcccgucugccuccagagcuuggaacgugugggaagucgaggacuauggcuuuggcguuuucacaaccaauaucuggcucaaacugcgcgaaguguacacgcagcugugugaccaccggcuuaugagcgcggccgugaaggaugagagagcuguccacgccgacaugggguacuggauugagucccagaaaaacggaucuuggaagcucgaaaaagccagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauaugguuaaaucccuggugagcgcgggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcccacacacugaucaugauuggauccaaugcuagcgacagaaugggcaugggggugaccuaccuggcccuuaucgcgacguuuaaaauccagcccuuccuggcucucggauuuuuccugcggaagcucacaucuagagaaaaccugcuucugggcguggggcucgccauggccaccacacugcaacugccugaggauauugaacagauggcuaauggaaucgcccuuggccugauggcucucaaacugauuacccaguuugagaccuaucagcucuggacagcccugaucucccuuacguguagcaacaccauuuucacacugaccgucgcguggcgcacagccacccucauccuggcuggcguuucccugcuuccggugugccaaucuagcuccaugcggaagacggacuggcugcccaugacaguggccgcuaugggggucccuccccucccucuguuuaucuucucucucaaggauacccugaaaagacgcagcuggccccuuaaugagggagugauggccguuggccugguguccauucuggccucuagccuccugagaaacgacgucccuauggcugggccccuuguggcgggaggccugcucaucgccuguuacguuauuaccgggacauccgcugaucugaccguggaaaaggccgccgacgucacaugggaggaagaggcugaacagacgggagugagccauaaccucaugaucaccgucgacgaugacggcacaaugcggauuaaagaugacgagaccgagaauauccugacagugcuucugaagaccgcccugcucaucguuucuggcauuuuuccguacuccaucccugcgacgcugcuuguguggcacaccuggcagaaacagacacaacgcagcgggguccugugggaugugcccucuccucccgaaacccagaaggcugagcucgaagagggaguuuauagaauuaaacagcagggcaucuucgggaagacacaagugggagucggcgugcagaaggaggggguguuucauaccauguggcacguuacacggggagccguccugacguacaacggcaaacgccucgaaccgaauugggccuccgugaagaaagaccugauuagcuauggcgggggauggagacuuucugcucaguggcaaaagggcgaggaagugcaggucaucgccguggagccugggaaaaaccccaagaauuuccagaccaugccuggaacauuccagaccaccacaggcgaaauuggggcgaucgcucuggauuuuaagcccggaacguccggcagccccaucauuaaccgggagggcaaaguuguggggcuguacggaaauggcgucgugaccaagaacgggggauauguuuccggcaucgcccaaacaaaugccgagccugacgggccgacccccgaacucgaggaagagauguucaaaaagcgcaaccugacaauuauggaucuucacccuggcagcggaaaaaccagaaaguaccugcccgcuaucgugcgggaagccauuaagcgcagacuccggacgcugauccucgcuccuacaagagucguggccgcggagauggaggaagcccugaaaggccuucccauccgcuaucagaccaccgcuacaaagucugagcauaccgggcgggaaauuguugaccugaugugccacgccacauuuaccaugagacugcucagcccugugcgcgucccgaauuacaaccugaucauuauggaugaggcucauuucacggaccccgccuccaucgccgcucggggauacauuucuacaagagugggcaugggggaagcggccgcuaucuuuaugaccgccacaccucccggaaccgccgaugcuuucccucagagcaaugcccccauccaggacgaggagaaagacauuccggaacgcuccuggaacucuggcaaugaguggaucacggauuuugcggggaagaccgugugguucgucccuagcauuaaagcuggcaacgacaucgccaacugucuucggaagaauggaaagaaaguuauucaacuguccagaaagacauuugauaccgaauaucagaaaacaaagcucaacgacugggauuucguggugaccacagacaucucugagaugggcgccaauuuuaaagcugaucgcgucauugacccccggagaugccugaagcccgugauccugaccgaugggccugagcggguuauccucgccggacccaugccugugacggcggccagcgcugcccagcgcagaggccgggucgggcgcaacccgcagaaggaaaaugaccaauacauuuucacaggacagccccuuaacaaugaugaggaccacgcucauuggaccgaagccaaaaugcugcuggacaacaucaauaccccugagggcauuauccccgcucucuucgaaccugagagagagaaguccgccgcgauugauggggaauaucggcugaaaggcgagagcagaaagacauuuguggaacuuaugcgccggggagaccugcccguuuggcucgcccacaaaguggcuucugagggcaucaaguacaccgauagaaaauggugcuucgacgggcagcgcaacaaucagauccuggaagagaacauggaugucgagauuuggacaaaggaaggagagaagaaaaagcugcggccgagauggcucgacgcccgcacguauuccgauccucuugcucugaaagaauuuaaggacuucgccgccggccggaaaagcaucgcucuggaucucgugaccgagauugggagaguccccucucaccuggcgcaucgcacaagaaaugcccuugacaaccuggugaugcuccacaccuccgaacauggaggcaaggcuuaccggcacgccguugaggagcugccugaaacaauggagacccugcuccuucugggccugaugauccuccugacggggggagccaugcuuuuucugauuagcggcaaggggaucggaaaaaccuccaucggccucauuugugugaucgcuucuagcgggaugcuguggauggccgaaauuccccugcaauggaucgcguccgccauugugcucgaguucuuuaugaugguccuucugaucccugagcccgaaaagcagcgcacaccgcaggauaaucaacuggcuuauguugugauuggaauccucacccuggccgcuaucauugccgcgaacgagaugggccuucuggaaacaaccaaaagagaccucggcaugagcaaggagccugggguggucucucccacguccuaccuggauguggaccugcaccccgccagcgcuuggacacucuacgccguugcuaccacagugaucaccccuaugcuucggcauaccauugaaaauucuacagccaacgucagccuggcugccaucgcgaaccaggccgugguccugaugggacucgacaaaggcuggccgauuuccaagauggaucugggggugccccuucuggcucucggaugcuauucucagguuaauccucugacgcugaccgccgcugugcuccuucugaucacacacuacgccaucauuggccccgggcugcaggccaaggcgacccgcgaggcucaaaaaagaacagccgcuggaaucaugaagaacccuaccgucgacggcauuaugacgaucgaucucgaccccgugauuuaugauagcaaauucgagaagcagcugggccagguuaugcuucuggugcucugugccguccagcugcugcucaugcggacauccugggcccuuugcgaagcucugacccuggccaccgggccuaucacaacccucugggagggaucuccgggcaaauuuuggaauacaacgaucgcggugagcauggccaacauuuucagaggguccuaccuggcuggagccggccuugcuuuuagcaucaugaagucuguggggaccggaaagcgcggcacaggcucccaaggggaaacccugggagagaaauggaagaaaaagcucaaucagcugagccggaaagaauucgaccuguauaagaaauccggcauuacagagguugauagaaccgaggccaaggaagggcucaagcgcggagagaucacgcaucacgcggucucucggggcagcgccaaacuucagugguuuguggaaagaaacauggugauucccgaggggcgggucaucgaccugggauguggccgcggcgggugguccuacuauugcgcuggacugaagaaaguuaccgaagugagaggcuacacaaaggggggaccuggccaugaggagcccgugccuaugucuaccuacggguggaauauugucaaacucaugagcggaaaggauguguucuaucugcccccggaaaagugugacacacuucugugcgauaucggcgaguccagcccuucucccaccguugaagagucccggacaauccgcgugcucaaaauggucgagcccuggcugaagaacaaucaguucuguauuaaagugcugaacccuuacaugcccaccguuaucgaacaccucgagagacuucaacggaagcacggcgggaugcuggugcgcaauccucugagcagaaacucuacgcaugaaauguauuggauuuccaauggaacaggcaacaucgucgccagcgugaauauggugucucggcuccugcuuaaccgcuuuaccaugacccacagacggccgacaauugagaaagacgucgaucugggggcuggaacgagacauguuaacgccgaacccgagaccccuaauauggacgugaucggcgagcgcaucaagcggauuaaggaagagcacaacagcacauggcacuacgacgaugaaaaucccuauaaaaccugggcuuaccauggguccuaugaggugaaggccacaggaucugcgagcuccaugaucaacggcgucgugaaacuccugaccaagccuugggacguugugcccauggucacacagauggccaugaccgauacgaccccguucggccagcaaagaguguuuaaagaaaagguugacacacgcaccccucggagcaugcccgggacaagacgcgugaugggaauuaccgcugaguggcuguggcggacgcucggcagaaauaagaaaccucgccugugcacacgggaggaauucaccaagaaagucagaacaaacgccgcuaugggggccguguuuaccgaggaaaaucagugggauuccgccaaggcggcuguugaggacgaagauuucuggauccuuguggaccgcgagcgggagcugcacaaacucggaaaguguggcucuugcgucuacaacaugauggggaaaagagaaaagaagcugggcgaguuuggaaaagccaagggcagccgcgccauuugguacauguggcuuggggcuagauaucuggaauucgaggcccucggauuucugaaugaggaucauugguucucccgggaaaacucuuacagcggcguggagggggaaggacugcacaaacucggcuauauccugcgcgacaucuccaagauucccgggggcgcuauguacgccgaugacacggcgggaugggacaccagaaucacagaggaugaccuucauaaugaagagaaaauuacccagcagauggauccugagcaccggcaacuggccaacgcuaucuuuaagcucacauaucagaauaaggucgugaaaguucagagacccaccccgacaggcaccgugauggacauuaucucucggaaggaucagcgcgggagcggacaagucggcacguacgggcugaacacauucaccaauauggaagcccagcuuaucagacagauggagggagaaggcgugcuguccaaagcugaccucgagaacccucaccugcccgaaaagaaaauuacccaguggcuggagacaaaggggguggagcggcucaagcgcauggccaucagcggcgaugacugcguugugaaacccauugaugacagauuugcgaacgcccugcuugcucugaaugauaugggaaagguccggaaagacaucccucaauggcagccgucuaagggcuggcaugauuggcagcaggugcccuucuguucccaccauuuccacgaacucauuaugaaagacgggcgcaagcugguugugccuugcagaccccaagacgagcuuaucggacgggcccgcauuagccagggcgcuggguggucucugagagaaaccgccugucucggaaaggcuuaugcccagauguggucccugauguacuuucaccggcgcgaucugagacucgcgagcaacgccaucugcucugcugucccugugcauuggguccccacaucccggacgaccuggagcauccacgcccaucaccaauggaugacaaccgaggacaugcugacaguguggaaucgcguuuggauugaagauaacccuuggauggaggacaaaacccccgugacgaccugggagaaugucccguaccuuggcaagagagaagaucaguggugugggucccugaucggccucacaagccgggccaccugggcucagaacauuccuacagccauccagcaagugagaucucugauuggaaaugaggaauuccuugacuauaugcccagcaugaaacgcuuucggaaggaggaggaauccgagggcgcgaucugguga

SEQ ID NO: 20683 - RNA, 9873 nt, Artificial Sequence
  derived and/or modified CDS sequence (opt5) from DENV-3__EU726774__SS-prME
accagccugugccucaugaugauccugcccgccgcucuugccuuccaccugacaucccgggacggagaaccucggaugauuguggggaagaacgaacgcggaaagucucuccuguuuaagacggcgagcggcaucaauauguguacccuuauugcuauggaucugggggaaaugugcgacgauacagucaccuacaaguguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcaagguggacaacuucacaauggggguccugugccucgccauccuguuugaagaggugaugcggggaaaguucggcaaaaagcauaugauugccggcguuuucuuuaccuucgugcuucugcucagcgggcagaucacauggcgcgauauggcucacacccugauuauggucggauccaaugccagcgacagaaugggcaugggggugacguaccuggcgcuuaucgcuacauuuaaaauucagcccuuccuggcccucggauuuuuccugcggaagcucaccucuagagaaaaccugcuucugggcguggggcucgccauggcuacaacccugcaacugccugaggauaucgaacagauggccaauggaaucgcucuuggccugauggcccucaaacugaccacacaguuugagacguaucagcucuggaccgcgcugauuucccuuacauguagcaacaccaucuucacacugaccgucgccuggcgcacggcuacacucauucuggccggcguuucccugcuuccggugugccaaucuagcuccaugcggaagaccgacuggcugcccaugaccguggcugccaugggggucccuccccucccucuguuuaucuucucucucaaggauacacugaaaagacgcagcuggccccuuaaugagggagugauggccguuggccugguguccauucuggcuucuagccuccugagaaacgacgucccuauggcggggccccuuguggccggaggccugcucaucgcuuguuacguuaucaccgggacauccgccgaucugacgguggaaaaggccgcugacgucaccugggaggaagaggccgaacagacaggagugagccauaaccucaugauuaccgucgacgaugacggcacaaugcggaucaaagaugacgagaccgagaauauucugacggugcuucugaagaccgcgcugcucaucguuucuggcauuuuuccguacuccaucccugcuacacugcuuguguggcacaccuggcagaaacagacacaacgcagcgggguccugugggaugugcccucuccucccgaaacccagaaggccgagcucgaagagggaguuuauagaaucaaacagcagggcauuuucgggaagacacaagugggagucggcgugcagaaggaggggguguuucauacgauguggcacguuacccggggagccguccugacauacaacggcaaacgccucgaaccgaauugggcuuccgugaagaaagaccugaucagcuauggcgggggauggagacuuucugcccaguggcaaaagggcgaggaagugcaggucauugcgguggagccugggaaaaaccccaagaauuuccagaccaugccuggaaccuuccagacaacgaccggcgaaaucggggcuauugcccuggauuuuaagcccggaacauccggcagccccaucauuaaccgggagggcaaaguuguggggcuguacggaaauggcgucgugaccaagaacgggggauauguuuccggcaucgcccaaacaaaugcugagccugacgggccgacccccgaacucgaggaagagauguucaaaaagcgcaaccugacgaucauggaucuucacccuggcagcggaaaaacaagaaaguaccugcccgccauugugcgggaagcuaucaagcgcagacuccggacccugauucucgccccuaccagagucguggcggccgagauggaggaagcucugaaaggccuucccauccgcuaucagacaaccgccacaaagucugagcauaccgggcgggaaauuguugaccugaugugccacgcuacguuuacaaugagacugcucagcccugugcgcgucccgaauuacaaccugaucaucauggaugaggcccauuucaccgaccccgccuccauugcugcgcggggauacaucucuacaagagugggcaugggggaagccgcugccauuuuuaugaccgccacgccucccggaaccgcugaugccuucccucagagcaaugcgcccauccaggacgaggagcgcgacauuccggaacgguccuggaacucuggcaaugaguggaucacagauuuugcugggaaaaccgugugguucgucccuagcaucaaggccggcaacgacauugccaacugucuucgcaaaaauggaaagaagguuauccaacuguccagaaaaacauuugauaccgaauaucagaagacaaaacucaacgacugggauuucguggugaccacggacauuucugagaugggcgcuaauuuuaaggccgaucgggucaucgaccccagacggugccugaaacccgugauucugacagaugggccugagcgcguuauccucgcgggacccaugccugugaccgccgcuagcgccgcucagagacggggccgcgucgggagaaacccgcagaaggaaaaugaccaauacauuuucaccggacagccccuuaacaaugaugaggaccacgcccauuggacagaagcuaagaugcugcuggacaacaucaauaccccugagggcaucauucccgcccucuucgaaccugagcgggagaaauccgcggccaucgauggggaauauagacugaagggcgagagccgcaaaacauuuguggaacuuaugcggagaggagaccugcccguuuggcucgcucacaagguggccucugagggcauuaaauacacggaucgcaaguggugcuucgacgggcagcggaacaaucagauccuggaagagaacauggaugucgagauuuggaccaaagaaggagagaagaagaaacugagaccgcgcuggcucgacgcucggacauauuccgauccucuugcccugaaggaauuuaaagacuucgccgcuggcagaaagagcaucgcgcuggaucucgugaccgagaucgggcgcguccccucucaccuggcccauagaacacggaaugcucuugacaaccuggugaugcuccacaccuccgaacauggaggcaaagccuaccgccacgccguugaggagcugccugaaacgauggagacccugcuccuucugggccugaugauucuccugacagggggagcuaugcuuuuucugaucagcggcaaggggauuggaaagaccuccaucggccucauuugugugaucgccucuagcgggaugcuguggauggcggaaaucccccugcaauggauugccuccgcuaucgugcucgaguucuuuaugaugguccuucugauuccugagcccgaaaaacagagaacaccgcaggauaaucaacuggccuauguugugaucggcauucucacccuggcugccaucauugcggccaacgagaugggccuucuggaaacgacaaagcgggaccucggcaugagcaaagagccugggguggucucucccaccuccuaccuggauguggaccugcaccccgcuagcgccuggacacucuacgcuguugccaccaccgugaucacaccuaugcuucgccauacgaucgaaaauucuaccgcuaacgucagccuggccgcgauugccaaccaggcugugguccugaugggacucgacaagggcuggccgaucuccaaaauggaucugggggugccccuucuggcccucggaugcuauucucagguuaauccucugacacugaccgcugccgugcuccuucugauuacacacuacgccaucauuggccccgggcugcaggcgaaggcuaccagagaggcccaaaagcggacggcugccggaaucaugaaaaacccuacagucgacggcaucaugaccauugaucucgaccccgugaucuaugauagcaaguucgagaaacagcugggccagguuaugcuucuggugcucugugccguccagcugcugcucaugagaaccuccugggcucuuugcgaagcccugacacuggcgaccgggccuauuacaacgcucugggagggaucuccgggcaaguuuuggaauaccacaaucgccgugagcauggcuaacauuuuccgcggguccuaccuggccggagcuggccuugccuuuagcaucaugaaaucuguggggaccggaaagcggggcacaggcucccaaggggaaacccugggagagaaguggaaaaagaaacucaaucagcugagcagaaaggaguucgaccuguauaaaaaguccggcaucacggagguugaucgcaccgaggcgaaagaagggcucaagcggggagagauuacacaucacgccgucucuagaggcagcgcuaaacuucagugguuuguggaacggaacauggugauccccgaggggcgcgucauugaccugggauguggcagaggcgggugguccuacuauugcgccggacugaaaaagguuaccgaagugcggggcuacacaaaagggggaccuggccaugaggagcccgugccuaugucuaccuacggguggaauaucgucaagcucaugagcggaaaagauguguucuaucugcccccggaaaagugugacacacuucugugcgauauuggcgaguccagcccuucucccaccguugaagagucccgcacgaucagagugcucaagauggucgagcccuggcugaaaaacaaucaguucuguauuaaggugcugaacccuuacaugcccacaguuaucgaacaccucgagcggcuucaacgcaaacacggcgggaugcuggugagaaauccucugagccggaacucuacccaugaaauguauuggaucuccaauggaaccggcaacauugucgcuagcgugaauauggugucucgccuccugcuuaacagauuuacaaugacgcaccggagaccgaccaucgagaaggacgucgaucugggggccggaacacgccauguuaacgcugaacccgagaccccuaauauggacgugauuggcgagcggaucaaaagaauuaaggaagaacacaacagcacauggcacuacgacgaugaaaaucccuauaagaccugggccuaccauggguccuaugaggugaaagcgacaggaucugccagcuccaugaucaacggcgucgugaagcuccugaccaaaccuugggacguugugcccauggucacgcagauggcuaugaccgauacaaccccguucggccagcaacgcguguuuaaggaaaaaguugacacacggaccccuagaagcaugcccgggacgcgccgggugaugggaaucacagccgaguggcuguggagaacccucggccgcaauaagaagccucggcugugcacaagagaggaguucaccaaaaagguccgcacgaacgcugccaugggggccguguuuaccgaggaaaaucagugggauuccgcgaaagcugccguugaggacgaagauuucuggaaacuuguggaccgggagagagagcugcacaaacucggaaaguguggcucuugcgucuacaacaugauggggaaacgcgaaaagaagcugggcgaguuuggaaaagccaagggcagcagagcuauuugguacauguggcuuggggcccgguaucuggaguucgaggcucucggauuucugaaugaggaucauugguucucccgcgaaaacucuuacagcggcguggagggggaaggacugcacaaacucggcuauauccugagagacauuuccaagauccccgggggcgccauguacgcggaugacacagccggaugggacacccggauuacagaggaugaccuucauaaugaagagaaaaucacccagcagauggauccugagcacagacaacuggcuaacgccaucuuuaagcucacauaucagaauaaggucgugaaaguucagcggcccaccccgacgggcacagugauggacauuaucucucgcaaggaucagagagggagcggacaagucggcaccuacgggcugaacaccuucacaaauauggaagcucagcuuauucggcagauggagggagaaggcgugcuguccaaagccgaccucgagaacccucaucugcccgaaaagaaaaucacccaguggcuggagacaaaggggguggagcgccucaagagaauggcgauuagcggcgaugacugcguugugaaacccaucgaugaccgguuugccaacgcucugcuugcccugaaugauaugggaaagguccgcaaagacaucccucaauggcagccgucuaagggcuggcaugauuggcaacaggugcccuucuguucccaccauuuccacgaacucauuaugaaagacgggagaaagcugguugugccuugccggccccaagacgagcuuaucggacgcgcuagaauuagccagggcgccggguggucucugcgggaaacggcuugucucggaaaggccuaugcgcagauguggucccugauguacuuucaccgcagagaucugcggcucgccagcaacgcuaucugcucugccgucccugugcauuggguccccaccucccgcacaaccuggagcauucacgcccaucaccaauggaugacaaccgaggacaugcugacgguguggaauagaguuuggaucgaagauaacccuuggauggaggacaaaacccccgugacaaccugggagaaugucccguaccuuggcaagcgggaagaucaguggugugggucccugauuggccucacaagcagagcuaccugggcccagaacaucccuacggcgauccagcaagugcgcucucugauuggaaaugaggaguuccuugacuauaugcccagcaugaaacgguuuagaaaggaggaggaauccgagggcgcuaucugguga

SEQ ID NO: 20684 - RNA, 9873 nt, Artificial Sequence
  derived and/or modified CDS sequence (opt5) from DENV-3__EU687219__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacacuuauugcuauggaucugggggaaaugugcgacgauacagucaccuacaaauguccgcacaucgccgaaguugaacccgaagacauugauugcugguguaaccucacauccaccugggugacauauggaaccugcaaucaggccggcgagcaccggcgggacaagcgcucuguggcucuggccccucaugucgggaugggacuggauacgagaacccagacauggaugagcgcugagggcgccuggagacagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccaaaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucaccaagaaggaggaacccgugaacauugaggccgaaccuccguucggcgaguccaauaucgugauugggaucggcgauaacgcccugaaaaucaauugguauaagaagggaucuagcauuggcaaaauguuugaagcuaccgccagaggggcuagacgcauggccauccuuggagacacggcgugggauuucggcuccguugggggaguccucaacagccugggcaagauggugcaccagauuuuugggucugccuacacagcucuguucuccggcgugagcugggucaugaaaaucggaauuggcgugcuccugaccuggaucgggcuuaauucuaagaacaccagcauguccuuuucuugcauugccaucggaaucauuacacuguaucucggcgcuguugugcaggccgacauggggugugucaucaauuggaaaggaaaggagcugaagugcggcagcgggauuuucgugaccaacgagguucauacauggacggaacaguacaaauuucaagcggauucccccaagcggcuggccaccgcuaucgccggcgcuugggagaauggaguguguggcauuagaagcacaacccgcauggaaaaccuucucuggaaacagaucgccaaugagcugaacuauauccugugggaaaauaacauuaagcucacagucgugguuggggacaucauuggagugcuggagcagggcaaacggacccuuacgccucagcccauggagcugaaguacucuuggaaaaccugggggaaggccaagaucgucacagcugaaacccaaaacuccagcuucauuaucgauggaccuaauacacccgagugcccgucuguguccagagcguggaacgugugggaagucgaggacuauggcuuuggcguuuucaccacaaauaucuggcucaaacugcgcgaaguguacacccagcugugugaccaccggcuuaugagcgccgcugugaaggaugagagagccguccacgccgacaugggguacuggauugagucccagaaaaacggaucuuggaagcucgaaaaagcuagccugaucgaggugaagacgugcacauggccuaagucccauacccuguggucuaauggcguucucgaaagcgauaugauuauccccaaaucccuggccgggccuauuagccagcacaacuaucgccccggauaccauacccaaacagcgggcccuuggcaccuugggaagcuggagcucgacuuuaauuauugcgagggaaccacgguggucaucacagaaaacuguggcacccggggccccucucugagaacaaccacaguguccgggaaacugauccacgaguggugcugucgcagcugcacccuuccgccucuccgguacaugggagaagauggcuguugguaugggauggagauuagacccaucucugaaaaggaggagaauaugguuaaaucccuggugagcgcuggaucuggcaaggucgacaacuucacgaugggggugcugugccucgccauucuguuugaagagguuaugcggggaaaguucggcaaaaagcauaugaucgccggcguguucuuuaccuucguccuucugcucagcgggcagauuacauggcgcgauauggcucacacccugaucaugauuggauccaaugccagcgacagaaugggcaugggggugacauaccuggcgcuuaucgcuaccuuuaaaauccagcccuuccuggcccucggauuuuuccugcggaagcucacgucuagagaaaaccugcuucugggcguggggcucgccauggcuacaacccugcaacugccugaggauauugaacagauggccaauggaaucgcucuuggccugauggcccucaaacugauuacacaguuugagaccuaucagcucuggaccgcgcugaucucccuuacauguagcaacacgauuuucacccugacagucgccuggcgcaccgcuacacucauccuggccggcguuucccugcuuccggugugccaaucuagcuccaugcggaagaccgacuggcugcccaugacgguggcugccaugggggucccuccccucccucuguuuaucuucucucucaaggauacacugaaaagacgcagcuggccccuuaaugagggagugauggccguuggccugguguccauucuggcuucuagccuccugagaaacgacgucccuauggcggggccccuuguggccggaggccugcucaucgcuuguuacguuauuaccgggaccuccgccgaucugacaguggaaaaggccgcugacgucaccugggaggaagaggccgaacagacaggagugagccauaaccucaugaucacggucgacgaugacggcaccaugcggauuaaagaugacgagacagagaauauccugaccgugcuucugaagacagcgcugcucaucguuucuggcauuuuuccguacuccaucccugcuacccugcuuguguggcacacguggcagaaacagacccaacgcagcgggguccugugggaugugcccucuccucccgaaacacagaaggccgagcucgaagagggaguuuauagaauuaaacagcagggcaucuucgggaagacccaagugggagucggcgugcagaaggaggggguguuucauacaauguggcacguuacccggggagccguccugacauacaacggcaaacgccucgaaccgaauugggcuuccgugaagaaagaccugauuagcuauggcgggggauggagacuuucugcccaguggcaaaagggcgaggaagugcaggucaucgcgguggagccugggaaaaaccccaagaauuuccagacgaugccuggaaccuuccagacaaccaccggcgaaauuggggcuaucgcccuggauuuuaagcccggaacauccggcagccccaucauuaaccgggagggcaaaguuguggggcuguacggaaauggcgucaucacgaagaacgggggauauguguccggcauugcccaaaccaaugcugagccugacgggccgacacccgaacucgaggaagagauguucaaaaagcgcaaccugaccaucauggaucuucacccuggcagcggaaaaacaagaaaguaccugcccgccauuguucgggaagcuaucaagcgcagacuccggacccugauccucgccccuacgagaguggucgcggccgagauggaggaagcucugaaaggccuucccauucgcuaucagacaaccgccaccaagucugagcauacagggcgggaaaucguggaccugaugugccacgcuaccuuuacaaugagacugcucagcccuguucgcgugccgaauuacaaccugauuaucauggaugaggcccauuucaccgaccccgccuccauugcugcgcggggauacaucucuacgagagucggcaugggggaagccgcugccaucuuuaugacagccaccccucccggaacagcugaugccuucccucagagcaaugcgcccauucaggacgaggagcgcgacaucccggaacgguccuggaacucuggcaaugaguggauuaccgauuuugcugggaaaacggugugguucgugccuagcaucaaggccggcaacgacauugccaacugucuucgcaaaaauggaaagaaggucauccaacuguccagaaaaaccuuugauacagaauaucagaagaccaaacucaacgacugggauuucguugugacaaccgacauuucugagaugggcgcuaauuuuaaggccgaucgggugaucgaccccagacggugccugaaacccgucauccugacagaugggccugagcgcgugauucucgcgggacccaugccuguuaccgccgcuagcgccgcucagagacggggccgcguggggagaaacccgcagaaggaaaaugaccaauacaucuucacgggacagccccuuaacaaugaugaggaccacgcccauuggacagaagcuaagaugcugcuggacaacauuaauaccccugagggcaucauucccgcccucuucgaaccugagcgggagaaauccgcggccaucgauggggaauauagacugaagggcgagagccgcaaaaccuuugucgaacuuaugcggagaggagaccugcccguguggcucgcucacaagguugccucugagggcaucaaauacacagaucgcaaguggugcuucgacgggcagcggaacaaucagauucuggaagagaacauggauguggagaucuggaccaaagaaggagagaagaagaaacugagaccgcgcuggcucgacgcucggacauauuccgauccucuugcccugaaggaauuuaaagacuucgccgcuggcagaaagagcauugcgcuggaucucgucacggagaucgggcgcgugcccucucaccuggcccauagaacccggaaugcucuugacaaccuggucaugcuccacacauccgaacauggaggcaaagccuaccgccacgccguggaggagcugccugaaaccauggagacacugcuccuucugggccugaugauucuccugaccgggggagcuaugcuuuuucugaucagcggcaaggggaucggaaagacguccauuggccucaucuguguuauugccucuagcgggaugcuguggauggcggaaaucccccugcaauggauugccuccgcuaucgugcucgaguucuuuaugauggugcuucugauuccugagcccgaaaaacagagaaccccgcaggauaaucaacuggccuaugucguuaucggaauccucacacuggcugccauuaucgcggccaacgagaugggccuucuggaaaccacaaagcgggaccucggcaugagcaaagagccugggguggugucucccaccuccuaccuggaugucgaccugcaccccgcuagcgccuggacgcucuacgcuguggccacaaccguuauuacaccuaugcuucgccauaccaucgaaaauucuaccgcuaacgugagccuggccgcgauugccaaccaggcugucgugcugaugggacucgacaagggcuggccgaucuccaaaauggaucugggggucccccuucuggcccucggaugcuauucucaggugaauccucugacacugacggcugccguucuccuucugaucacccacuacgccauuaucggccccgggcugcaggcgaaggcuacaagagaggcccaaaagcggaccgcugccggaauuaugaaaaacccuacaguggacggcaucaugaccauugaucucgaccccgucaucuaugauagcaaguucgagaaacagcugggccaggugaugcuucugguucucugugccgugcagcugcugcucaugagaacguccugggcucuuugcgaagcccugacacuggcgaccgggccuaucaccacacucugggagggaucuccgggcaaguuuuggaauaccacaauugccgucagcauggcuaacaucuuccgcggguccuaccuggccggagcuggccuugccuuuagcauuaugaaaucuguggggacgggaaagcggggcaccggcucccaaggggaaacacugggagagaaguggaaaaagaaacucaaucagcugagcagaaaggaguucgaccuguauaaaaaguccggcaucaccgagguggaucgcacagaggcgaaagaagggcucaagcggggagagauuacccaucacgccguuucuagaggcagcgcuaaacuucagugguuugucgaacggaacauggugauccccgaggggcgcgugauugaccugggauguggcagaggcgggugguccuacuauugcgccggacugaaaaaggucacggaaguucggggcuacaccaaagggggaccuggccaugaggagcccgugccuaugucuacauacggguggaauaucgugaagcucaugagcggaaaagaugucuucuaucugcccccggaaaagugugacacccuucugugcgauaucggcgaguccagcccuucucccacaguggaagagucccgcaccauuagaguucucaagaugguggagcccuggcugaaaaacaaucaguucuguaucaagguccugaacccuuacaugcccacagugauugaacaccucgagcggcuucaacgcaaacacggcgggaugcugguuagaaauccucugagccggaacucuacccaugaaauguauuggaucuccaauggaacgggcaacauuguggcuagcgucaauauggugucucgccuccugcuuaacagauuuacaaugacccaccggagaccgaccaucgagaaggacguggaucugggggccggaacacgccaugucaacgcugaacccgagacgccuaauauggacguuaucggcgagcggauuaaaagaaucaaggaagaacacaacagcaccuggcacuacgacgaugaaaaucccuauaagacaugggccuaccauggguccuaugaggugaaagcgaccggaucugccagcuccaugauuaacggcguggucaagcuccugacaaaaccuugggacgugguucccauggugacccagauggcuaugacagauaccacgccguucggccagcaacgcgucuuuaaggaaaaaguggacacccggacaccuagaagcaugcccgggacccgccggguuaugggaaucacagccgaguggcuguggagaacccucggccgcaauaagaagccucggcugugcacgagagaggaguucaccaagaaggugcgcaccaacgcugccaugggggccgucuuuacagaggaaaaucagugggauuccgcgaaagcugccguggaggacgaagauuucuggaaacuuguugaccgggagagagagcugcacaaacucggaaaguguggcucuugcguguacaacaugauggggaaacgcgaaaagaagcugggcgaguuuggaaaagccaagggcagcagagcuauuugguacauguggcuuggggcccgguaucuggaguucgaggcucucggauuucugaaugaggaucauugguucucccgcgaaaacucuuacagcggcgucgagggggaaggacugcacaaacucggcuauauccugagagacaucuccaagauucccgggggcgccauguacgcggaugacaccgccggaugggacacgcggaucaccgaggaugaccuucauaaugaagagaaaauuacacagcagauggauccugagcacagacaacuggcuaacgccaucuuuaagcucaccuaucagaauaagguggucaaagugcagcggcccacaccgaccggcacaguuauggacauuaucucucgcaaggaucagagagggagcggacaagugggcaccuacgggcugaacacguucacaaauauggaagcucagcuuauccggcagauggagggagaaggcguccuguccaaagccgaccucgagaacccucaucugcccgaaaagaaaauuacccaguggcuggagaccaaggggguggagcgccucaagagaauggcgaucagcggcgaugacugcgugguuaaacccauugaugaccgguuugccaacgcucugcuugcccugaaugauaugggaaaggugcgcaaagacaucccucaauggcagccgucuaagggcuggcaugauuggcagcagguccccuucuguucccaccauuuccacgaacucauuaugaaagacgggagaaagcuggugguuccuugccggccccaagacgagcuuaucggacgcgcuagaauuagccagggcgccggguggucucugcgggaaacagcuugucucggaaaggccuaugcgcagauguggucccugauguacuuucaccgcagagaucugcggcucgccagcaacgcuaucugcucugccgugccuguccauugggugcccaccucccgcacaacguggagcauccacgcccaucaccaauggaugaccacagaggacaugcugaccgucuggaauagaguguggauugaagauaacccuuggauggaggacaaaacacccguuaccacgugggagaaugugccguaccuuggcaagcgggaagaucaguggugugggucccugaucggccucaccagcagagcuacaugggcccagaacauuccuaccgcgauccagcaaguccgcucucugauuggaaaugaggaguuccuugacuauaugcccagcaugaaacgguuuagaaaggaggaggaauccgagggcgcuaucugguga

SEQ ID NO: 20685 - RNA, 9873 nt, Artificial Sequence
  derived and/or modified CDS sequence (opt5) from DENV-3__EU726768__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauuguuaucggaaucauuacccuguaucucggcgcugugguccaggccgacauggggugugugaucaauuggaaaggaaaggagcugaagugcggcagcgggauuuucguuacaaacgaggugcauacguggaccgaacaguacaaauuucaagcugauucccccaagcggcuggccacagcgaucgccggcgcuugggagaauggagucuguggcauuagaagcaccacacgcauggaaaaccuucucuggaaacagaucgccaaugagcugaacuauauccugugggaaaauaacauuaagcucaccgugguugugggggacaucauuggaguccuggagcagggcaaacggacgcuuaccccucagcccauggagcugaaguacucuuggaaaacaugggggaaggcuaagaucgugaccgccgaaacacaaaacuccagcuucauuaucgauggaccuaauacccccgagugcccgucugccuccagagcuuggaacgugugggaagucgaggacuauggcuuuggcguuuucacaaccaauaucuggcucaaacugcgcgaaguguacacgcagcugugugaccaccggcuuaugagcgcggccgugaaggaugagagagcuguccacgccgacaugggguacuggauugagucccagaaaaacggaucuuggaagcucgaaaaagccagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauaugguuaaaucccuggugagcgcgggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcccacacacugaucaugauuggauccaaugcuagcgacagaaugggcaugggggugaccuaccuggcccuuaucgcgacguuuaaaauccagcccuuccuggcucucggauuuuuccugcggaagcucacaucuagagaaaaccugcuucugggcguggggcucgccauggccaccacacugcaacugccugaggauauugaacagauggcuaauggaaucgcccuuggccugauggcucucaaacugauuacccaguuugagaccuaucagcucuggacagcccugaucucccuuacguguagcaacaccauuuucacacugaccgucgcguggcgcacagccacccucauccuggcuggcguuucccugcuuccggugugccaaucuagcuccaugcggaagacggacuggcugcccaugacaguggccgcuaugggggucccuccccucccucuguuuaucuucucucucaaggauacccugaaaagacgcagcuggccccuuaaugagggagugauggccguuggccugguguccauucuggccucuagccuccugagaaacgacgucccuauggcugggccccuuguggcgggaggccugcucaucgccuguuacguuauuaccgggacauccgcugaucugaccguggaaaaggccgccgacgucacaugggaggaagaggcugaacagacgggagugagccauaaccucaugaucaccgucgacgaugacggcacaaugcggauuaaagaugacgagaccgagaauauccugacagugcuucugaagaccgcccugcucaucguuucuggcauuuuuccguacuccaucccugcgacgcugcuuguguggcacaccuggcagaaacagacacaacgcagcgggguccugugggaugugcccucuccucccgaaacccagaaggcugagcucgaagagggaguuuauagaauuaaacagcagggcaucuucgggaagacacaagugggagucggcgugcagaaggaggggguguuucauaccauguggcacguuacacggggagccguccugacguacaacggcaaacgccucgaaccgaauugggccuccgugaagaaagaccugauuagcuauggcgggggauggagacuuucugcucaguggcaaaagggcgaggaagugcaggucaucgccguggagccugggaaaaaccccaagaauuuccagaccaugccuggaacauuccagaccaccacaggcgaaauuggggcgaucgcucuggauuuuaagcccggaacguccggcagccccaucauuaaccgggagggcaaaguuguggggcuguacggaaauggcgucgugaccaagaacgggggauauguuuccggcaucgcccaaacaaaugccgagccugacgggccgacccccgaacucgaggaagagauguucaaaaagcgcaaccugacaauuauggaucuucacccuggcagcggaaaaaccagaaaguaccugcccgcuaucgugcgggaagccauuaagcgcagacuccggacgcugauccucgcuccuacaagagucguggccgcggagauggaggaagcccugaaaggccuucccauccgcuaucagaccaccgcuacaaagucugagcauaccgggcgggaaauuguugaccugaugugccacgccacauuuaccaugagacugcucagcccugugcgcgucccgaauuacaaccugaucauuauggaugaggcucauuucacggaccccgccuccaucgccgcucggggauacauuucuacaagagugggcaugggggaagcggccgcuaucuuuaugaccgccacaccucccggaaccgccgaugcuuucccucagagcaaugcccccauccaggacgaggagcgcgacauuccggaacgguccuggaacucuggcaaugaguggaucacggauuuugcggggaaaaccgugugguucgucccuagcauuaaggcuggcaacgacaucgccaacugucuucgcaaaaauggaaagaagguuauucaacuguccagaaaaacauuugauaccgaauaucagaagacaaaacucaacgacugggauuucguggugaccacagacaucucugagaugggcgccaauuuuaaggcugaucgggucauugaccccagacggugccugaaacccgugauccugaccgaugggccugagcgcguuauccucgccggacccaugccugugacggcggccagcgcugcccagagacggggccgcgucgggagaaacccgcagaaggaaaaugaccaauacauuuucacaggacagccccuuaacaaugaugaggaccacgcucauuggaccgaagccaagaugcugcuggacaacaucaauaccccugagggcauuauccccgcucucuucgaaccugagcgggagaaauccgccgcgauugauggggaauauagacugaagggcgagagccgcaaaacauuuguggaacuuaugcggagaggagaccugcccguuuggcucgcccacaagguggcuucugagggcaucaaauacaccgaucgcaaguggugcuucgacgggcagcggaacaaucagauccuggaagagaacauggaugucgagauuuggacaaaagaaggagagaagaagaaacugagaccgcgcuggcucgacgcccggacguauuccgauccucuugcucugaaggaauuuaaagacuucgccgccggcagaaagagcaucgcucuggaucucgugaccgagauugggcgcguccccucucaccuggcgcauagaacacggaaugcccuugacaaccuggugaugcuccacaccuccgaacauggaggcaaggcuuaccgccacgccguugaggagcugccugaaacaauggagacccugcuccuucugggccugaugauccuccugacagggggagccaugcuuuuucugauuagcggcaaggggaucggaaagaccuccaucggccucauuugugugaucgcuucuagcgggaugcuguggauggccgaaauuccccugcaauggaucgcguccgccauugugcucgaguucuuuaugaugguccuucugaucccugagcccgaaaaacagagaacaccgcaggauaaucaacuggcuuauguugugauuggaauccucacccuggccgcuaucauugccgcgaacgagaugggccuucuggaaacaaccaagcgggaccucggcaugagcaaagagccugggguggucucucccacguccuaccuggauguggaccugcaccccgccagcgcuuggacacucuacgccguugcuaccacagugaucaccccuaugcuucgccauaccauugaaaauucuacagccaacgucagccuggcugccaucgcgaaccaggccgugguccugaugggacucgacaagggcuggccgauuuccaaaauggaucugggggugccccuucuggcucucggaugcuauucucagguuaauccucugacgcugaccgccgcugugcuccuucugaucacacacuacgccaucauuggccccgggcugcaggccaaggcgaccagagaggcucaaaagcggacagccgcuggaaucaugaaaaacccuaccgucgacggcauuaugacgaucgaucucgaccccgugauuuaugauagcaaguucgagaaacagcugggccagguuaugcuucuggugcucugugccguccagcugcugcucaugagaacauccugggcccuuugcgaagcucugacccuggccaccgggccuaucacaacccucugggagggaucuccgggcaaguuuuggaauacaacgaucgcggugagcauggccaacauuuuccgcggguccuaccuggcuggagccggccuugcuuuuagcaucaugaaaucuguggggaccggaaagcggggcacaggcucccaaggggaaacccugggagagaaguggaaaaagaaacucaaucagcugagcagaaaggaguucgaccuguauaaaaaguccggcauuacagagguugaucgcaccgaggccaaagaagggcucaagcggggagagaucacgcaucacgcggucucuagaggcagcgccaaacuucagugguuuguggaacggaacauggugauucccgaggggcgcgucaucgaccugggauguggcagaggcgggugguccuacuauugcgcuggacugaaaaagguuaccgaagugcggggcuacacaaaagggggaccuggccaugaggagcccgugccuaugucuaccuacggguggaauauugucaagcucaugagcggaaaagauguguucuaucugcccccggaaaagugugacacacuucugugcgauaucggcgaguccagcccuucucccaccguugaagagucccgcacaaucagagugcucaagauggucgagcccuggcugaaaaacaaucaguucuguauuaaggugcugaacccuuacaugcccaccguuaucgaacaccucgagcggcuucaacgcaaacacggcgggaugcuggugagaaauccucugagccggaacucuacgcaugaaauguauuggauuuccaauggaacaggcaacaucgucgccagcgugaauauggugucucgccuccugcuuaacagauuuaccaugacccaccggagaccgacaauugagaaggacgucgaucugggggcuggaacgcgccauguuaacgccgaacccgagaccccuaauauggacgugaucggcgagcggaucaaaagaauuaaggaagaacacaacagcacauggcacuacgacgaugaaaaucccuauaagaccugggcuuaccauggguccuaugaggugaaagccacaggaucugcgagcuccaugaucaacggcgucgugaagcuccugaccaaaccuugggacguugugcccauggucacacagauggccaugaccgauacgaccccguucggccagcaacgcguguuuaaggaaaaaguugacacacggaccccuagaagcaugcccgggacacgccgggugaugggaauuaccgcugaguggcuguggagaacgcucggccgcaauaagaagccucggcugugcacaagagaggaguucaccaaaaagguccgcacaaacgccgcuaugggggccguguuuaccgaggaaaaucagugggauuccgccaaagcggcuguugaggacgaagauuucuggauccuuguggaccgggagagagagcugcacaagcucggaaaauguggcucuugcgucuacaacaugauggggaagcgcgagaaaaagcugggcgaguuuggaaaggccaaaggcagcagagccauuugguacauguggcuuggggcucgguaucuggaguucgaggcccucggauuucugaaugaggaucauugguucucccgcgaaaacucuuacagcggcguggagggggaaggacugcacaagcucggcuauauccugagagacaucuccaaaauucccgggggcgcuauguacgccgaugacacggcgggaugggacacccggaucacagaggaugaccuucauaaugaagagaagauuacccagcagauggauccugagcacagacaacuggccaacgcuaucuuuaaacucacauaucagaauaaggucgugaagguucagcggcccaccccgacaggcaccgugauggacauuaucucucgcaaagaucagagagggagcggacaagucggcacguacgggcugaacacauucaccaauauggaagcccagcuuauccggcagauggagggagaaggcgugcuguccaaggcugaccucgagaacccucaucugcccgagaaaaagauuacccaguggcuggagacaaaagggguggagcgccucaagagaauggccaucagcggcgaugacugcguugugaagcccauugaugaccgguuugcgaacgcccugcuugcucugaaugauaugggaaaaguccgcaaggacaucccucaauggcagccgucuaaaggcuggcaugauuggcaacaggugcccuucuguucccaccauuuccacgaacucauuaugaaggacgggagaaaacugguugugccuugccggccccaagacgagcuuaucggacgcgccagaauuagccagggcgcuggguggucucugcgggaaaccgccugucucggaaaggcuuaugcccagauguggucccugauguacuuucaccgcagagaucugcggcucgcgagcaacgccaucugcucugcugucccugugcauuggguccccacaucccgcacgaccuggagcauccacgcccaucaccaauggaugacaaccgaggacaugcugacaguguggaauagaguuuggauugaagauaacccuuggauggaggacaagacccccgugacgaccugggagaaugucccguaccuuggcaaacgggaagaucaguggugugggucccugaucggccucacaagcagagccaccugggcucagaacauuccuacagccauccagcaagugcgcucucugauuggaaaugaggaguuccuugacuauaugcccagcaugaagcgguuuagaaaagaggaggaauccgagggcgcgaucugguga

SEQ ID NO: 20686 - RNA, 9873 nt, Artificial Sequence
  derived and/or modified CDS sequence (opt5) from DENV-3__EU687226__SS-prME
accagccugugccucaugaugauccugcccgccgcucuugccuuccaccugaccucccgggacggagaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucagugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccgugucugaaaaggaggagaauaugguuaaaucccuggugagcgcuggaucuggcaaggucgacaacuucaccaugggggugcugugccucgccauccuguuugaagagguuaugcggggaaaguucggcaaaaagcauaugauugccggcguguucuuuacauucguccuucugcucagcgggcagaucaccuggcgcgauauggcucacacacugauuaugaucggauccaaugccagcgacagaaugggcaugggggugaccuaccuggcgcuuauugcuacguuuaaaauccagcccuuccuggcccucggauuuuuccugcggaagcucacaucuagagaaaaccugcuucugggcguggggcucgccauggcuaccacacugcaacugccugaggauaucgaacagauggccaauggaauugcucuuggccugauggcccucaaacugaucacccaguuugagaccuaucagcucuggacagcgcugauuucccuuacguguagcaacaccaucuucacacugaccgucgccuggcgcacagcuacccucauucuggccggcguuucccugcuuccggugugccaaucuagcuccaugcggaagacggacuggcugcccaugacaguggcugccaugggggucccuccccucccucuguuuaucuucucucucaaggauacccugaaaagacgcagcuggccccuuaaugagggagugauggccguuggccugguguccauccuggcuucuagccuccugagaaacgacgucccuauggcggggccccuuguggccggaggccugcucauugcuuguuacguuaucaccgggacauccgccgaucugaccguggaaaaggccgcugacgucacaugggaggaagaggccgaacagacgggagugagccauaaccucaugauuaccgucgacgaugacggcacaaugcggaucaaagaugacgagaccgagaauauucugacagugcuucugaagaccgcgcugcucaucguuucuggcaucuuuccguacuccauuccugcuacgcugcuuguguggcacaccuggcauaaacagacacagcgcagcgggguccccugggaugugccuucucccccggaaacccaaaaggccgagcuggaagagggaguuuauagaaucaaacagcagggcauuuucgggaagacacaggugggagucggcgugcaaaaggaggggguguuucacuccauguggcacguuacccggggagccguccucacauacaacggcaaacgccuggaaccuaauugggcuagcgugaagaaagaccucaucucuuauggcgggggauggagacuguccgcccaguggcagaagggcgaggaagugcaagucauugcgguggagcccgggaaaaacccuaagaauuuccagacgaugcccggaaccuuccagacaaccaccggcgaaaucggggcuauugcccuugauuuuaagcccggaacaagcggcuccccuaucaucaaccgggagggcaaaguuguggggcuguacggaaauggcgucgugacgaagaacgggggauauguuagcggcauugcccagaccaaugcugagccggacgggcccacaccugaacuggaggaagagauguucaaaaagcgcaaccucaccaucauggaucugcaucccggcucuggaaaaacaagaaaguaccuuccugccauugugcgggaagcuaucaagcgcagacugcggacccucauucuggcccccacgagagucguggcggccgagauggaggaagcucucaaaggccugccuauccgcuaucaaacaaccgccaccaagagcgagcacacagggcgggaaaucguugaccuuaugugccaugcuaccuuuacaaugagacugcuguccccggugcgcguccccaauuacaaccucauuaucauggaugaggcccacuucaccgacccugccucuauugcugcgcggggauacaucagcacgagagugggcaugggggaagccgcugccauuuuuaugacagccacacccccuggaacagcugaugccuucccccaguccaaugcgccgauccaggacgaggagcgcgacaucccugaacggucuuggaacagcggcaaugaguggauuaccgauuuugcugggaaaacggugugguucguccccuccaucaaggccggcaacgacauugccaacugucugcgcaaaaauggaaagaagguuauccagcuuucuagaaaaaccuuugauacagaauaucaaaagaccaaacugaacgacugggauuucguggugacaaccgacauuagcgagaugggcgcuaauuuuaaggccgaucgggucaucgaccccagacggugccucaaaccugugauucugacagaugggcccgagcgcguuauccuggcgggaccuaugccggugaccgccgcuuccgccgcucagagacggggccgcgucgggagaaacccccagaaggaaaaugaccaguacaucuucacgggacaaccucucaacaaugaugaggaccaugcccacuggacagaagcuaagaugcuucuggacaacauuaauacccccgagggcaucauuccugcccuguucgaacccgagcgggagaaaagcgcggccaucgauggggaauauagacucaagggcgagucucgcaaaaccuuuguggaacugaugcggagaggagaccuuccgguuuggcuggcucacaagguggccuccgagggcauuaaauacacagaucgcaaguggugcuucgacgggcagcggaacaaucagauccucgaagagaacauggaugucgagaucuggaccaaagaaggagagaagaagaaacugagaccucgcuggcuggacgcucggacauauagcgauccccucgcccuuaaggaauuuaaagacuucgccgcuggcagaaagucuauugcgcuggaucuggugacggagaucgggcgcgucccuucccaucucgcccacagaacccggaaugcucuggacaaccuugugaugcugcauacaagcgaacacggaggcaaagccuaccgccacgccguugaggagcuccccgaaaccauggagacacugcugcuccuuggccugaugauucugcucaccgggggagcuaugcuguuucuuaucuccggcaaggggauuggaaagacgucuaucggccugaucugugugauugccagcuccgggaugcucuggauggcggaaaucccucugcaguggauugccagcgcuaucgugcuggaguucuuuaugaugguccuccuuauucccgagccggaaaaacaaagaaccccucaggauaaucagcuggccuauguugugaucggcauucugacacucgcugccaucaucgcggccaacgagaugggccugcuugaaaccacaaagcgggaccugggcaugucuaaagagcccgggguggucucccccaccagcuaccucgauguggaccugcauccugcuucugccuggacgcuguacgcuguugccacaaccgugauuacaccgaugcuccgccacaccaucgaaaauagcaccgcuaacgucucccuugccgcgauugccaaccaagcugugguccugaugggacuggacaagggcuggcccaucucuaaaauggaucucggggugccucugcuugcccugggaugcuauagccagguuaauccccucacacugacggcugccgugcugcuccuuauuacccauuacgccaucaucggcccugggcugcaggcgaaggcuacaagagaggcccagaagcggaccgcugccggaauuaugaaaaaccccacagucgacggcaucaugaccauugaucuggacccugugaucuaugauuccaaguucgagaaacaacucggccagguuaugcugcuugugcugugugccguccagcuccugcugaugagaacgucuugggcucucugcgaagcccuuacacuggcgaccgggccgauuaccacacugugggagggaagccccggcaaguuuuggaauaccacaaucgccguguccauggcuaacaucuuccgcgggagcuaccucgccggagcuggccuggccuuuucuauuaugaaauccguggggacgggaaagcggggcaccggcagccagggggaaacacuuggagagaaguggaaaaagaaacugaaucaacucuccagaaaggaguucgaccuguauaaaaagucuggcaucaccgagguugaucgcacagaggcgaaagaagggcugaagcggggagagauuacccaccaugccgucagcagaggcuccgcuaagcuccagugguuuguggaacggaacauggugaucccugaggggcgcgucauugaccuuggauguggcagaggcggguggucuuacuauugcgccggacugaaaaagguuacggaagugcggggcuacaccaaagggggacccggccacgaggagccugugcccaugagcacauacggguggaauaucgucaagcugauguccggaaaagauguguucuaucucccgccugaaaagugugacacccugcuuugcgauauuggcgagagcucucccucccccacaguugaagagagccgcaccaucagagugcugaagauggucgagccuuggcucaaaaacaaucaguucuguaucaaggugcugaaccccuacaugccuacaguuauugaacaccuggagcggcuccagcgcaaacauggcgggaugcuugugagaaauccgcugucucggaacuccacccacgaaauguauuggaucagcaauggaacgggcaacauugucgcuucugugaauauggugagccgccugcuccugaacagauuuacaaugacccaucggagacccaccaucgagaaggacgucgaucuuggggccggaacacgccacguuaacgcugaaccugagacgcccaauauggacgugauuggcgagcggaucaaaagaaucaaggaagaacacaacuccaccuggcauuacgacgaugaaaauccuuauaagacaugggccuaccacgggucuuaugaggugaaagcgaccggaagcgccuccagcaugauuaacggcgucgugaagcugcucacaaaacccugggacguugugccgauggucacccaaauggcuaugacagauaccacgccuuucggccagcagcgcguguuuaaggaaaaaguugacacccggacacccagauccaugccugggacccgccgggugaugggaaucacagccgaguggcuguggagaacccugggccgcaauaagaagccccggcucugcacgagagaggaguucaccaaaaagguccgcaccaacgcugccaugggggccguguuuacagaggaaaaucaaugggauucugcgaaagcugccguugaggacgaagauuucuggaagcugguggaccgggagagagagcuucauaaacugggaaaguguggcagcugcgucuacaacaugauggggaaacgcgaaaagaagcucggcgaguuuggaaaagccaagggcuccagagcuauuugguacauguggcugggggcccgguaucuugaguucgaggcucugggauuucucaaugaggaucacugguucucucgcgaaaacagcuacuccggcguggagggggaaggacugcauaaacugggcuauauccucagagacauuucuaagaucccugggggcgccauguacgcggaugacaccgccggaugggacacgcggaucaccgaggaugaccugcacaaugaagagaaaauuacacagcagauggaucccgagcacagacagcuugcuaacgccaucuuuaagcugaccuaucaaaauaaggucgugaaaguucagcggccgacaccuaccggcacagugauggacauuaucagccgcaaggaucagagaggguccggacaggucggcaccuacgggcucaacacguucacaaauauggaagcucaacugauucggcagauggagggagaaggcgugcuuagcaaagccgaccuggagaacccccaucuccccgaaaagaaaaucacccaguggcuggagaccaaggggguggagcgccugaagagaauggcgaucucuggcgaugacugcguugugaaaccuauugaugaccgguuugccaacgcucuccuggcccuuaaugauaugggaaagguccgcaaagacaucccgcaguggcaacccuccaagggcuggcacgauuggcaacaggugccuuucuguagccaucacuuccacgaacugauuaugaaagacgggagaaagcucguugugcccugccggccucaggacgagcugaucggacgcgcuagaauuucucaaggcgccggguggucccuucgggaaacagcuugucugggaaaggccuaugcgcagauguggagccucauguacuuucaucgcagagaucugcggcuggccucuaacgcuaucugcuccgccguccccgugcacugggucccuaccagccgcacaacgugguccauucaugcccaccaucaguggaugaccacagaggacaugcucaccguguggaauagaguuuggaucgaagauaaccccuggauggaggacaaaacaccggugaccacgugggagaaugucccuuaccugggcaagcgggaagaucaauggugugggagccuuaucggccugaccucuagagcuacaugggcccagaacauucccaccgcgauccaacaggugcgcagccucauuggaaaugaggaguuccuggacuauaugccuuccaugaaacgguuuagaaaggaggaggaaucugagggcgcuaucugguga

SEQ ID NO: 20687 - RNA, 9876 nt, Artificial Sequence
  derived and/or modified CDS sequence (opt5) from DENV-3__EU687233__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccagaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucacaaaaaaggaggaacccgugaacauugaggccgaaccuccguucggcgaguccaauaucgugauugggaucggcgauaacgcccugaaaaucaauugguauaagaagggaucuagcauuggcaaaauguuugaagcuaccgcccggggggcuagacgcauggccauccuuggagacacggcgugggauuucggcuccguugggggaguccucaacagccugggcaagauggugcaccagauuuuugggucugccuacacagcucuguucuccggcgugagcugggucaugaaaaucggaauuggcgugcuccugaccuggaucgggcuuaauucuaagaacaccagcauguccuuuucuugcauugccaucggaaucauuacacuguaucucggcgcuguugugcaggccgacaccgggugugucaucaauuggaaaggaaaggagcugaagugcggcagcgggauuuucgugacaaacgagguucauacguggaccgaacaguacaaauuucaagcggauucccccaagcggcuggccacagcuaucgccggcgcuugggagaauggaguguguggcauuagaagcaccacacgcauggaaaaccuucucuggaaacagaucgccaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgcugaaacacaaaacuccagcuucauuaucgauggaccuaauacccccgagugcccgucugcguccagagccuggaacgugugggaaguggaggacuauggcuuuggcgucuucacaaccaauaucuggcucaaacugcgcgaaguuuacacgcagcugugugaccaccggcuuaugagcgcugccgugaaggaugagagagccgugcacgcugacaugggguacuggauugagucccagaaaaacggaucuuggaagcucgaaaaagccagccugaucgaggucaagacaugcaccuggccuaagucccauacccuguggucuaauggcgugcucgaaagcgauaugauuauccccaaaucccuggcggggccuauuagccagcacaacuaucgccccggauaccauacacaaaccgcuggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgccggaucuggcaagguggacaacuucaccauggggguccugugccucgccauucuguuugaagaggugaugcggggaaaguucggcaaaaagcauaugaucgcuggcguuuucuuuacauucgugcuucugcucagcgggcagauuaccuggcgcgauauggcccacacacugaucaugauuggauccaaugcgagcgacagaaugggcaugggggucaccuaccuggcucuuaucgccacguuuaaaauccagcccuuccuggcccucggauuuuuccugcggaagcucacaucuagagaaaaccugcuucugggcguggggcucgcuauggccaccacacugcaacugccugaggauauugaacagauggcuaauggaaucgcccuuggccugauggcgcucaaacugauuacccaguuugagaccuaucagcucuggacagcccugaucucccuuacguguagcaacaccauuuucacacugaccguggcuuggcgcacagccacccucauccuggcuggcgucucccugcuuccgguuugccaaucuagcuccaugcggaagucugacuggcugcccaugacgguggccgccaugggggugccuccccucccucuguuuaucuucagccucaaggauacacugaaaagacgcuccuggccccuuaaugagggagucauggcugugggccugguuucuauucuggcgagcucccuccugagaaacgacgugccuauggccgggccccuugucgcuggaggccugcucaucgccuguuacgugauuaccgggaccagcgccgaucugacaguugaaaaggcugccgacgugaccugggaggaagaggcggaacagacaggagucucucauaaccucaugaucacgguggacgaugacggcaccaugcggauuaaagaugacgagacagagaauauccugaccguccuucugaagacagcucugcucaucguguccggcauuuuuccguacagcaucccugccacccugcuuguuuggcacacguggcagaaacagacccgcagaucuggggugcugugggauguccccuccccucccgaaacacaaaaggccgagcucgaagagggaguguaucggauuaaacagcagggcaucuucgggaagacccagguuggagugggcguccaaaaggaggggguguuucauacaauguggcacgugacccgcggagcuguucugacauacaacggcaaaagacucgaaccgaauugggccagcgucaagaaagaccugauuucuuauggcgggggauggcggcuuuccgcgcaguggcagaagggcgaggaagugcaagugaucgcugucgagccugggaaaaaccccaagaauuuccagacgaugccuggaaccuuccagacaaccaccggcgaaauuggggccaucgcccuggauuuuaagcccggaacaagcggcucccccaucauuaaccgcgagggcaaagugguugggcuguacggaaauggcguggucacgaagaacgggggauaugugagcggcaucgcucagaccaaugccgagccugacgggccgacacccgaacucgaggaagagauguucaaaaagagaaaccugaccauuauggaucuucacccuggcucuggaaaaacacggaaguaccugcccgcuaucguucgcgaagccauuaagagacggcucagaacccugauccucgcgccuacgcgcguggucgccgcugagauggaggaagcccugaaaggccuucccauccgguaucaaacaaccgcuaccaagagcgagcauacagggagagaaauuguggaccugaugugccacgccaccuuuacaaugcgccugcucuccccuguucgggugccgaauuacaaccugaucauuauggaugaggcccauuucaccgaccccgcuucuaucgcggccagaggauacauuagcacgcgcgucggcaugggggaagcugccgccaucuuuaugacagcuaccccucccggaacagccgaugcguucccucaguccaaugcucccauccaggacgaggagcgggacauuccggaaagaucuuggaacagcggcaaugaguggaucaccgauuuugccgggaaaacggugugguucgugccuuccauuaaggccggcaacgacaucgcuaacugucuucgcaaaaauggaaagaaggucauucagcugucucggaaaaccuuugauacagaauaucaaaagaccaaacucaacgacugggauuucguugugacaaccgacaucagcgagaugggcgccaauuuuaaggcggauagagugauugacccccggcgcugccugaaacccgucauccugacagaugggccugagagagugauccucgccggacccaugccuguuaccgcugccuccgcugcccagcggcgcggcagaguggggcggaacccgcagaaggaaaaugaccaguacauuuucacgggacaaccccuuaacaaugaugaggaccacgcucauuggacagaagccaagaugcugcuggacaacaucaauaccccugagggcauuauccccgcgcucuucgaaccugagagagagaaaagcgccgcuauugauggggaauaucgccugaagggcgagucucggaaaaccuuugucgaacuuaugagacgcggagaccugcccguguggcucgcccacaagguugcuuccgagggcaucaaauacacagaucggaaguggugcuucgacgggcagagaaacaaucagauccuggaagagaacauggauguggagauuuggaccaaagaaggagagaagaagaaacugcgcccgcgguggcucgacgccagaacauauagcgauccucuugcccugaaggaauuuaaagacuucgcugcgggccgcaagucuaucgcccuggaucucgucacggagauugggagagugcccucccaccuggcucaucggacccgcaaugcccuugacaaccuggucaugcuccacacaagcgaacauggaggcaaagccuacagacacgcuguggaggagcugccugaaaccauggagacacugcuccuucugggccugaugauccuccugaccgggggagccaugcuuuuucugauuuccggcaaggggaucggaaagacgucuaucggccucauuuguguuaucgcgagcuccgggaugcuguggauggccgaaauuccccugcaguggaucgcuagcgccauugugcucgaguucuuuaugauggugcuucugaucccugagcccgaaaaacaacggaccccgcaggauaaucagcuggcuuaugucguuauuggaauccucacacuggccgcgaucauugccgcuaacgagaugggccuucuggaaaccacaaagcgcgaccucggcaugucuaaagagccugggguggugucccccaccagcuaccuggaugucgaccugcaccccgccucugcuuggacgcucuacgccguggcuacaaccguuaucacaccuaugcuuagacauaccauugaaaauagcaccgccaacgugucccuggcggccaucgcuaaccaagccgucgugcugaugggacucgacaagggcuggccgauuucuaaaauggaucugggggucccccuucuggcucucggaugcuauagccaggugaauccucugacacugacggccgccguucuccuucugaucacccacuacgcgaucauuggccccgggcugcaggcuaaggccacacgggaggcucagaagagaaccgccgccggaaucaugaaaaacccuacaguggacggcauuaugaccaucgaucucgaccccgucauuuaugauuccaaguucgagaaacaacugggccaggugaugcuucugguucucugugcugugcagcugcugcucaugcgcacgucuugggcccuuugcgaagcgcugacacuggccaccgggccuaucaccacacucugggagggaagcccgggcaaguuuuggaauaccacaaucgcugucuccauggccaacauuuuccgggggagcuaccuggcuggagccggccuugcguuuucuaucaugaaauccguggggacgggaaagagaggcaccggcagccagggggaaacacugggagagaaguggaaaaagaaacucaaucaacugucccgcaaggaauucgaccuguauaaaaagucuggcauuaccgagguggaucggacagaggccaaagaagggcucaagagaggagagaucacccaucacgcuguuagccggggcuccgccaagcuucagugguuugucgaacgcaacauggugauucccgaggggagagugaucgaccugggauguggccggggcggguggucuuacuauugcgcuggacugaaaaaggucacggaaguucgcggcuacaccaaagggggaccuggccaugaggagcccgugccuaugagcacauacggguggaauauugugaagcucauguccggaaaagaugucuucuaucugcccccggaaaagugugacacccuucugugcgauaucggcgagagcucuccuucccccacaguggaagagagcagaaccauccggguucucaagaugguggagcccuggcugaaaaacaaucaguucuguauuaagguccugaacccuuacaugcccacagugaucgaacaccucgagcgccuucagagaaaacacggcgggaugcugguucggaauccucugucucgcaacuccacccaugaaauguauuggauuagcaauggaacgggcaacaucguggccucugucaauauggugagcagacuccugcuuaaccgguuuacaaugacccacagacgcccgaccauugagaaggacguggaucugggggcuggaacacggcaugucaacgccgaacccgagacgccuaauauggacguuaucggcgagagaaucaaacgcauuaaggaagagcacaacuccaccuggcacuacgacgaugaaaaucccuauaagacaugggcguaccaugggucuuaugaggugaaagccaccggaagcgcuuccagcaugaucaacggcguggucaagcuccugacaaaaccuugggacgugguucccauggugacccaaauggccaugacagauaccacgccguucggccagcagcgggucuuuaaggaaaaaguggacaccagaacaccucgcuccaugcccgggacccggagaguuaugggaauuacagcugaguggcuguggcgcacccucggccggaauaagaagccuagacugugcacgcgcgaggaauucacaaaaaaggugcggaccaacgccgccaugggggcggucuuuacagaggaaaaucaaugggauucugcuaaagccgccguggaggacgaagauuucuggaagcuuguugacagagagcgcgagcugcacaaacucggaaaguguggcagcugcguguacaacaugauggggaaaagagaaaagaagcugggcgaguuuggaaaagcuaagggcucccgggccaucugguacauguggcuuggggcucgcuaucuggaauucgaggcccucggauuucugaaugaggaucauugguucucuagagaaaacagcuacuccggcgucgagggggaaggacugcacaaacucggcuauauucugcgggacaucucuaagauccccgggggcgcgauguacgccgaugacaccgcuggaugggacacgagaauuaccgaggaugaccuucauaaugaagagaaaaucacacagcagauggauccugagcaccggcagcuggccaacgcuauuuuuaagcucaccuaucaaaauaagguggucaaagugcagcgccccacaccgaccggcacaguuauggacaucauuagcagaaaggaucagcggggguccggacaggugggcaccuacgggcugaacacgugccacagcaauauggaagcccaacuuauccgccagauggagggagaaggcguccugucuaaagcggaccucgagaacccucaucuguccgaaaagaaaaucacacaguggcuggagaccaaggggguggagagacucaagcggauggccauuagcggcgaugacugugugguuaaacccaucgaugaccgcuucgcuaacgcccugcuugcucugaaugauaugggaaaggugagaaaagacauuccccaguggcaaccuucuaagggcuggcacgauuggcagcaggucccguuuugcucccaucacuuccacgaacucaucaugaaagacgggcggaagcuggugguucccugucgcccucaggacgagcuuauuggaagagcccggaucagccaaggcgcuggguggucucugcgcgaaaccgccugccucggaaaggcguaugcccagauguggucccugauguacuuccauagacgggaucugcgccucgcuagcaacgccauuuguuccgccgugcccguccacugggugccuacaagcagaaccacauggucuauccaugcucaccaucaguggaugacgaccgaggacaugcugacagucuggaaucggguguggaucgaagauaaccccuggauggaggacaaaaccccuguuacaaccugggagaaugugcccuaccuuggcaagagagaagaucaauggugcgggagccugauuggccucacgucccgcgccaccugggcgcagaacaucccgacagcuauucagcagguccggucucugaucggaaaugaggaauuucuugacuauaugccuagcaugaaaagauuccgcaaggaggaggaauccgagggcgccauuugguga

SEQ ID NO: 20688 - RNA, 9873 nt, Artificial Sequence
  derived and/or modified CDS sequence (opt5) from DENV-3__EU687234__SS-prME
accagccugugccucaugaugauccugcccgccgcucuugccuuccaccugacgucccgggacggagaaccucggaugauuguggggaagaacgaacgcggaaagucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaagugccuuucagcaccgaggacggccaagggaaggcccauuccggaagacugauuacagcgaaccccgucgugaccaaaaaggaggaacccgugaauaucgaggcugaaccuccguucggcgagucuaacauuguuaucgggauuggcgauaaugcccugaaaaucaacugguauaagaagggaagcuccaucggcaaaauguuugaagccacggcuagaggggccagacgcauggcuauucuuggagacacagccugggauuucggcagcgucgggggagugcucaauucucugggcaagauggugcaccagaucuuuggguccgcguacaccgcccuguucagcggcgucucuugggugaugaaaauuggaaucggcguucuccugaccuggauugggcuuaacagcaagaauacauccaugucuuuuagcugcaucgugauuggaaucaucacccuguaucucggcgcugucgugcaggccgacaugggguguguuauuaacuggaaaggaaaggagcugaagugcggcuccgggaucuucgugacaaaugagguccauacguggaccgaacaguacaaauuucaagcugauagccccaagcggcuggccacagcgauugccggcgcuugggagaacggaguguguggcaucagaucuaccacacgcauggaaaaucuucucuggaaacagauugccaacgagcugaauuauauccugugggaaaacaauaucaagcucaccguuguggucggggacauuaucggagugcuggagcagggcaaacggacgcuuaccccucagcccauggagcugaaguacuccuggaaaacaugggggaaggcuaagauugugaccgccgaaacacaaaacagcucuuucaucauugauggaccuaacacccccgagugcccguccgccagcagagcuuggaaugucugggaaguugaggacuauggcuuuggcguguucacaaccaacaucuggcucaaacugcgcgaaguguacacgcagcugugugaccaccggcuuauguccgcggccgucaaggaugagagagcugugcacgccgacaugggguacuggaucgagucucagaaaaauggaagcuggaagcucgaaaaagccucccugauugagguuaagacaugcaccuggccuaagucucauacccuguggagcaacggcgugcucgaauccgauaugaucauucccaaaagccuggcugggccuaucucucagcacaauuaucgccccggauaccauacacaaaccgccggcccuuggcaccuugggaagcuggagcucgacuuuaacuauugcgagggaacgacagucgugauuaccgaaaauuguggcacacggggccccucccugagaaccacaaccguuagcgggaaacugauccacgaguggugcugucgcucuugcacgcuuccgccucuccgguacaugggagaagauggcuguugguaugggauggagaucagacccauuuccgaaaaggaggagaacauggugaaaagccuggucucugcgggaagcggcaagguggacaauuucaccauggggguucugugccucgcuauccuguuugaagaggugaugcggggaaaguucggcaaaaagcauaugauugccggcgucuucuuuacauucgugcuucugcucuccgggcagaucaccuggcgcgauauggcccacacacugauuaugaucggaagcaacgcuucugacagaaugggcaugggggugaccuaccuggcccuuauugcgacguuuaaaauccagcccuuccuggcucucggauuuuuccugcggaagcucacauccagagaaaaucugcuucugggcgucgggcucgccauggccaccacacugcaacugccugaggauaucgaacagauggcuaacggaauugcccuuggccugauggcucucaaacugaucacccaguuugagaccuaucagcucuggacagcccugauuagccuuacguguuccaauaccaucuucacacugaccguugcguggcgcacagccacccucauucuggcuggcgugucucugcuuccggugugccaaagcuccucuaugcggaagacggacuggcugcccaugacagucgccgcuaugggggugccuccccucccucuguuuaucuucagccucaaggauacccugaaaagacgcuccuggccccuuaacgagggaguuauggccgugggccuggucucuauccuggccagcucccuccugagaaaugacgugccuauggcugggccccuuguugcgggaggccugcucauugccuguuacgugaucaccgggacaagcgcugaucugaccgucgaaaaggccgccgacgugacaugggaggaagaggcugaacagacgggagucucucauaaccucaugauuaccguggacgaugacggcacaaugcggaucaaagaugacgagaccgagaacauucugacaguucuucugaagaccgcccugcucaucguguccggcaucuuuccguacagcauuccugcgacgcugcuugucuggcacaccuggcagaaacagacacaacgcucuggggugcugugggauguucccuccccucccgaaacccagaaggcugagcucgaagagggaguguauagaaucaaacagcagggcauuuucgggaagacacaagucggagugggcgugcagaaggaggggguuuuucauaccauguggcacgucacacggggagccgugcugacguacaauggcaaacgccucgaaccgaacugggccagcgugaagaaagaccugaucucuuauggcgggggauggagacuuuccgcucaguggcaaaagggcgaggaaguccaggugauugccguugagccugggaaaaaucccaagaacuuccagaccaugccuggaacauuccagaccaccacaggcgaaaucggggcgauugcucuggauuuuaagcccggaacgagcggcucccccaucaucaaucgggagggcaaaguggucgggcuguacggaaacggcgugguuaccaagaaugggggauaugugagcggcauugcccaaacaaacgccgagccugacgggccgacccccgaacucgaggaagagauguucaaaaagcgcaaucugacaaucauggaucuucacccuggcucuggaaaaaccagaaaguaccugcccgcuauuguccgggaagccaucaagcgcagacuccggacgcugauucucgcuccuacaagagugguugccgcggagauggaggaagcccugaaaggccuucccauccgcuaucagaccaccgcuacaaagagcgagcauaccgggcgggaaaucguggaccugaugugccacgccacauuuaccaugagacugcucuccccuguccgcgugccgaacuacaaucugauuaucauggaugaggcucauuucacggaccccgccucuauugccgcucggggauacaucagcacaagagugggcaugggggaagcggccgcuauuuuuaugaccgccacaccucccggaaccgccgaugcuuucccucaguccaacgcccccauccaggacgaggagcgcgacaucccggaacggucuuggaauagcggcaacgaguggauuacggauuuugcggggaaaaccgucugguucguuccuuccaucaaggcuggcaaugacauugccaacugucuucgcaaaaacggaaagaaggugauccaacugucuagaaaaacauuugauaccgaauaucagaagacaaaacucaaugacugggauuucguggucaccacagacauuagcgagaugggcgccaacuuuaaggcugaucgggugaucgaccccagacggugccugaaacccguuauucugaccgaugggccugagcgcgugauccucgccggacccaugccugucacggcggccuccgcugcccagagacggggccgcguggggagaaauccgcagaaggaaaacgaccaauacaucuucacaggacagccccuuaauaacgaugaggaccacgcucauuggaccgaagccaagaugcugcuggacaauauuaacaccccugagggcaucauucccgcucucuucgaaccugagcgggagaaaagcgccgcgaucgauggggaauauagacugaagggcgagucucgcaaaacauuuguugaacuuaugcggagaggagaccugcccguguggcucgcccacaaggucgcuuccgagggcauuaaauacaccgaucgcaaguggugcuucgacgggcagcggaauaaccagauccuggaagagaauauggauguggagaucuggacaaaagaaggagagaagaagaaacugagaccgcgcuggcucgacgcccggacguauagcgauccucuugcucugaaggaauuuaaagacuucgccgccggcagaaagucuauugcucuggaucucgucaccgagaucgggcgcgugcccucccaccuggcgcauagaacacggaacgcccuugacaaucugguuaugcuccacaccagcgaacauggaggccgcgcuuacagacacgccguggaggagcugccugaaacaauggagacccugcuccuucugggccugaugauucuccugacagggggagccaugcuuuuucugaucuccggcaaagggauuggaaagaccucuaucggccucaucugugugauugcuagcuccgggaugcuguggauggccgaaaucccccugcaauggauugcgagcgccaucguccucgaguucuuuaugaugguucuucugauuccugagcccgaaaagcagcggacaccgcaggauaaccaacuggcuuauguggugaucggcauucucacccuggccgcuaucaucgccgcgaaugagaugggccuucuggaaacaaccaaacgcgaccucggcaugucuaaggagccuggggucgugucccccacgagcuaccuggauguugaccugcaccccgccucugcuuggacacucuacgccguggcuaccacagucauuaccccuaugcuuagacauaccaucgaaaacagcacagccaaugugucccuggcugccauugcgaaccaggccgucgugcugaugggacucgacaaaggcuggccgaucucuaagauggaucuggggguuccccuucuggcucucggaugcuauagccaggugaacccucugacgcugaccgccgcuguccuccuucugauuacacacuacgccaucaucggccccgggcugcaggccaaagcgacccgggaggcucaaaagagaacagccgcuggaauuaugaagaauccuaccguggacggcaucaugacgauugaucucgaccccguuaucuaugauuccaaauucgagaagcagcugggccaggugaugcuucugguccucugugccgugcagcugcugcucaugcgcacaucuugggcccuuugcgaagcucugacccuggccaccgggccuauuacaacccucugggagggaagcccgggcaaauuuuggaacacaacgaucgcgguguccauggccaauaucuuccgggggagcuaccuggcuggagccggccuugcuuuuucuauuaugaaguccguugggaccggaaaaagaggcacaggcagccaaggggaaacccugggagagaaguggaagaaaaagcucaaccagcugucccgcaaagaguucgaccuguauaagaaaucuggcaucacagaggucgaucggaccgaggccaaggaagggcucaaaagaggagagauuacgcaucacgcggugagccggggcuccgccaaacuucagugguuuguggaacgcaauauggucauccccgaggggagaguuauugaccugggauguggccggggcggguggucuuacuauugcgcuggacugaagaaagugaccgaagugcgcggcuacacaaaagggggaccuggccaugaggagcccgucccuaugagcaccuacggguggaacaucgugaaacucauguccggaaaggauguuuucuaucugcccccggaaaaaugugacacacuucugugcgauauuggcgagagcucuccuucccccaccguggaagagagcagaacaauccggguccucaagaugguggagcccuggcugaagaauaaccaguucuguaucaaaguucugaauccuuacaugcccaccgugauugaacaccucgagcgccuucaaagaaagcacggcgggaugcugguccggaacccucugucucgcaauuccacgcaugaaauguauuggaucagcaacggaacaggcaauauuguggccucugugaacauggucagcagacuccugcuuaaucgguuuaccaugacccacagacgcccgacaaucgagaaagacguugaucugggggcuggaacgcggcaugugaacgccgaacccgagaccccuaacauggacgugauuggcgagagaaucaagcgcaucaaagaagaacacaauuccacauggcacuacgacgaugaaaaccccuauaagaccugggcuuaccaugggucuuaugaggucaaggccacaggaagcgcguccagcaugauuaauggcgugguuaaacuccugaccaagccuugggacgugguccccauggugacacagauggccaugaccgauacgaccccguucggccagcaacggguuuuuaaagaaaagguggacacaagaaccccucgcuccaugcccgggacacggagagucaugggaaucaccgcugaguggcuguggcgcacgcucggccggaacaaaaagccuagacugugcacacgcgaggaguucaccaagaaagugcggacaaaugccgcuaugggggccguuuuuaccgaggaaaaccagugggauucugccaaggcggcuguggaggacgaagauuucuggauucuugucgacagagagcgcgagcugcacaaacucggaaaguguggcagcugcguguacaauaugauggggaaaagagaaaagaaacugggcgaguuuggaaaggccaagggcucccgggccaucugguacauguggcuuggggcucgcuaucuggaguucgaggcccucggauuucugaacgaggaucauugguucucuagagaaaauagcuacuccggcgucgagggggaaggacugcacaaacucggcuauauucugcgggacaucucuaagauccccgggggcgcuauguacgccgaugacacggcgggaugggacaccagaauuacagaggaugaccuucauaacgaagagaaaaucacccagcagauggauccugagcaccggcaacuggccagcgcuauuuuuaagcucacauaucagaauaaagugguuaaggugcagcgccccaccccgacaggcaccgucauggacaucauuuccagaaaggaucagcgggggagcggacaagugggcacguacgggcugaacacauucaccaauauggaagcccagcuuauccgccagauggagggagaaggcgugcugucuaaagcugaccucgagaacccucaucugcccgaaaagaaaaucacccaguggcuggagacaaaggggguugagagacucaaacggauggccauuuccggcgaugacugcguggucaagcccaucgaugaccgcuuugcgaaugcccugcuugcucugaacgauaugggaaaggugagaaaagacauuccucaauggcagccgagcaagggcuggcaugauuggcagcagguucccuucuguucucaccauuuccacgaacucaucaugaaagacgggcggaagcugguggucccuugccgcccccaagacgagcuuauuggacgggcccggaucucccagggcgcuggguggagccugcgcgaaaccgccugucucggaaaggcuuaugcccagauguggucucugauguacuuucacagacgggaucugcgccucgcguccaacgccauuugcagcgcugugccuguccauugggugcccacauccagaacgaccuggagcauccacgcccaucaccaauggaugacaaccgaggacaugcugacaguuuggaaucggguguggaucgaagauaacccuuggauggaggacaagacccccgucacgaccugggagaaugugccguaccuuggcaagagagaagaucaguggugugggucucugauuggccucacaagccgcgccaccugggcucagaacaucccuacagccauucagcaaguucggucccugaucggaaaugaggaguuccuugacuauaugcccucuaugaaaagauuucgcaaggaggaggaaagcgagggcgcgauuugguga

SEQ ID NO: 20689 - RNA, 9873 nt, Artificial Sequence
  derived and/or modified CDS sequence (opt5) from DENV-3__EU687196__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggagaugugcgacgauacagucaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcaagguggacaacuucacaauggggguccugugccucgccauccuguuugaagaggugaugcggggaaaguucggcaaaaagcauaugauugccggcguuaucuucaccuuugugcuucugcucagcgggcagauuacauggcgcgaugucgcucacacccugaucaugauuggauccaaugccagcgacagaaugggcaugggggugacguaccuggcgcuuaucgcuacauucaaaauccagcccuuucuggcccucggauucuuucugcggaagcucaccucuagagaaaaccugcuucugggcguggggcucgccauggcuacaacccugcaacugccugaggauauugaacagauggccaauggaaucgcucuuggccugauggcccucaaacugaccacacaguucgagacguaucagcucuggaccgcgcugauuucccuuacauguagcaacaccaucuuuacacugaccgucgccuggcgcacggcuacacucauucuggccggcguuucccugcuuccggugugccaaucuagcuccaugcggaagaccgacuggcugcccaugaccguggcugccaugggggucccuccccucccucuguucaucuuuucucucaaggauacacugaaaagacgcagcuggccccuuaaugagggagugauggccguuggccugguguccauccuggcuucuagccuccugagaaacgacgucccuauggcggggccccuuguggccggaggccugcucauugcuuguuacguuaucaccgggacauccgccgaucugacgguggaaaaggccgcugacgucaccugggaggaagaggccgaacagacaggagugagccauaaccucaugauuaccgucgacgaugacggcacaaugcggaucaaagaugacgagaccgagaauauucugacggugcuucugaagaccgcgcugcucaucguuucuggcaucuucccguacuccauuccugcuacacugcuuguguggcacaccuggcagaaacagacacaacgcagcgggguccugugggaugugcccucuccucccgaaacccagaaggccgagcucgaagagggaguuuauagaaucaaacagcagggcauuuuugggaagacacaagugggagucggcgugcagaaggaggggguguuccauacgauguggcacguuacccggggagccguccugacauacaacggcaaacgccucgaaccgaauugggcuuccgugaagaaagaccugaucagcuauggcgggggauggagacuuucugcccaguggcaaaagggcgaggaagugcaggucauugcgguggagccugggaaaaaccccaagaauuuucagaccaugccuggaaucuuccagaccacaacgggcgaaauuggggcuaucgcccuggauuucaagcccggaaccuccggcagccccaucauuaaccgggagggcaaaguuguggggcuguacggaaauggcgucgugacaaagaacgggggauauguuuccggcaucgcccaaaccaaugcugagccugacgggccgacacccgaacucgaggaagagauguuuaaaaagcgcaaccugaccauuauggaucuucacccuggcagcggaaaaacgagaaaguaccugcccgccaucgugcgggaagcuauuaagcgcagacuccggacacugauccucgccccuaccagagucguggcggccgagauggaggaagcucugaaaggccuucccauccgcuaucagaccacagccaccaagucugagcauacagggcgggaaauuguugaccugaugugccacgcuaccuucacgaugagacugcucagcccugugcgcgucccgaauuacaaccugaucauuauggaugaggcccauuuuacagaccccgccuccaucgcugcgcggggauacauuucuaccagagugggcaugggggaagccgcugccaucuucaugacagccaccccucccggaacggcugaugccuuuccucagagcaaugcgcccauccaggacgaggagcgcgacauuccggaacgguccuggaacucuggcaaugaguggaucaccgauuucgcugggaaaacagugugguuugucccuagcauuaaggccggcaacgacaucgccaacugucuucgcaaaaauggaaagaagguuauucaacuguccagaaaaaccuucgauacagaauaucagaagaccaaacucaacgacugggauuuuguggugacaaccgacaucucugagaugggcgcuaauuucaaggccgaucgggucauugaccccagacggugccugaaacccgugauccugacggaugggccugagcgcguuauccucgcgggacccaugccugugacagccgcuagcgccgcucagagacggggccgcgucgggagaaacccgcagaaggaaaaugaccaauacauuuuuaccggacagccccuuaacaaugaugaggaccacgcccauuggaccgaagcuaagaugcugcuggacaacaucaauacaccugagggcauuauccccgcccucuucgaaccugagcgggagaaauccgcggccauugauggggaauauagacugaagggcgagagccgcaaaaccuucguggaacuuaugcggagaggagaccugcccguuuggcucgcucacaagguggccucugagggcaucaaauacacagaucgcaaguggugcuuugacgggcagcggaacaaucagauccuggaagagaacauggaugucgagauuuggacgaaagaaggagagaagaagaaacugagaccgcgcuggcucgacgcucggaccuauuccgauccucuugcccugaaggaguucaaagacuuugccgcuggcagaaagagcaucgcgcuggaucucgugacagagauugggcgcguccccucucaccuggcccauagaacccggaaugcucuugacaaccuggugaugcuccacauguccgaacauggaggcaaagccuaccgccacgccguugaggagcugccugaaacaauggagacccugcuccuucugggccugaugauccuccugacagggggagcuaugcuuuuccugauuagcggcaaggggaucggaaagaccuccaucggccucauuugugugaucgccucuagcgggaugcuguggauggcggaaauuccccugcaauggaucgccuccgcuauugugcucgaguuuuucaugaugguccuucugaucccugagcccgaaaaacagagaacaccgcaggauaaucaacuggccuauguugugauuggaauccucacccuggcugccaucauugcggccaacgagaugggccuucuggaaacaaccaagcgggaccucggcaugagcaaagagccugggguggucucucccacguccuaccuggauguggaccugcaccccgcuagcgccuggacacucuacgcuguugccaccacagugaucaccccuaugcuucgccauaccauugaaaauucuacagcuaacgucagccuggccgcgaucgccaaccaggcugugguccugaugggacucgacaagggcuggccgauuuccaaaauggaucugggggugccccuucuggcccucggaugcuauucucagguuaauccucugacgcugaccgcugccgugcuccuucugaucacacacuacgccaucauuggccccgggcugcaggcgaaggcuaccagagaggcccaaaagcggacagcugccggaaucaugaaaaacccuaccgucgacggcauuaugacgaucgaucucgaccccgugauuuaugauagcaaguuugagaaacagcugggccagguuaugcuucuggugcucugugccguccagcugcugcucaugagaacauccugggcucuuugcgaagcccugacccuggcgaccgggccuaucacaacccucugggagggaucuccgggcaaguucuggaauacaacgaucgccgugagcauggcuaacauuuuucgcggguccuaccuggccggagcuggccuugccuucagcaucaugaaaucuguggggaccggaaagcggggcacaggcucccaaggggaaacccugggagagaaguggaaaaagaaacucaaucagcugagcagaaaggaauuugaccuguauaaaaaguccggcauuacagagguugaucgcaccgaggcgaaagaagggcucaagcggggagagaucacgcaucacgccgucucuagaggcagcgcuaaacuucagugguucguggaacggaacauggugauucccgaggggcgcgucaucgaccugggauguggcagaggcgggugguccuacuauugcgccggacugaaaaagguuaccgaagugcggggcuacacaaaagggggaccuggccaugaggagcccgugccuaugucuaccuacggguggaauauugucaagcucaugagcggaaaagauguguuuuaucugcccccggaaaagugugacacacuucugugcgauaucggcgaguccagcccuucucccaccguugaagagucccgcacagugagaguccucaagaugguggagcccuggcugaaaaacaaucaguucuguaucaagguucugaacccuuacaugcccaccgugauugaacaccucgagcggcuucaacgcaaacacggcgggaugcuggucagaaauccucugagccggaacucuacgcaugaaauguauuggaucuccaauggaacaggcaacauuguggcuagcgugaauauggucucucgccuccugcuuaacagauucaccaugacccaccggagaccgacaaucgagaaggacguugaucugggggccggaacgcgccaugugaacgcugaacccgagaccccuaauauggacgugauuggcgagcggaucaaaagaaucaaggaagaacacauuagcacauggcacuacgacgaugaaaaccccuauaagaccugggccuaccauggguccuaugaggucaaagcgacaggaucugccagcuccaugaucaauggcgugguuaagcuccugaccaaaccuugggacgugguccccauggugacacagauggcuaugaccgauacgaccccguuuggccagcaacgcguuuucaaggaaaaaguggacacacggaccccuagaagcaugcccgggacacgccgggucaugggaauuaccgccgaguggcuguggagaacgcucggccgcaacaagaagccucggcugugcacaagagaggaauuuaccaaaaaggugcgcacaaaugcugccaugggggccguuuucaccgaggaaaaccagugggauuccgcgaaagcugccguggaggacgaagauuuuuggaaacuugucgaccgggagagagagcugcacaaacucggaaaguguggcucuugcguguacaauaugauggggaaacgcgaaaagaagcugggcgaguucggaaaagccaagggcagcagagcuaucugguacauguggcuuggggcccgguaucuggaauuugaggcucucggauuccugaacgaggaucauugguuuucccgcgaaaauucuuacagcggcgucgagggggaaggacugcacaaacucggcuauauucugagagacaucuccaagauccccgggggcgccauguacgcggaugacacggccggaugggacacccggauuacagaggaugaccuucauaacgaagagaaaaucacccagcagauggauccugagcacagacaacuggcuaaugccauuuucaagcucacauaucagaacaaggugguuaaagugcagcggcccaccccgacaggcaccgucauggacaucauuucucgcaaggaucagagagggagcggacaagugggcacguacgggcugaauacauuuaccaacauggaagcucagcuuauccggcagauggagggagaaggcgugcuguccaaagccgaccucgagaauccucaucugcccgaaaagaaaaucacccaguggcuggagacaaaggggguugagcgccucaagagaauggcgauuagcggcgaugacugcguggucaaacccaucgaugaccgguucgccaacgcucugcuugcccugaacgauaugggaaaggugcgcaaagacauuccucaauggcagccgucuaagggcuggcaugauuggcagcagguucccuuuuguucccaccauuuccacgaacucaucaugaaagacgggagaaagcugguggucccuugccggccccaagacgagcuuauuggacgcgcuagaaucagccagggcgccggguggucuuuccgggaaaccgcuugucugggaaaggccuaugcgcagauguggucccucauguacuuucaccgcagagaucugcggcuggccagcaaugcuauuugcucugccgugccuguccauugggugcccacaucccgcacgaccuggagcauccacgcccaucaccaauggaugacaaccgaggacaugcucacaguuuggaacagaguguggaucgaagauaauccuuggauggaggacaaaacccccgucacgaccugggagaacgugccguaccugggcaagcgggaagaucaguggugugggucccuuauuggccugacaagcagagcuaccugggcccagaauaucccuacagcgauucagcaaguucgcucucucaucggaaacgaggaguuccuggacuauaugcccagcaugaaacgguuuagaaaggaggaggaauccgagggcgcuauuugguga

SEQ ID NO: 20690 - RNA, 9873 nt, Artificial Sequence
  derived and/or modified CDS sequence (opt5) from DENV-3__EU854298__SS-prME
accagccugugccucaugaugauccugcccgccgcucuugccuuccaccugacaucccgggacggcgaaccucggaugauuguggggaagaaugaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcgagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgaacgcuucuagagcguggaaugugugggaaguggaggacuauggcuuuggcgucuucacaaccaacaucuggcucaaacugcgcgaaguucacacgcagcugugugaccaccggcuuauguccgccgcugugaaggaugagagagccgugcaugccgacaugggguacuggauugagagccagaaaaauggauccuggaagcucgaaaaggcuucucugaucgaggucaagacaugcaccuggccuaagagccacacccugugguccaacggcgugcucgaaucugauaugauuauccccaaaagccuggccgggccuauuucccagcauaauuaccgccccggauaucacacacaaaccgcgggcccuuggcaccuugggaagcuggagcucgacuuuaacuacugcgagggaacgacaguugugaucaccgaaaauuguggcacacggggccccagccugagaaccacaaccgucucugggaaacugauccaugaguggugcugucgcuccugcacgcuuccgccucuccgguauaugggagaagauggcuguugguacgggauggagauuagacccaucagcgaaaaggaggagaacauggugaaaucucugguuuccgcuggaagcggcaagguggacaauuucaccauggggguccugugccucgccauucuguuugaagaggugaugcggggaaaguucggcaaaaagcacaugaucgccggcguuuucuuuacauucgugcuucugcucucugggcagauuaccuggcgcgauauggcucauacacugaucaugauuggaagcaacgccuccgacagaaugggcaugggggucaccuaucuggcgcuuaucgcuacguuuaaaauccagcccuuccuggcccucggauuuuuccugcggaagcucacaagcagagaaaaucugcuucugggcguggggcucgccauggcuaccacacugcaacugccugaggauauugaacagauggccaacggaaucgcucuuggccugauggcccucaaacugauuacccaguuugagaccuaccagcucuggacagcgcugaucucucuuacguguuccaauaccauuuucacacugaccguggccuggcgcacagcuacccucauccuggccggcgucagccugcuuccgguuugccaauccucuagcaugcggaagacggacuggcugcccaugacaguggcugccaugggggugccuccccucccucuguuuaucuucucccucaaggauacccugaaaagacgcucuuggccccuuaacgagggagucauggccgugggccugguuagcauucuggcuuccucucuccugagaaacgacgugccuauggcggggccccuugucgccggaggccugcucaucgcuuguuaugugauuaccgggacaagcgccgaucugaccguugaaaaggccgcugacgugacaugggaggaagaggccgaacagacgggagucucccacaaucucaugaucaccguggacgaugacggcacaaugcggauuaaagaugacgagaccgagaacauccugacaguccuucugaagaccgcgcugcucaucgugagcggcauuuuuccguacucuaucccugcuacgcugcuuguuuggcauaccuggcagaaacagacacaacgcuccggggugcugugggauguccccagcccucccgaaacccagaaggccgagcucgaagagggaguguacagaauuaaacagcagggcaucuucgggaagacacaaguuggagugggcguccagaaggaggggguguuucacaccauguggcacgugacacggggagccguucuggcuuauaauggcaaacgccucgaaccgaacugggccucugucaagaaagaccugauuuccuacggcgggggauggagacuuagcgcgcaguggcaaaagggcgaggaaguccaggugaucgcugucgagccugggaaaaaucccaagaacuuccagacgauuccuggaaccuuccagacaaccaccggcgaaaucggggccaucgcccuggauuuuaagcccggaacaucuggcucccccauuaucaaucgggagggcaaagugguugggcuguauggaaacggcguggucacgaagaaugggggauacgugagcggcauugcucaaaccaacgccgagccugacgggccgacacccgaacucgaggaagagauguucaaaaagcgcaaucugaccaucauggaucuucauccuggcuccggaaaaacaagaaaguaucugcccgcuauuguucgggaagccaucaagcgcagacuccggacccugauccucgcgccuacgagaguggucgccgcugagauggaggaagcccugaaaggccuucccauucgcuaccagacaaccgcuaccaagagcgagcacacagggcgggaaaucguggaccugaugugccaugccaccuuuacaaugagacugcucucuccuguucgcgugccgaacuauaaucugauuaucauggaugaggcccacuucaccgaccccgcuagcauugcggcccggggauacaucuccacgagagucggcaugggggaagcugccgccaucuuuaugacagcuaccccucccggaacagccgaugcguucccucagucuaacgcucccauucaggacgaggagcgcgacaucccggaacggagcuggaacuccggcaacgaguggauuaccgauuuugccgggaaaacggugugguucgugccuucuaucaaggccggcaacgacauugcuaauugucuucgcaaaaacggaaagaaggucauccaacugagcagaaaaaccuuugauacagaauaccagaagaccaaacucaaugacugggauuucguugugacaaccgacauuuccgagaugggcgccaacuuuaaggcggaucgggugaucgaccccagacggugccugaaacccgucauccugacagaugggccugagcgcgugauucucgccggacccaugccuguuaccgcugccucugcugcccagagacggggccgcguggggagaaauccgcagaaggaaaacgaccaauauaucuucacgggacagccccuuaauaacgaugaggaccaugcucacuggacagaagccaagaugcugcuggacaauauuaacaccccugagggcaucauucccgcccucuucgaaccugagcgggagaaaagcgccgcuaucgauggggaauacagacugaagggcgagucccgcaaaaccuuugucgaacuuaugcggagaggagaccugcccguguggcucgcccacaagguugcuagcgagggcaucaaauauacagaucgcaaguggugcuucgacgggcagcggaauaaccagauucuggaagagaauauggauguggagaucuggaccaaagaaggagagagaaagaagcugcgcccgcgguggcucgacgccagaacauacucugauccucuugcccugaaagaauuuaaggacuucgcugcgggccgcaaauccauugcccuggaucucgucacggagaucgggagagugcccagccaucuggcucaccggacccgcaacgcccuugacaaucuggucaugcuccauacaucugaacacggaggcaaggccuauagacacgcuguggaggagcugccugaaaccauggagacacugcuccuucugggccugaugauucuccugaccgggggagccaugcuuuuucugaucuccggcaaagggaucggaaagacgagcauuggccucaucuguguuauugcguccucugggaugcuguggauggccgaaaucccccugcaauggauugcuagcgccaucgugcucgaguucuuuaugauggugcuucugauuccugagcccgaaaagcagcggaccccgcaggauaaccaacuggcuuacgucguuaucggaauccucacacuggccgcgauuaucgccgcuaaugagaugggccuucuggaaaccacaaaacgcgaccucggcauguccaaggagccugggguggugagccccaccucuuaucuggaugucgaccugcaucccgccuccgcuuggacgcucuacgccguggcuacaaccguuauuacaccuaugcuuagacacaccaucgaaaacagcaccgccaacgugucucuggcggccauugcuaaucaggccgucgugcugaugggacucgacaaaggcuggccgaucagcaagauggaucugggggucccccuucuggcucucggaugcuacucccaggugaacccucugacacugacggccgccguucuccuucugaucacccauuaugcgauuaucggccccgggcugcaggcuaaagccacacgggaggcucaaaagagaaccgccgccggaauuaugaagaauccuacaguggacggcaucaugaccauugaucucgaccccgucaucuacgauucuaaauucgagaagcagcugggccaggugaugcuucugguucucugugcugugcagcugcugcucaugcgcacgagcugggcccuuugcgaagcgcugacacuggccaccgggccuaucaccacacucugggagggauccccgggcaaauuuuggaacaccacaauugcugucucuauggccaauaucuuccgggggagcuaucuggcuggagccggccuugcguuuuccauuaugaaaagcguggggacgggaaaaagaggcaccggcucucaaggggaaacacugggagagaaguggaagaaaaagcucaaccagcugucccgcaaagaguucgaccuguacaagaaaagcggcaucaccgagguggaucggacagaggccaaggaagggcucaaaagaggagagauuacccaccaugcuguuucccggggcucugccaaacuucagugguuugucgaacgcaauauggugauccccgaggggagagugauugaccugggauguggccggggcggguggagcuauuacugcgcuggacugaagaaagucacggaaguucgcggcuauaccaaagggggaccuggccacgaggagcccgugccuauguccacauacggguggaacaucgugaaacucaugucuggaaaggaugucuucuaccugcccccggaaaaaugugacacccuucugugcgauaucggcgagagcuccccuagccccacaguggaagagucuagaaccauucggguucucaagaugguggagcccuggcugaagaauaaccaguucuguaucaaaguccugaauccuuauaugcccacagugauugaacaccucgagcgccuucaaagaaagcauggcgggaugcugguucggaacccucugucccgcaauagcacccacgaaauguacuggaucucuaacggaacgggcaauauuguggccuccgucaacauggugagcagacuccugcuuaaccgguuuacaaugacccauagacgcccgaccaucgagaaagacguggaucugggggcuggaacacggcacgucaaugccgaacccgagacgccuaacauggacguuaucggcgagagaauuaagcgcaucaaagaagaacacaauucuaccuggcauuaugacgaugaaaaccccuacaagacaugggcguaucacgggagcuacgaggugaaggccaccggauccgcuucuagcaugauuaauggcguggucaaacuccugacaaagccuugggacgugguucccauggugacccagauggccaugacagauaccacgccguucggccagcaacgggucuuuaaagaaaagguggacaccagaacaccucgcuccaugcccgggacccggagaguuaugggaaucacagcugaguggcuguggcgcacccucggccggaacaaaaagccuagacugugcacgcgcgaggaguucacaaagaaagugcggaccaaugccgccaugggggcggucuuuacagaggaaaaccagugggauagcgcuaaggccgccguggaggacgaagauuucuggaaacuuguugacagagagcgcgagcugcauaagcucggaaaauguggcuccugcguguauaauaugauggggaagagagagaagaagcugggcgaguuuggaaaggcuaaaggcucucgggccauuugguacauguggcuuggggcucgcuaccuggaguucgaggcccucggauuucugaacgaggaucacugguucagcagagaaaauuccuauucuggcgucgagggggaaggacugcauaagcucggcuacauccugcgggacaucagcaaaauucccgggggcgcgauguaugccgaugacaccgcuggaugggacacgagaaucaccgaggaugaccuucacaacgaagagaagauuacacagcagauggauccugagcaccggcaacuggccaaugcuaucuuuaaacucaccuaccagaacaagguggucaaggugcagcgccccacaccgaccggcacaguuauggacauuaucuccagaaaagaucagcgggggucuggacaagugggcaccuaugggcugaauacguucacaaacauggaaguccagcuuauccgccagauggagggagaaggcgugcugagcaaggccgaccucgagaacccucaucugcccgagaagaagauuacccaguggcuggagaccaaagggguggagagacucaagcggauggcgaucuccggcgaugacugcguugugaagcccauugaugaccgcuuugccaaugcucugcuugcccugaacgauaugggaaaagucagaaaggacaucccucaauggcagccgagcaaaggcuggcacgauuggcaacaggugcccuucuguucucaucacuuccacgaacucauuaugaaggacgggcggaaacugguugugccuugccgcccccaagacgagcuuaucggacgggcucggauuucccagggcgccggguggagccugcgcgaaacagcuugucucggaaaggccuacgcgcagauguggucucugauguauuuucauagacgggaucugcgccucgccuccaaugcuaucugcagcgccgucccugugcacuggguccccaccucuagaacaacgugguccauccaugcccaccaucaauggaugaccacagaggacaugcugaccguguggaaccggguuuggauugaagauaauccuuggauggaggacaagacacccgugaccacgugggagaacgucccguaccuuggcaaaagagaagaucaguggugugggagccugaucggccucaccucccgcgcuacaugggcccagaauauuccuaccgcgauccaccaggugcggagccugauuggaaacgaggaguuccuugacuacaugcccucuaugaagagauuucgcaaagaggaggaacuggagggcgcuaucugguga

SEQ ID NO: 20691 - RNA, 9873 nt, Artificial Sequence
  derived and/or modified CDS sequence (opt5) from DENV-3__FJ373306__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacguggggacgucccucacacagaaggucgugaucuucauucugcuuaugcugguuaccccuucuaugacaaugagaugugugggagucggcaaccgggacuuuguggaagggcucagcggagcuaccuggguggaugucguucuggagcacggcgggugcgugaccacaauggccaagaauaaacccacgcuggacaucgagcuccagaagaccgaagcuacacagcuggccacccuucgcaaacuguguauugagggaaagaucacaaacauuaccacggauuccagaugcccuacacagggcgaagcggugcucccggaggaacaggaccagaauuaugucuguaaacacaccuacguggaucggggcugggggaacggaugcggccuguucgggaagggaagccuuguuaccugcgccaaguuucaaugucuggagcccaucgagggcaaagugguccaguaugaaaaucucaaguacacagugauuaucaccguucauacaggggaccagcaccaggugggaaacgagacgcaaggcgucaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaagugguugugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguccugaagaaagagguguccgaaacccagcacgggacaauucucaucaagguugaguacaagggagaagaugugcccuguaaagucccuuucagcaccgaggacggccaagggaaggcccauaacggaagacugaucacagcgaaucccguggugaccaaaaaggaggaacccguuaacauugaggcugaaccuccguucggcgaguccaauaucgucauugggaucggcgauaacgcccugaaaauuaauugguauaagaagggaucuagcaucggcaaaauguuugaagccacggcuagaggggccagacgcauggcuauccuuggagacacagccugggauuucggcuccgucgggggagugcucaacagccugggcaagaugguccaccagauuuuugggucugcguacaccgcccuguucuccggcgugagcuggguuaugaaaaucggaauuggcgugcuccugaccuggaucgggcuuaauucuaagaacacaagcauguccuuuucuugcauugucaucggaauuaucacccuguaucucggcgcugugguucaggccgacauggggugugugaucaauuggaaaggaaaggagcugaagugcggcagcgggauuuucgucacaaacgaggugcauacguggaccgaacaguacaaauuucaagcugauucccccaagcggcuggccacagcgaucgccggcgcuugggagaauggaguuuguggcauuagaagcaccacacgcauggaaaaccuucucuggaaacagaucgccaaugagcugaacuauauucugugggaaaauaacaucaagcucaccguggucgugggggacaucauuggagugcuggagcagggcaaacggacgcuuaccccucagcccauggagcugaaguacucuuggaaaacaugggggaaggcuaagaucgucaccgccgaaacacaaaacuccagcuucauuaucgauggaccuaauacccccgagugcccgucugccuccagagcuuggaacguuugggaaguggaggacuauggcuuuggcguguucagcacaaauauuuggcucaaacugcgcgaagucuacacccagcugugugaccaccggcuuauguccgcggccgugaaggaugagagagcuguucacgccgacaugggguacuggaucgagucucagaaaaacggaagcuggaagcucgaaaaagccucccugaucgaggugaagacgugcacauggccuaagucucauacccuguggagcaauggcguccucgaauccgauaugauuauccccaaaagccuggcugggccuauuucucagcacaacuaucgccccggauaccauacccaaacagccggcccuuggcaccuugggaagcuggagcucgacuuuaauuauugcgagggaaccacggugguuaucacagaaaacuguggcacccggggccccucccugagaacaaccacagugagcgggaaacugauucacgaguggugcugucgcucuugcacccuuccgccucuccgguacaugggagaagauggcuguugguaugggauggagaucagacccaucuccgaaaaggaggagaauauggucaaaagccuggugucugcgggaagcggcaagguugacaacuucacgaugggggugcugugccucgcuauucuguuugaagaggucaugcggggaaaguucggcaaaaagcauaugaucgccggcguguucuuuaccuucgugcuucugcucuccgggcagauuacauggcgcgauauggcccacacccugaucaugauuggaagcaaugcuucugacagaaugggcaugggggucacauaccuggcccuuaucgcgaccuuuaaaauucagcccuuccuggcucucggauuuuuccugcggaagcucacguccagagaaaaccugcuucugggcguugggcucgccauggccacaacccugcaacugccugaggauaucgaacagauggcuaauggaaucgcccuuggccugauggcucucaaacugauuacacaguuugagaccuaucagcucuggaccgcccugaucagccuuacauguuccaacacgauuuucacccugacaguggcguggcgcaccgccacacucauccuggcuggcgugucucugcuuccggucugccaaagcuccucuaugcggaagaccgacuggcugcccaugacgguggccgcuauggggguuccuccccucccucuguuuauuuucagccucaaggauacacugaaaagacgcuccuggccccuuaaugagggagugauggccgucggccuggugucuauccuggccagcucccuccugagaaacgacguuccuauggcugggccccuuguggcgggaggccugcucaucgccuguuacgucauuaccgggaccagcgcugaucugacaguggaaaaggccgccgacgucaccugggaggaagaggcugaacagacaggagugucucauaaccucaugaucacgguugacgaugacggcaccaugcggauuaaagaugacgagacagagaauauccugaccgugcuucugaagacagcccugcucauugucuccggcaucuuuccguacagcaucccugcgacccugcuuguguggcacacguggcagaaacagacccaacgcucugggguucugugggaugugcccuccccucccgaaacacagaaggcugagcucgaagagggagucuauagaauuaaacagcagggcaucuucgggaagacccaagugggagugggcguucagaaggagggggucuuucauacaauguggcacgugacccggggagccgugcugacauacaacggcaaacgccucgaaccgaauugggccagcgucaagaaagaccugauuucuuauggcgggggauggagacuuuccgcucaguggcaaaagggcgaggaagugcagguuaucgccguggagccugggaaaaaccccaagaauuuccagacgaugccuggaaccuuccagacaaccaccggcgaaauuggggcgaucgcucuggauuuuaagcccggaacaagcggcucccccauuaucaaccgggagggcaaagucguggggcuguacggaaauggcguugugacgaagaacgggggauaugucagcggcaucgcccaaaccaaugccgagccugacgggccgacacccgaacucgaggaagagauguucaaaaagcgcaaccugaccauuauggaucuucacccuggcucuggaaaaacaagaaaguaccugcccgcuaucgugcgggaagccauuaagcgcagacuccggacccugauccucgcuccuacgagaguuguggccgcggagauggaggaagcccugaaaggccuucccauucgcuaucagacaaccgcuaccaagagcgagcauacagggcgggaaaucgucgaccugaugugccacgccaccuuuacaaugagacugcucuccccugugcgcgugccgaauuacaaccugaucauuauggaugaggcucauuucaccgaccccgccucuaucgccgcucggggauacauuagcacgagagucggcaugggggaagcggccgcuaucuuuaugacagccaccccucccggaacagccgaugcuuucccucaguccaaugcccccauucaggacgaggagcgcgacaucccggaacggucuuggaacagcggcaaugaguggaucaccgauuuugcggggaaaacgguuugguucgugccuuccauuaaggcuggcaacgacaucgccaacugucuucgcaaaaauggaaagaaggugauucaacugucuagaaaaaccuuugauacagaauaucagaagaccaaacucaacgacugggauuucgucgugacaaccgacaucagcgagaugggcgccaauuuuaaggcugaucggguuauugaccccagacggugccugaaacccgugauccugacagaugggccugagcgcgucauucucgccggacccaugccugugaccgcggccuccgcugcccagagacggggccgcguugggagaaacccgcagaaggaaaaugaccaauacaucuucacgggacagccccuuaacaaugaugaggaccacgcucauuggacagaagccaagaugcugcuggacaacaucaauaccccugagggcauuauccccgcucucuucgaaccugagcgggagaaaagcgccgcgauugauggggaauauagacugaagggcgagucucgcaaaaccuuuguggaacuuaugcggagaggagaccugcccgucuggcucgcccacaagguggcuuccgagggcaucaaauacacagaucgcaaguggugcuucgacgggcagcggaacaaucagauucuggaagagaacauggaugucgagaucuggaccaaagaaggagagaagaagaaacugagaccgcgcuggcucgacgcccggacauauagcgauccucuugcucugaaggaauuuaaagacuucgccgccggcagaaagucuaucgcucuggaucucgugacggagauugggcgcguucccucccaccuggcgcauagaacccggaaugcccuugacaaccuggugaugcuccacacaagcgaacauggaggcaaggcuuaccgccacgccguggaggagcugccugaaaccauggagacacugcuccuucugggccugaugauccuccugaccgggggagccaugcuuuuucugauuuccggcaaggggaucggaaagacgucuauuggccucaucugugucaucgcuagcuccgggaugcuguggauggccgaaauuccccugcaauggaucgcgagcgccauuguucucgaguucuuuaugauggugcuucugaucccugagcccgaaaaacagagaaccccgcaggauaaucaacuggcuuauguggucauuggaauccucacacuggccgcuauuaucgccgcgaacgagaugggccuucuggaaaccacaaagcgggaccucggcaugucuaaagagccuggggugguuucccccaccagcuaccuggauguggaccugcaccccgccucugcuuggacgcucuacgccgucgcuacaaccgugaucacaccuaugcuucgccauaccauugaaaauagcaccgccaacgucucccuggcugccaucgcgaaccaggccgugguucugaugggacucgacaagggcuggccgauuucuaaaauggaucugggggugccccuucuggcucucggaugcuauagccaggucaauccucugacacugacggccgcugugcuccuucugaucacccacuacgccauuaucggccccgggcugcaggccaaggcgacaagagaggcucaaaagcggaccgccgcuggaaucaugaaaaacccuacaguugacggcauuaugaccaucgaucucgaccccgugauuuaugauuccaaguucgagaaacagcugggccaggucaugcuucuggugcucugugccgugcagcugcugcucaugagaacgucuugggcccuuugcgaagcucugacacuggccaccgggccuaucaccacacucugggagggaagcccgggcaaguuuuggaauaccacaauugcgguuuccauggccaacaucuuccgcgggagcuaccuggcuggagccggccuugcuuuuucuaucaugaaauccgucgggacgggaaagcggggcaccggcagccaaggggaaacacugggagagaaguggaaaaagaaacucaaucagcuguccagaaaggaguucgaccuguauaaaaagucuggcauuaccgagguggaucgcacagaggccaaagaagggcucaagcggggagagaucacccaucacgcggugagcagaggcuccgccaaacuucagugguuugucgaacggaacaugguuauucccgaggggcgcgugaucgaccugggauguggcagaggcggguggucuuacuauugcgcuggacugaaaaaggugacggaaguccggggcuacaccaaagggggaccuggccaugaggagcccgugccuaugagcacauacggguggaauauuguuaagcucauguccggaaaagauguguucuaucugcccccggaaaagugugacacccuucugugcgauaucggcgagagcucuccuucccccacagucgaagagagccgcaccauuagagugcucaagaugguugagcccuggcugaaaaacaaucaguucuguaucaaggugcugaacccuuacaugcccacagucaucgaacaccucgagcggcuucaacgcaaacacggcgggaugcuggugagaaauccucugucucggaacuccacccaugaaauguauuggauuagcaauggaacgggcaacaucguggccucugucaauaugguuagccgccuccugcuuaacagauuuacaaugacccaccggagaccgaccauugagaaggacguggaucugggggcuggaacacgccaugugaacgccgaacccgagacgccuaauauggacgucaucggcgagcggauuaaaagaaucaaggaagaacacaacuccaccuggcacuacgacgaugaaaaucccuauaagacaugggcuuaccaugggucuuaugaggugaaagccaccggaagcgcguccagcaugaucaacggcguugugaagcuccugacaaaaccuugggacgucgugcccaugguuacccagauggccaugacagauaccacgccguucggccagcaacgcguguuuaaggaaaaagucgacacccggacaccuagauccaugcccgggacccgccgggugaugggaauuacagcugaguggcuguggagaacccucggccgcaauaagaagccucggcugugcacgagagaggaguucaccaaaaagguucgcaccaacgccgcuaugggggccguguuuacagaggaaaaucagugggauucugccaaagcggcugucgaggacgaagauuucuggauccuuguggaccgggagagagagcugcacaagcucggaaaauguggcagcugcgucuacaacaugauggggaagcgcgagaaaaagcugggcgaguuuggaaaggccaaaggcuccagagccauuugguacauguggcuuggggcucgguaucuggaguucgaggcccucggauuucugaaugaggaucauugguucucucgcgaaaacagcuacuccggcguggagggggaaggacugcacaagcucggcuauauccugagagacauuucuaaaauccccgggggcgcuauguacgccgaugacaccgcgggaugggacacgcggaucaccgaggaugaccuucauaaugaagagaagauuacacagcagauggauccugagcacagacaacuggccaacgcuaucuuuaaacucaccuaucagaauaagguugugaagguccagcggcccacaccgaccggcacagugauggacauuaucagccgcaaagaucagagaggguccggacaagugggcaccuacgggcugaacacguucacaaauauggaagcccagcuuauucggcagauggagggagaaggcguucugagcaaggcugaccucgagaacccucaucugcccgagaaaaagaucacccaguggcuggagaccaaagggguggagcgccucaagagaauggccaucucuggcgaugacugcgucgugaagcccauugaugaccgguuugcgaacgcccugcuugcucugaaugauaugggaaaaguucgcaaggacaucccucaauggcagccguccaaaggcuggcaugauuggcaacaggugcccuucuguagccaccauuuccacgaacucauuaugaaggacgggagaaaacuggucgugccuugccggccccaagacgagcuuaucggacgcgccagaauuucucagggcgcuggguggucccugcgggaaacagccugucucggaaaggcuuaugcccagauguggagccugauguacuuucaccgcagagaucugcggcucgcgucuaacgccaucugcuccgcugucccugugcauuggguucccaccagccgcacaacgugguccauucacgcccaucaccaauggaugaccacagaggacaugcugaccguguggaauagagucuggaucgaagauaacccuuggauggaggacaagacacccgugaccacgugggagaauguuccguaccuuggcaaacgggaagaucaguggugugggagccugaucggccucaccucuagagccacaugggcucagaacauuccuaccgccauccagcaagugcgcagccugauuggaaaugaggaguuccuugacuauaugcccuccaugaagcgguuuagaaaagaggaggaaucugagggcgcgaucugguga

SEQ ID NO: 20692 - RNA, 9873 nt, Artificial Sequence
  derived and/or modified CDS sequence (opt5) from DENV-3__EU687197__SS-prME
accagccugugccucaugaugauccugcccgccgcucuugccuuccaccugacaucccgggacggagaaccucggaugauuguggggaagaaugaacgcggaaagucucuccuguuuaagacggcgagcggcaucaauauguguacccuuauugcuauggaucugggggaaaugugcgacgauacagucaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcgagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucgugaauuggaaaggaaaggagcugaagugcggcagcgggaucuucguuacaaacgaggugcauacguggaccgaacaguacaaauuucaagccgauucccccaagcggcuggcgacagccauugcuggcgccugggagaauggagucuguggcaucagaagcaccacacgcauggaaaaccuucucuggaaacagauugcuaaugagcugaacuauauccugugggaaaauaacaucaagcucaccgugguugugggggacauuaucggaguccuggagcagggcaaacggacgcuuaccccucagcccauggagcugaaguacucuuggaaaacaugggggaaggccaagauugugaccgccgaaacacaaaacuccagcuucaucauugauggaccuaauacccccgagugcccgaacgcuucuagagcguggaaugugugggaagucgaggacuauggcuuuggcguuuucacaaccaacaucuggcucaaacugcgcgaaguguacacgcagcugugugaccaccggcuuauguccgccgcugugaaggaugagagagccguccacgccgacaugggguacuggaucgagagccagaaaaauggauccuggaagcucgaaaaggcuucucugauugaggugaagacaugcaccuggccuaagagccauacccugugguccaacggcguucucgaaucugauaugaucauucccaaaagccuggccgggccuaucucccagcacaauuaucgccccggauaccauacacaaaccgcgggcccuuggcaccuugggaagcuggagcucgacuuuaacuauugcgagggaacgacaguggucauuaccgaaaauuguggcacacggggccccagccugagaaccacaaccgugucugggaaacugauccacgaguggugcugucgcuccugcacgcuuccgccucuccgguacaugggagaagauggcuguugguaugggauggagaucagacccauuagcgaaaaggaggagaacaugguuaaaucucugguguccgcuggaagcggcaaggucgacaauuucaccaugggggugcugugccucgccauccuguuugaagagguuaugcggggaaaguucggcaaaaagcauaugauugccggcguguucuuuacauucguccuucugcucucugggcagaucaccuggcgcgauauggcucacacacugauuaugaucggaagcaacgccuccgacagaaugggcaugggggugaccuaccuggcgcuuauugcuacguuuaaaauccagcccuuccuggcccucggauuuuuccugcggaagcucacaagcagagaaaaucugcuucugggcguggggcucgccauggcuaccacacugcaacugccugaggauaucgaacagauggccaacggaauugcucuuggccugauggcccucaaacugaucacccaguuugagaccuaucagcucuggacagcgcugauuucucuuacguguuccaauaccaucuucacacugaccgucgccuggcgcacagcuacccucauucuggccggcguuagccugcuuccggugugccaauccucuagcaugcggaagacggacuggcugcccaugacaguggcugccaugggggucccuccccucccucuguuuaucuucucccucaaggauacccugaaaagacgcucuuggccccuuaacgagggagugauggccguuggccuggugagcauccuggcuuccucucuccugagaaacgacgucccuauggcggggccccuuguggccggaggccugcucauugcuuguuacguuaucaccgggacaagcgccgaucugaccguggaaaaggccgcugacgucacaugggaggaagaggccgaacagacgggagugucccauaaucucaugauuaccgucgacgaugacggcacaaugcggaucaaagaugacgagaccgagaacauucugacagugcuucugaagaccgcgcugcucaucguuagcggcaucuuuccguacucuauuccugcuacgcugcuuguguggcacaccuggcagaaacagacacaacgcuccgggguccugugggaugugcccagcccucccgaaacccagaaggccgagcucgaagagggaguuuauagaaucaaacagcagggcauuuucgggaagacacaagugggagucggcgugcagaaggaggggguguuucauaccauguggcacguuacacggggagccguccuggcuuacaauggcaaacgccucgaaccgaacugggccucugugaagaaagaccugaucuccuauggcgggggauggagacuuagcgcgcaguggcaaaagggcgaggaagugcaggucauugcuguggagccugggaaaaaucccaagaacuuccagacgaugccuggaaccuuccagacaaccaccggcgaaaucggggccauugcccuggauuuuaagcccggaacaucuggcucccccaucaucaaucgggagggcaaaguuguggggcuguacggaaacggcgucgugacgaagaaugggggauauguuagcggcauugcucaaaccaacgccgagccugacgggccgacacccgaacucgaggaagagauguucaaaaagcgcaaucugaccaucauggaucuucacccuggcuccggaaaaacaagaaaguaccugcccgcuauugugcgggaagccaucaagcgcagacuccggacccugauucucgcgccuacgagagucguggccgcugagauggaggaagcccugaaaggccuucccauccgcuaucagacaaccgcuaccaagagcgagcauacagggcgggaaaucguugaccugaugugccacgccaccuuuacaaugagacugcucucuccugugcgcgucccgaacuacaaucugauuaucauggaugaggcccauuucaccgaccccgcuagcauugcggcccggggauacaucuccacgagagugggcaugggggaagcugccgccauuuuuaugacagcuaccccucccggaacagccgaugcguucccucagucuaacgcucccauccaggacgaggagcgcgacaucccggaacggagcuggaacuccggcaacgaguggauuaccgauuuugccgggagaacggugugguucgucccuucuaucaaagccggcaacgacauugcuaauugucuucgcaagaacggcaaaaagguuauccaacugagccggaagaccuuugauacagaauaucagaaaaccaagcucaaugacugggauuucguggugacaaccgacauuuccgagaugggagccaacuuuaaagcggauagagucaucgacccccggcgcugccugaagcccgugauucugacagaugggccugagagaguuauccucgccggacccaugccugugaccgcugccucugcugcccagcggcgcggcagagucgggcggaauccgcagaaagaaaacgaccaauacaucuucacgggacagccccuuaauaacgaugaggaccacgcucauuggacagaagccaagaugcugcuggacaauauuaacaccccugagggcaucauucccgcccucuucgaaccugagagagagaaaagcgccgcuaucgauggggaauaucgccugaaaggcgaaucccggaagaccuuuguggaacuuaugagacgcggagaccugcccguuuggcucgcccacaaaguggcuagcgagggcauuaaguacacagaucggaaauggugcuucgacgggcagagaaauaaccagauccuggaagagaauauggaugucgagaucuggaccaaggaaggagagcgcaaaaagcugcggccgagauggcucgacgcccgcacauauucugauccucuugcccugaaggaauuuaaagacuucgcugcgggcagaaaguccauugcccuggaucucgugacggagaucgggcggguccccagccaccuggcucaucgcaccagaaacgcccuugacaaucuggugaugcuccacacaucugaacauggaggcaaagccuaccggcacgcuguugaggagcugccugaaaccauggagacacugcuccuucugggccugaugauucuccugaccgggggagccaugcuuuuucugaucuccggcaaggggauuggaaaaacgagcaucggccucaucugugugauugcguccucugggaugcuguggauggccgaaaucccccugcaauggauugcuagcgccaucgugcucgaguucuuuaugaugguccuucugauuccugagcccgaaaagcagcgcaccccgcaggauaaccaacuggcuuauguugugaucggcauucucacacuggccgcgaucaucgccgcuaaugagaugggccuucuggaaaccacaaagagagaccucggcauguccaaagagccugggguggucagccccaccucuuaccuggauguggaccugcaccccgccuccgcuuggacgcucuacgccguugcuacaaccgugauuacaccuaugcuucggcauaccaucgaaaacagcaccgccaacgucucucuggcggccauugcuaaucaggccgugguccugaugggacucgacaagggcuggccgaucagcaaaauggaucugggggugccccuucuggcucucggaugcuauucccagguuaacccucugacacugacggccgccgugcuccuucugauuacccacuacgcgaucaucggccccgggcugcaggcuaaggccacaagagaggcucaaaaacgcaccgccgccggaauuaugaagaauccuacagucgacggcaucaugaccauugaucucgaccccgugaucuaugauucuaaguucgagaaacagcugggccagguuaugcuucuggugcucugugcuguccagcugcugcucaugcggacgagcugggcccuuugcgaagcgcugacacuggccaccgggccuauuaccacacucugggagggauccccgggcaaguuuuggaacaccacaaucgcugugucuauggccaauaucuucagagggagcuaccuggcuggagccggccuugcguuuuccauuaugaaaagcguggggacgggaaagcgcggcaccggcucucaaggggaaacacugggagagaaauggaagaagaaacucaaccagcugucccggaaggaguucgaccuguauaaaaagagcggcaucaccgagguugauagaacagaggccaaagaagggcucaagcggggagagauuacccaucacgcugucucccgcggcucugccaaacuucagugguuuguggaaagaaauauggugauccccgaggggcgggucauugaccugggauguggccgcggcggguggagcuacuauugcgcuggacugaagaagguuacggaagugagaggcuacaccaaagggggaccuggccaugaggagcccgugccuauguccacauacggguggaacaucgucaagcucaugucuggaaaagauguguucuaucugcccccggaaaagugugacacccuucugugcgauauuggcgagagcuccccuagccccacaguugaagagucucggaccauccgcgugcucaaaauggucgagcccuggcugaagaauaaccaguucuguaucaaggugcugaauccuuacaugcccacaguuauugaacaccucgagagacuucaacggaaacacggcgggaugcuggugcgcaacccucuguccagaaauagcacccaugaaauguauuggaucucuaacggaacgggcaauauugucgccuccgugaacauggugagccggcuccugcuuaacagauuuacaaugacccaccgccggccgaccaucgagaaggacgucgaucugggggcuggaacaagacauguuaaugccgaacccgagacgccuaacauggacgugauuggcgagcgcaucaaacggaucaaggaagaacacaauucuaccuggcacuacgacgaugaaaaccccuauaaaacaugggcguaccaugggagcuaugaggugaaggccaccggauccgcuucuagcaugauuaauggcgucgugaagcuccugacaaaaccuugggacguugugcccauggucacccagauggccaugacagauaccacgccguucggccagcaaagaguguuuaaggaaaaaguugacacccgcacaccucgguccaugcccgggaccagacgcgugaugggaaucacagcugaguggcuguggcggacccucggcagaaacaagaaaccucgccugugcacgcgggaggaguucacaaagaaggucagaaccaaugccgccaugggggcgguguuuacagaggaaaaccagugggauagcgcuaaagccgccguugaggacgaagauuucuggaaacuuguggaccgcgagagagagcugcacaaacucggaaaguguggcuccugcgucuacaauaugauggggaaacgggaaaagaaacugggcgaguuuggaaaggcuaagggcucucgcgccauuugguacauguggcuuggggcuagauaucuggaguucgaggcccucggauuucugaacgaggaucauugguucagccgggaaaauuccuacucuggcguggagggggaaggacugcacaaacucggcuauauccugagagacauuagcaagauccccgggggcgcgauguacgccgaugacaccgcuggaugggacacgcggaucaccgaggaugaccuucauaacgaagagaaaauuacacagcagauggauccugagcaccgccaacuggccaaugcuaucuuuaagcucaccuaucagaacaaagucgugaagguucagagacccacaccgaccggcacagugauggacauuaucucccggaaggaucagcgcgggucuggacaagucggcaccuacgggcugaauacguucacaaacauggaagugcagcuuauuagacagauggagggagaaggcgugcugagcaaagccgaccucgagaacccucaucugcccgaaaagaaaaucacccaguggcuggagaccaaggggguugagcggcucaaacgcauggcgaucuccggcgaugacugcguggucaagcccauugaugacagauuugccaaugcucugcuugcccugaacgauaugggaaaggugcggaaagacaucccucaauggcagccgagcaagggcuggcaugauuggcagcagguucccuucuguucucaccauuuccacgaacucauuaugaaagacgggcgcaagcugguggucccuugcagaccccaagacgagcuuaucggacgggcucgcauuucccagggcgccggguggagccugagagaaacagcuugucucggaaaagccuaugcgcagauguggucucugauguacuuucaccggcgcgaucugagacucgccuccaaugcuaucugcagcgccgugccuguccauugggugcccaccucucggacaacgugguccauucacgcccaucaccaauggaugaccacagaggacaugcugaccguuuggaacagaguguggaucgaagauaauccuuggauggaggacaagacacccgucaccacgugggagaacgugccguaccuuggcaagcgcgaagaucaguggugugggagccugaucggccucaccucccgggcuacaugggcccagaauauuccuaccgcgauccaucagguuagaagccugauuggaaacgaggaguuccuugacuauaugcccucuaugaaacgcuuucggaaggaggaggaacuggagggcgcuaucugguga

SEQ ID NO: 20693 - RNA, 9873 nt, Artificial Sequence
  derived and/or modified CDS sequence (opt5) from DENV-3__EU687198__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccagaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucacaaaaaaggaggaacccgugaacauugaggccgaaccuccguucggcgaguccaauaucgugauugggguuggcgauaacgcccugaaaaucaauugguauaagaagggaucuagcaucggcaaaauguuugaagcuaccgcccggggggcuagacgcauggccauucuuggagacacggcgugggauuucggcuccgucgggggagugcucaacagccugggcaagauggugcaccagaucuuugggucugccuacacagcucuguucuccggcgucagcugggugaugaaaauuggaaucggcguucuccugaccuggauugggcuuaauucuaagaacaccagcauguccuuuucuugcaucgccauuggaaucaucacacuguaucucggcgcugugguccaggccgacaccgggugugugauuaauuggaaaggaaaggagcugaagugcggcagcgggaucuucguuacaaacgaggugcauacguggaccgaacaguacaaauuucaagcggauucccccaagcggcuggccacagcuauugccggcgcuugggagaauggagucuguggcaucagaagcaccacacgcauggaaaaccuucucuggaaacagauugccaaugagcugaacuauauccugugggaaaauaacaucaagcucaccgugguugugggggacauuaucggaguccuggagcagggcaaacggacgcuuaccccucagcccauggagcugaaguacucuuggaaaacaugggggaaggccaagauugugaccgcugaaacacaaaacuccagcuucaucauugauggaccuaauacccccgagugcccgucugcguccagagccuggaacgugugggaagucgaggacuauggcuuuggcguuuucacaaccaauaucuggcucaaacugcgcgaaguguacacgcagcugugugaccaccggcuuaugagcgcugccgugaaggaugagagagccguccacgcugacaugggguacuggaucgagucccagaaaaacggaucuuggaagcucgaaaaagccagccugauugaggugaagacaugcaccuggccuaagucccauacccuguggucuaauggcguucucgaaagcgauaugaucauucccaaaucccuggcggggccuaucagccagcacaacuaucgccccggauaccauacacaaaccgcuggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagaucagacccauuucugaaaaggaggagaauaugguuaaaucccuggugagcgccggaucuggcaaggucgacaacuucaccaugggggugcugugccucgccauccuguuugaagagguuaugcggggaaaguucggcaaaaagcauaugauugcuggcguguucuuuacauucguccuucugcucagcgggcagaucaccuggcgcgauauggcccacacacugauuaugaucggauccaaugcgagcgacagaaugggcaugggggugaccuaccuggcucuuauugccacguuuaaaauccagcccuuccuggcccucggauuuuuccugcggaagcucacaucuagagaaaaccugcuucugggcguggggcucgcuauggccaccacacugcaacugccugaggauaucgaacagauggcuaauggaauugcccuuggccugauggcgcucaaacugaucacccaguuugagaccuaucagcucuggacagcccugauuucccuuacguguagcaacaccaucuucacacugaccgucgcuuggcgcacagccacccucauucuggcuggcguuucccugcuuccggugugccaaucuagcuccaugcggaagucugacuggcugcccaugacgguggccgccaugggggucccuccccucccucuguuuaucuucagccucaaggauacacugaaaagacgcuccuggccccuuaaugagggagugauggcuguuggccuggugucuauccuggcgagcucccuccugagaaacgacgucccuauggccgggccccuuguggcuggaggccugcucauugccuguuacguuaucaccgggaccagcgccgaucugacaguggaaaaggcugccgacgucaccugggaggaagaggcggaacagacaggagugucucauaaccucaugauuacggucgacgaugacggcaccaugcggaucaaagaugacgagacagagaauauucugaccgugcuucugaagacagcucugcucaucguuuccggcaucuuuccguacagcauuccugccacccugcuuguguggcacacguggcagaaacagacccgcagaucugggguccugugggaugugcccuccccucccgaaacacaaaaggccgagcucgaagagggaguuuaucggaucaaacagcagggcauuuucgggaagacccaggugggagucggcgugcaaaaggaggggguguuucauacaauguggcacguuacccgcggagcuguccugacauacaacggcaaaagacucgaaccgaauugggccagcgugaagaaagaccugaucucuuauggcgggggauggcggcuuuccgcgcaguggcagaagggcgaggaagugcaagucauugcuguggagccugggaaaaaccccaagaauuuccagacgaugccuggaaccuuccagacaaccaccggcgaaaucggggccauugcccuggauuuuaagcccggaacaagcggcucccccaucaucaaccgcgagggcaaaguuguggggcuguacggaaauggcgucgugacgaagaacgggggauauguuagcggcauugcucagaccaaugccgagccugacgggccgacacccgaacucgaggaagagauguucaaaaagagaaaccugaccaucauggaucuucacccuggcucuggaaaaacacggaaguaccugcccgcuauugugcgcgaagccaucaagagacggcucagaacccugauucucgcgccuacgcgcgucguggccgcugagauggaggaagcccugaaaggccuucccauccgguaucaaacaaccgcuaccaagagcgagcauacagggagagaaaucguugaccugaugugccacgccaccuuuacaaugcgccugcucuccccugugcgggucccgaauuacaaccugauuaucauggaugaggcccauuucaccgaccccgcuucuauugcggccagaggauacaucagcacgcgcgugggcaugggggaagcugccgccauuuuuaugacagcuaccccucccggaacagccgaugcguucccucaguccaaugcucccauccaggacgaggagcgggacaucccggaaagaucuuggaacagcggcaaugaguggauuaccgauuuugccgggaaaacggugugguucgucccuuccaucaaggccggcaacgacauugcuaacugucuucgcaaaaauggaaagaagguuauccagcugucucggaaaaccuuugauacagaauaucaaaagaccagacucaacgacugggauuucguggugacaaccgacauuagcgagaugggcgccaauuuuaaagcggaucgggucaucgacccccgcagaugccugaagcccgugauucugacagaugggccugagcggguuauccucgccggacccaugccugugaccgcugccuccgcugcccagcgcagaggccgggucgggagaaacccgcagaaagaaaaugaccaguacaucuucacgggacaaccccuuaacaaugaugaggaccacgcucauuggacagaagccaagaugcugcuggacaacauuaauaccccugagggcaucauucccgcgcucuucgaaccugagcgcgagaagagcgccgcuaucgauggggaauaucggcugaaaggcgagucuagaaagaccuuuguggaacuuaugcgccggggagaccugcccguuuggcucgcccacaaaguggcuuccgagggcauuaaguacacagauagaaaauggugcuucgacgggcagcgcaacaaucagauccuggaagagaacauggaugucgagaucuggaccaaggaaggagagaaaaagaagcugcggccgagauggcucgacgcccgcacauauagcgauccucuugcccugaaagaauuuaaggacuucgcugcgggcagaaaaucuauugcccuggaucucgugacggagaucgggcggguccccucccaccuggcucaucgcaccagaaaugcccuugacaaccuggugaugcuccacacaagcgaacauggaggcaaggccuaccggcacgcuguugaggagcugccugaaaccauggagacacugcuccuucugggccugaugauucuccugaccgggggagccaugcuuuuucugaucuccggcaaagggauuggaaagacgucuaucggccucaucugugugauugcgagcuccgggaugcuguggauggccgaaaucccccugcaguggauugcuagcgccaucgugcucgaguucuuuaugaugguccuucugauuccugagcccgaaaagcaacgcaccccgcaggauaaucagcuggcuuauguugugaucggaauucucacacuggccgcgaucaucgccgcuaacgagaugggccuucuggaaaccacaaaaagagaccucggcaugucuaaggagccugggguggucucccccaccagcuaccuggauguggaccugcaccccgccucugcuuggacgcucuacgccguugcuacaaccgugauuacaccuaugcuucggcauaccaucgaaaauagcaccgccaacgucucccuggcggccauugcuaaccaagccgugguccugaugggacucgacaaaggcuggccgaucucuaagauggaucugggggugccccuucuggcucucggaugcuauagccagguuaauccucugacacugacggccgccgugcuccuucugauuacccacuacgcgaucaucggccccgggcugcaggcuaaagccacaagagaggcucagaagcgcaccgccgccggaauuaugaagaacccuacagucgacggcaucaugaccauugaucucgaccccgugaucuaugauuccaaauucgagaagcaacugggccagguuaugcuucuggugcucugugcuguccagcugcugcucaugcggacgucuugggcccuuugcgaagcgcugacacuggccaccgggccuauuaccacacucugggagggaagcccgggcaaauuuuggaauaccacaaucgcuguguccauggccaacaucuucagagggagcuaccuggcuggagccggccuugcguuuucuauuaugaaguccguggggacgggaaaacgcggcaccggcagccagggggaaacacugggagagaaguggaagaaaaagcucaaucaacugucccggaaagaauucgaccuguauaagaaaucuggcaucaccgagguugauagaacagaggccaaggaagggcucaaacggggagagauuacccaucacgcugucagccgcggcuccgccaagcuucagugguuuguggaaagaaacauggugauccccgaggggcgggucauugaccugggauguggccgcggcggguggucuuacuauugcgcuggacugaagaaaguuacggaagugagaggcuacaccaaggggggaccuggccaugaggagcccgugccuaugagcacauacggguggaauaucgucaaacucauguccggaaaggauguguucuaucugcccccggaaaaaugugacacccuucugugcgauauuggcgagagcucuccuucccccacaguugaagagagccggaccauccgcgugcucaagauggucgagcccuggcugaagaacaaucaguucuguaucaaagugcugaacccuuacaugcccacaguuauugaacaccucgagagacuucagcggaagcacggcgggaugcuggugcgcaauccucugucuagaaacuccacccaugaaauguauuggaucagcaauggaacgggcaacauugucgccucugugaauauggugagccggcuccugcuuaacagauuuacaaugacccaccgccggccgaccaucgagaaagacgucgaucugggggcuggaacaagacauguuaacgccgaacccgagacgccuaauauggacgugauuggcgagcgcaucaagcggaucaaagaagagcacaacuccaccuggcacuacgacgaugaaaaucccuauaagacaugggcguaccaugggucuuaugaggugaaggccaccggaagcgcuuccagcaugauuaacggcgucgugaaacuccugacaaagccuugggacguugugcccauggucacccaaauggccaugacagauaccacgccguucggccagcagagaguguuuaaagaaaagguugacacccgcacaccucgguccaugcccgggaccagacgcgugaugggaaucacagcugaguggcuguggcggacccucggcagaaauaaaaagccucgccugugcacgcgggaggaauucacaaagaaagucagaaccaacgccgccaugggggcgguguuuacagaggaaaaucaaugggauucugcuaaggccgccguugaggacgaagauuucuggaaacuuguggaccgcgagagagagcugcacaagcucggaaaauguggcagcugcgucuacaacaugauggggaagcgggaaaaaaagcugggcgaguuuggaaaggcuaaaggcucccgcgccauuugguacauguggcuuggggcuagauaucuggaauucgaggcccucggauuucugaaugaggaucauugguucucucgggaaaacagcuacuccggcguggagggggaaggacugcacaagcucggcuauauccugagagacauuucuaaaauccccgggggcgcgauguacgccgaugacaccgcuggaugggacacgcggaucaccgaggaugaccuucauaaugaagagaagauuacacagcagauggauccugagcaccgccagcuggccaacgcuaucuuuaaacucaccuaucaaaauaaggucgugaagguucagagacccacaccgaccggcacagugauggacauuaucagccggaaagaucagcgcggguccggacaggucggcaccuacgggcugaacacguucacaaauauggaagcccaacuuauuagacagauggagggagaaggcgugcugagcaaggcggaccucgagaacccucaccugucugaaaaaaagaucacccaguggcuggagaccaaagggguggagcggcucaagcgcauggccaucuccggcgaugacugcguugugaagcccauugaugacagauuugcuaacgcccugcuugcucugaaugauaugggaaaaguccggaaggacaucccccaguggcaaccuagcaaaggcuggcaugauuggcagcaggugccguucuguucucaccauuuccacgaacucauuaugaaggacgggcgcaaacugguugugcccugcagaccucaggacgagcuuaucggacgggcccgcauuucccaaggcgcuggguggagccugagagaaacagccugucucggaaaggcguaugcccagauguggucucugauguacuuucaccggcgcgaucugagacucgcuuccaacgccaucugcagcgccguccccgugcauugggucccuaccucccggacaacguggagcauucacgcucaucaccaguggaugaccacagaggacaugcugaccguguggaauagaguuuggaucgaagauaaccccuggauggaggacaagacaccugugaccacgugggagaauguccccuaccuuggcaaacgcgaagaucaauggugugggucucugaucggccucaccagccgggccacaugggcgcagaacauuccgaccgcuauccagcaggugagaucccugauuggaaaugaggaauuccuugacuauaugccuucuaugaagcgcuuucggaaagaggaggaaagcgagggcgccaucugguga

SEQ ID NO: 20694 - RNA, 9873 nt, Artificial Sequence
  derived and/or modified CDS sequence (opt5) from DENV-3__EU726769__SS-prME
accagccugugccucaugaugauccugcccgccgcucuugccuuccaccugacgucccgggacggagaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauuguuaucggaaucauuacccuguaucucggcgcugugguccaggccgacauggggugugugaucaauuggaaaggaaaggagcugaagugcggcagcgggauuuucguuacaaacgaggugcauacguggaccgaacaguacaaauuucaagcugauucccccaagcggcuggccacagcgaucgccggcgcuugggagaauggagucuguggcauuagaagcaccacacgcauggaaaaccuucucuggaaacagaucgccaaugagcugaacuauauccugugggaaaauaacauuaagcucaccgugguugugggggacaucauuggaguccuggagcagggcaaacggacgcuuaccccucagcccauggagcugaaguacucuuggaaaacaugggggaaggcuaagaucgugaccgccgaaacacaaaacuccagcuucauuaucgauggaccuaauacccccgagugcccgucugccuccagagcuuggaacgugugggaagucgaggacuauggcuuuggcguuuucacaaccaauaucuggcucaaacugcgcgaaguguacacgcagcugugugaccaccggcuuaugagcgcggccgugaaggaugagagagcuguccacgccgacaugggguacuggauugagucccagaaaaacggaucuuggaagcucgaaaaagccagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauaugguuaaaucccuggugagcgcgggaucuggcaaggucgacaacuucaccaugggggugcugugccucgcuauucuguuugaagagguuaugcggggaaaguucggcaaaaagcauaugguggccggcgucuucuuuacauucgugcuucugcucagcgggcagaucaccuggcgcgauauggcccacacacugauuauggugggauccaaugcuagcgacagaaugggcaugggggucaccuaccuggcccuuaucgcgacguuuaaaauucagcccuuccuggcucucggauuuuuccugcggaagcucacaucuagagaaaaccugcuucugggcguugggcucgccauggccaccacacugcaacugccugaggauaucgaacagauggcuaauggaaucgcccuuggccugauggcucucaaacugauuacccaguuugagaccuaucagcucuggacagcccugaucucccuuacguguagcaacaccauuuucacacugaccguggcguggcgcacagccacccucauccuggcuggcgugucccugcuuccggucugccaaucuagcuccaugcggaagacggacuggcugcccaugacaguggccgcuauggggguuccuccccucccucuguuuauuuucucucucaaggauacccugaaaagacgcagcuggccccuuaaugagggagugauggccgucggccugguguccauccuggccucuagccuccugagaaacgacguuccuauggcugggccccuuguggcgggaggccugcucaucgccuguuacgucauuaccgggacauccgcugaucugaccguggaaaaggccgccgacgucacaugggaggaagaggcugaacagacgggagugagccauaaccucaugaucaccguugacgaugacggcacaaugcggauuaaagaugacgagaccgagaauauccugacagugcuucugaagaccgcccugcucauugucucuggcaucuuuccguacuccaucccugcgacgcugcuuguguggcacaccuggcagaaacagacacaacgcagcgggguucugugggaugugcccucuccucccgaaacccagaaggcugagcucgaagagggagucuauagaauuaaacagcagggcaucuucgggaagacacaagugggagugggcguucagaaggagggggucuuucauaccauguggcacgugacacggggagccgugcugacguacaacggcaaacgccucgaaccgaauugggccuccgucaagaaagaccugauuagcuauggcgggggauggagacuuucugcucaguggcaaaagggcgaggaagugcagguuaucgccguggagccugggaaaaaccccaagaauuuccagaccaugccuggaacauuccagaccaccacaggcgaaauuggggcgaucgcucuggauuuuaagcccggaacguccggcagccccauuaucaaccgggagggcaaagucguggggcuguacggaaauggcguugugaccaagaacgggggauaugucuccggcaucgcccaaacaaaugccgagccugacgggccgacccccgaacucgaggaagagauguucaaaaagcgcaaccugacaauuauggaucuucacccuggcagcggaaaaaccagaaaguaccugcccgcuaucgugcgggaagccauuaagcgcagacuccggacgcugauccucgcuccuacaagaguuguggccgcggagauggaggaagcccugaaaggccuucccauucgcuaucagaccaccgcuacaaagucugagcauaccgggcgggaaaucgucgaccugaugugccacgccacauuuaccaugagacugcucagcccugugcgcgugccgaauuacaaccugaucauuauggaugaggcucauuucacggaccccgccuccaucgccgcucggggauacauuucuacaagagucggcaugggggaagcggccgcuaucuuuaugaccgccacaccucccggaaccgccgaugcuuucccucagagcaaugcccccauucaggacgaggagcgcgacaucccggaacgguccuggaacucuggcaaugaguggaucacggauuuugcggggaaaaccguuugguucgugccuagcauuaaggcuggcaacgacaucgccaacugucuucgcaaaaauggaaagaaggugauucaacuguccagaaaaacauuugauaccgaauaucagaagacaaaacucaacgacugggauuucgucgugaccacagacaucucugagaugggcgccaauuuuaaggcugaucggguuauugaccccagacggugccugaaacccgugauccugaccgaugggccugagcgcgucauucucgccggacccaugccugugacggcggccagcgcugcccagagacggggccgcguugggagaaacccgcagaaggaaaaugaccaauacaucuucacaggacagccccuuaacaaugaugaggaccacgcucauuggaccgaagccaagaugcugcuggacaacaucaauaccccugagggcauuauccccgcucucuucgaaccugagcgggagaaauccgccgcgauugauggggaauauagacugaagggcgagagccgcaaaacauuuguggaacuuaugcggagaggagaccugcccgucuggcucgcccacaagguggcuucugagggcaucaaauacaccgaucgcaaguggugcuucgacgggcagcggaacaaucagauucuggaagagaacauggaugucgagaucuggacaaaagaaggagagaagaagaaacugagaccgcgcuggcucgacgcccggacguauuccgauccucuugcucugaaggaauuuaaagacuucgccgccggcagaaagagcaucgcucuggaucucgugaccgagauugggcgcguucccucucaccuggcgcauagaacacggaaugcccuugacaaccuggugaugcuccacaccuccgaacauggaggcaaggcuuaccgccacgccguggaggagcugccugaaacaauggagacccugcuccuucugggccugaugauccuccugacagggggagccaugcuuuuucugauuagcggcaaggggaucggaaagaccuccauuggccucaucugugucaucgcuucuagcgggaugcuguggauugccgaaaucccccugcaauggauugcguccgccaucguucucgaguucuuuaugauggugcuucugauuccugagcccgaaaaacagagaacaccgcaggauaaucaacuggcuuauguggucaucggcauucucacccuggccgcuaucaucgccgcgaacgagaugggccuucuggaaacaaccaagcgggaccucggcaugagcaaagagccuggggugguuucucccacguccuaccuggauguggaccugcaccccgccagcgcuuggacacucuacgccgucgcuaccacagugauuaccccuaugcuucgccauaccaucgaaaauucuacagccaacgucagccuggcugccauugcgaaccaggccgugguucugaugggacucgacaagggcuggccgaucuccaaaauggaucugggggugccccuucuggcucucggaugcuauucucaggucaauccucugacgcugaccgccgcugugcuccuucugauuacacacuacgccaucaucggccccgggcugcaggccaaggcgaccagagaggcucaaaagcggacagccgcuggaauuaugaaaaacccuaccguugacggcaucaugacgauugaucucgaccccgugaucuaugauagcaaguucgagaaacagcugggccaggucaugcuucuggugcucugugccgugcagcugcugcucaugagaacauccugggcccuuugcgaagcucugacccuggccaccgggccuauuacaacccucugggagggaucuccgggcaaguuuuggaauacaacgaucgcgguuagcauggccaacaucuuccgcggguccuaccuggcuggagccggccuugcuuuuagcauuaugaaaucugucgggaccggaaagcggggcacaggcucccaaggggaaacccugggagagaaguggaaaaagaaacucaaucagcugagcagaaaggaguucgaccuguauaaaaaguccggcaucacagagguggaucgcaccgaggccaaagaagggcucaagcggggagagauuacgcaucacgcggugucuagaggcagcgccaaacuucagugguuugucgaacggaacaugguuauccccgaggggcgcgugauugaccugggauguggcagaggcgggugguccuacuauugcgcuggacugaaaaaggugaccgaaguccggggcuacacaaaagggggaccuggccaugaggagcccgugccuaugucuaccuacggguggaauaucguuaagcucaugagcggaaaagauguguucuaucugcccccggaaaagugugacacacuucugugcgauauuggcgaguccagcccuucucccaccgucgaagagucccgcacaaucagagugcucaagaugguugagcccuggcugaaaaacaaucaguucuguaucaaggugcugaacccuuacaugcccaccgucauugaacaccucgagcggcuucaacgcaaacacggcgggaugcuggugagaaauccucugagccggaacucuacgcaugaaauguauuggaucuccaauggaacaggcaacauuguggccagcgucaauaugguuucucgccuccugcuuaacagauuuaccaugaccuaccggagaccgacaaucgagaaggacguggaucugggggcuggaacgcgccacgugaacgccgaacccgagaccccuaauauggacgucauuggcgagcggaucaaaagaaucaaggaagaacauaacagcacauggcacuaugacgaugaaaaucccuacaagaccugggcuuaucacggguccuacgaggugaaagccacaggaucugcgagcuccaugauuaacggcguugugaagcuccugaccaaaccuugggacgucgugcccaugguuacacagauggccaugaccgauacgaccccguucggccagcaacgcguguuuaaggaaaaagucgacacacggaccccuagaagcaugcccgggacacgccgggugaugggaaucaccgcugaguggcuguggagaacgcucggccgcaauaagaagccucggcugugcacaagagaggaguucaccaaaaagguucgcacaaacgccgcuaugggggccguguuuaccgaggaaaaucagugggauuccgccaaagcggcugucgaggacgaagauuucuggauucuuguggaccgggagagagagcugcauaaggucggaaaauguggcucuugcguguacaacaugauggggaagcgcgagaaaaagcucggcgaguuuggaaaggccaaaggcagcagagccaucugguauauguggcugggggcucgguaccuugaguucgaggcccugggauuucucaaugaggaucacugguucucccgcgaaaacucuuauagcggcguugagggggaaggacugcauaagcugggcuacauucucagagacaucuccaaaauccccgggggcgcuauguaugccgaugacacggcgggaugggacacccggauuacagaggaugaccugcacaaugaagagaagaucacccagcagauggauccugagcauagacaacuugccaacgcuauuuuuaaacugacauaccagaauaagguggucaaggugcagcggcccaccccgacaggcaccgugauggacaucauuucucgcaaagaucagagagggagcggacaaguuggcacguaugggcucaacacauucaccaauauggaagcccagcugauccggcagauggagggagaaggcgugcuuuccaaggcugaccuggagaacccucaccuccccgagaaaaagaucacccaguggcuggagacaaaaggggucgagcgccugaagagaauggccauuagcggcgaugacugcgugguuaagcccaucgaugaccgguuugcgaacgcccuccuggcucuuaaugauaugggaaaagugcgcaaggacauuccucaauggcagccgucuaaaggcuggcacgauuggcagcagguccccuucuguucccaucacuuccaugaacugaucaugaaggacgggagaaaacucguggucccuugccggccccaagacgagcugauuggacgcgccagaaucagccagggcgcuggguggucucuucgggaaaccgccugucugggaaaggcuuacgcccagauguggucccucauguacuuucaccgcagagaucugcggcuggcgagcaacgccauuugcucugcugugccuguucacugggugcccacaucccgcacgaccuggagcauccaugcccaccaucaauggaugacaaccgaggacaugcucacagucuggaauagaguguggaucgaagauaacccuuggauggaggacaagacccccguuacgaccugggagaaugugccguaucugggcaaacgggaagaucaguggugugggucccuuauuggccugacaagcagagccaccugggcucagaacaucccuacagccauucagcaaguccgcucucucaucggaaaugaggaguuccuggacuacaugcccagcaugaagcgguuuagaaaagaggaggaauccgagggcgcgauuugguga

SEQ ID NO: 20695 - RNA, 9873 nt, Artificial Sequence
  derived and/or modified CDS sequence (opt5) from DENV-3__EU687239__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccagaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucacaaaaaaggaggaacccgugaacauugaggccgaaccuccguucggcgaguccaauaucgugauugggguuggcgauaacgcccugaaaaucaauugguauaagaagggaucuagcaucggcaaaauguuugaagcuaccgcccggggggcuagacgcauggccauucuuggagacacggcgugggauuucggcuccgucgggggagugcucaacagccugggcaagauggugcaccagaucuuugggucugccuacacagcucuguucuccggcgucagcugggugaugaaaauuggaaucggcguucuccugaccuggauugggcuuaauucuaagaacaccagcauguccuuuucuugcaucgccauuggaaucaucacacuguaucucggcgcugugguccaggccgacaccgggugugugauuaauuggaaaggaaaggagcugaagugcggcagcgggaucuucguuacaaacgaggugcauacguggaccgaacaguacaaauuucaagcggauucccccaagcggcuggccacagcuauugccggcgcuugggagaauggagucuguggcaucagaagcaccacacgcauggaaaaccuucucuggaaacagauugccaaugagcugaacuauauccugugggaaaauaacaucaagcucaccgugguugugggggacauuaucggaguccuggagcagggcaaacggacgcuuaccccucagcccauggagcugaaguacucuuggaaaacaugggggaaggccaagauugugaccgcugaaacacaaaacuccagcuucaucauugauggaccuaauacccccgagugcccgucugcguccagagccuggaacgugugggaagucgaggacuauggcuuuggcguuuucacaaccaauaucuggcucaaacugcgcgaaguguacacgcagcugugugaccaccggcuuaugagcgcugccgugaaggaugagagagccguccacgcugacaugggguacuggaucgagucccagaaaaacggaucuuggaagcucgaaaaagccagccugauugaggugaagacaugcaccuggccuaagucccauacccuguggucuaauggcguucucgaaagcgauaugaucauucccaaaucccuggcggggccuaucagccagcacaacuaucgccccggauaccauacacaaaccgcuggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagaucagacccauuucugaaaaggaggagaauaugguuaaaucccuggugagcgccggaucuggcaaggucgacaacuucaccaugggggugcugugccucgccauccuguuugaagagguuaugcggggaaaguucggcaaaaagcauaugauugcuggcguguucuuuacauucguccuucugcucagcgggcagaucaccuggcgcgauauggcccacacacugauuaugaucggauccaaugcgagcgacagaaugggcaugggggugaccuaccuggcucuuauugccacguuuaaaauccagcccuuccuggcccucggauuuuuccugcggaagcucacaucuagagaaaaccugcuucugggcguggggcucgcuauggccaccacacugcaacugccugaggauaucgaacagauggcuaauggaauugcccuuggccugauggcgcucaaacugaucacccaguuugagaccuaucagcucuggacagcccugauuucccuuacguguagcaacaccaucuucacacugaccgucgcuuggcgcacagccacccucauucuggcuggcguuucccugcuuccggugugccaaucuagcuccaugcggaagucugacuggcugcccaugacgguggccgccaugggggucccuccccucccucuguuuaucuucagccucaaggauacacugaaaagacgcuccuggccccuuaaugagggagugauggcuguuggccuggugucuauccuggcgagcucccuccugagaaacgacgucccuauggccgggccccuuguggcuggaggccugcucauugccuguuacguuaucaccgggaccagcgccgaucugacaguggaaaaggcugccgacgucaccugggaggaagaggcggaacagacaggagugucucauaaccucaugauuacggucgacgaugacggcaccaugcggaucaaagaugacgagacagagaauauucugaccgugcuucugaagacagcucugcucaucguuuccggcaucuuuccguacagcauuccugccacccugcuuguguggcacacguggcagaaacagacccgcagaucugggguccugugggaugugcccuccccucccgaaacacaaaaggccgagcucgaagagggaguuuaucggaucaaacagcagggcauuuucgggaagacccaggugggagucggcgugcaaaaggaggggguguuucauacaauguggcacguuacccgcggagcuguccugacauacaacggcaaaagacucgaaccgaauugggccagcgugaagaaagaccugaucucuuauggcgggggauggcggcuuuccgcgcaguggcagaagggcgaggaagugcaagucauugcuguggagccugggaaaaaccccaagaauuuccagacgaugccuggaaccuuccagacaaccaccggcgaaaucggggccguugcccuggauuuuaagcccggaacaagcggcucccccauuaucaaccgcgagggcaaaguggucgggcuguacggaaauggcgugguuacgaagaacgggggauaugugagcggcaucgcucagaccaaugccgagccugacgggccgacacccgaacucgaggaagagauguucaaaaagagaaaccugaccauuauggaucuucacccuggcucuggaaaaacacggaaguaccugcccgcuaucguccgcgaagccauuaagagacggcucagaacccugauccucgcgccuacgcgcgugguugccgcugagauggaggaagcccugaaaggccuucccauucgguaucaaacaaccgcuaccaagagcgagcauacagggagagaaaucguggaccugaugugccacgccaccuuuacaaugcgccugcucuccccuguccgggugccgaauuacaaccugaucauuauggaugaggcccauuucaccgaccccgcuucuaucgcggccagaggauacauuagcacgcgcgugggcaugggggaagcugccgccaucuuuaugacagcuaccccucccggaacagccgaugcguucccucaguccaaugcucccauucaggacgaggagcgggacaucccggaaagaucuuggaacagcggcaaugaguggaucaccgauuuugccgggaaaacggucugguucguuccuuccauuaaggccggcaacgacaucgcuaacugucuucgcaaaaauggaaagaaggugauucagcugucucggaaaaccuuugauacagaauaucaaaagaccaaacucaacgacugggauuucguggucacaaccgacaucagcgagaugggcgccaauuuuaaggcggauagagugauugacccccggcgcugccugaaacccguuauccugacagaugggccugagagagugauucucgccggacccaugccugucaccgcugccuccgcugcccagcggcgcggcagaguggggcggaacccgcagaaggaaaaugaccaguacaucuucacgggacaaccccuuaacaaugaugaggaccacgcucauuggacagaagccaagaugcugcuggacaacaucaauaccccugagggcauuauccccgcgcucuucgaaccugagagagagaaaagcgccgcuauugauggggaauaucgccugaagggcgagucucggaaaaccuuuguugaacuuaugagacgcggagaccugcccguguggcucgcccacaaggucgcuuccgagggcaucaaauacacagaucggaaguggugcuucgacgggcagagaaacaaucagauucuggaagagaacauggauguggagaucuggaccaaagaaggagagaagaagaaacugcgcccgcgguggcucgacgccagaacauauagcgauccucuugcccugaaggaauuuaaagacuucgcugcgggccgcaagucuaucgcccuggaucucgucacggagauugggagagugcccucccaccuggcucaucggacccgcaaugcccuugacaaccugguuaugcuccacacaagcgaacauggaggcaaagccuacagacacgcuguggaggagcugccugaaaccauggagacacugcuccuucugggccugaugauccuccugaccgggggagccaugcuuuuucugauuuccggcaaggggaucggaaagacgucuauuggccucaucugugugaucgcgagcuccgggaugcuguggauggccgaaauuccccugcaguggaucgcuagcgccauuguccucgaguucuuuaugaugguucuucugaucccugagcccgaaaaacaacggaccccgcaggauaaucagcuggcuuauguggugauuggaauccucacacuggccgcgauuaucgccgcuaacgagaugggccuucuggaaaccacaaagcgcgaccucggcaugucuaaagagccuggggucgugucccccaccagcuaccuggauguugaccugcaccccgccucugcuuggacgcucuacgccguggcuacaaccgucaucacaccuaugcuuagacauaccauugaaaauagcaccgccaacgugucccuggcggccaucgcuaaccaagccgucgugcugaugggacucgacaagggcuggccgauuucuaaaauggaucuggggguuccccuucuggcucucggaugcuauagccaggugaauccucugacacugacggccgccguccuccuucugaucacccacuacgcgauuaucggccccgggcugcaggcuaaggccacacgggaggcucagaagagaaccgccgccggaaucaugaaaaacccuacaguggacggcauuaugaccaucgaucucgaccccguuauuuaugauuccaaguucgagaaacaacugggccaggugaugcuucugguccucugugcugugcagcugcugcucaugcgcacgucuugggcccuuugcgaagcgcugacacuggccaccgggccuaucaccacacucugggagggaagcccgggcaaguuuuggaauaccacaauugcuguguccauggccaacaucuuccgggggagcuaccuggcuggagccggccuugcguuuucuaucaugaaauccguugggacgggaaagagaggcaccggcagccagggggaaacacugggagagaaguggaaaaagaaacucaaucaacugucccgcaaggaauucgaccuguauaaaaagucuggcauuaccgaggucgaucggacagaggccaaagaagggcucaagagaggagagaucacccaucacgcugugagccggggcuccgccaagcuucagugguuuguggaacgcaacauggucauucccgaggggagaguuaucgaccugggauguggccggggcggguggucuuacuauugcgcuggacugaaaaaggugacggaagugcgcggcuacaccaaagggggaccuggccaugaggagcccgucccuaugagcacauacggguggaauauugugaagcucauguccggaaaagauguuuucuaucugcccccggaaaagugugacacccuucugugcgauaucggcgagagcucuccuucccccacaguggaagagagcagaaccauucggguccucaagaugguggagcccuggcugaaaaacaaucaguucuguaucaagguucugaacccuuacaugcccacagugaucgaacaccucgagcgccuucagagaaaacacggcgggaugcugguccggaauccucugucucgcaacuccacccaugaaauguauuggauuagcaauggaacgggcaacaucguggccucugugaauauggucagcagacuccugcuuaaccgguuuacaaugacccacagacgcccgaccauugagaaggacguugaucugggggcuggaacacggcaugugaacgccgaacccgagacgccuaauauggacgugaucggcgagagaauuaaacgcaucaaggaagagcacaacuccaccuggcacuacgacgaugaaaaucccuauaagacaugggcguaccaugggucuuaugaggucaaagccaccggaagcgcuuccagcaugaucaacggcgugguuaagcuccugacaaaaccuugggacgugguccccauggugacccaaauggccaugacagauaccacgccguucggccagcagcggguuuuuaaggaaaaaguggacaccagaacaccucgcuccaugcccgggacccggagagucaugggaauuacagcugaguggcuguggcgcacccucggccggaauaagaagccuagacugugcacgcgcgaggaauucacaaaaaaggugcggaccaacgccgccaugggggcgguuuuuacagaggaaaaucaaugggauucugcuaaagccgccguggaggacgaagauuucuggaagcuugucgacagagagcgcgagcugcacaaacucggaaaguguggcagcugcguguacaacaugauggggaaaagagaaaagaagcugggcgaguuuggaaaagcuaagggcucccgggccaucugguacauguggcuuggggcucgcuaucuggaauucgaggcccucggauuucugaaugaggaucauugguucucuagagaaaacagcuacuccggcgucgagggggaaggacugcacaaacucggcuauauucugcgggacaucucuaagauucccgggggcgcgauguacgccgaugacaccgcuggaugggacacgagaaucaccgaggaugaccuucauaaugaagagaaaaucacacagcagauggauccugagcaccggcagcuggccaacgcuauuuuuaagcucaccuaucaaaauaaggugguuaaagugcagcgccccacaccgaccggcacagucauggacaucauuagcagaaaggaucagcggggguccggacaggugggcaccuacgggcugaacacguucacaaauauggaagcccaacuuauccgccagauggagggagaaggcgugcugagcaaagcggaccucgagaacccucaccugucugaaaagaaaauuacccaguggcuggagaccaaggggguugagagacucaagcggauggccaucuccggcgaugacugcguggucaaacccaucgaugaccgcuuugcuaacgcccugcuugcucugaaugauaugggaaaggugagaaaagacauuccccaguggcaaccuagcaagggcuggcaugauuggcagcagguuccguucuguucucaccauuuccacgaacucaucaugaaagacgggcggaagcuggugguccccugccgcccucaggacgagcuuauuggaagagcccggaucucccaaggcgcuggguggagccugcgcgaaacagccugucucggaaaggcguaugcccagauguggucucugauguacuuucacagacgggaucugcgccucgcuuccaacgccauuugcagcgccgugcccguccauugggugccuaccuccagaacaacguggagcauccacgcucaucaccaguggaugaccacagaggacaugcugaccguuuggaaucggguguggauugaagauaaccccuggauggaggacaaaacaccugucaccacgugggagaaugugcccuaccuuggcaagagagaagaucaauggugugggucucugaucggccucaccagccgcgccacaugggcgcagaacaucccgaccgcuauucagcagguucggucccugaucggaaaugaggaauuccuugacuauaugccuucuaugaaaagauuucgcaaggaggaggaaagcgagggcgugauuugguga

SEQ ID NO: 20696 - RNA, 9873 nt, Artificial Sequence
  derived and/or modified CDS sequence (opt5) from DENV-3__FJ182004__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccagaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagaugcgcccuguaaaauuccuuucagcacagaggacggccaagggaaggcucauaacggaagacugaucaccgccaaucccguugugacaaaaaaggaggaacccgucaacauugaggccgaaccuccguucggcgaguccaauaucgugauugggaucggcgauaacgcucugaaaaucaauugguauaagaagggaucuagcauuggcaaaauguuugaagccaccgcucggggggccagacgcauggcgauccuuggagacacggccugggauuucggcuccguggggggaguucucaacagccugggcaagaugguccaccagauuuuugggucugcuuacacagcccuguucuccggcgugagcugggugaugaaaaucggaauuggcguccuccugaccuggaucgggcuuaauucuaagaacaccagcauguccuuuucuugcauugcuaucggaaucauuacacuguaucucggcgccgugguucaggcggacaccgggugugugaucaauuggaaaggaaaggagcugaagugcggcagcgggauuuucgucacaaacgaggugcauacguggaccgaacaguacaaauuucaagccgauucccccaagcggcuggcuacagccaucgcuggcgccugggagaauggaguuuguggcauuagaagcaccacacgcauggaaaaccuucucuggaaacagguggccaaugagcugaacuauauccugugggaaaauaacaucaagcucaccgucgugguuggggacauuaucggagugcuggagcagggcaaacggacgcuuaccccucagcccauggagcugaaguacucuuggaaaacaugggggaaggcuaagauugucaccgcggaaacacaaaacuccagcuucaucauugauggaccuaauacccccgagugcccgucugccuccagagcuuggaacgugugggaaguggaggacuauggcuuuggcgucuucacaaccaauaucuggcucaaacugcgcgaaguuuacacgcagcugugugaccaccggcuuaugagcgccgccgugaaggaugagagagcugugcacgccgacaugggguacuggaucgagucccagaaaaacggaucuuggaagcucgaaaaagcgagccugauugaggucaagacaugcaccuggccuaagucccauacccuguggucuaauggcgugcucgaaagcgauaugaucauucccaaaucccuggcugggccuaucagccagcacaacuaucgccccggauaccauacacaaaccgccggcccuuggcaccuugggaagcuggagcucgacuuuaauuauugcgagggaacgacaguugugauuaccgaaaacuguggcacacggggccccucucugagaaccacaaccgucuccgggaaacugauccacgaguggugcugucgcagcugcacgcuuccgccucuccgguacaugggagaagauggcuguugguaugggauggagaucagacccauuucugaaaaggaggagaauauggugaaaucccugguuagcgccggaucuggcaagguggacaacuucaccauggggguccugugccucgcuauccuguuugaagaggugaugcggggaaaguucggcaaaaagcauaugauugccggcguuuucuuuacauucgugcuucugcucagcgggcagaucaccuggcgcgauauggcgcacacacugauuaugaucggauccaaugcuagcgacagaaugggcaugggggucaccuaccuggcccuuauugccacguuuaaaauccagcccuuccuggcucucggauuuuuccugcggaagcucacaucuagagaaaaccugcuucugggcguggggcucgccauggcuaccacacugcaacugccugaggauaucgaacagauggccaauggaauugcgcuuggccugauggcccucaaacugaucacccaguuugagaccuaucagcucuggacagcucugauuucccuuacguguagcaacaccaucuucacacugaccguggccuggcgcacagcuacccucauucuggccggcgucucccugcuuccgguuugccaaucuagcuccaugcggaagucugacuggcugcccaugacgguggccgcuaugggggugccuccccucccucuguuuaucuucagccucaaggauacacugaaaagacgcuccuggccccuuaaugagggagucauggcggugggccugguuucuauccuggccagcucccuccugagaaacgacgugccuauggcugggccccuugucgccggaggccugcucauugccuguuacgugaucaccgggaccagcgcugaucugacaguugaaaaggccgcggacgugaccugggaggaagaggcugaacagacaggagucucucauaaccucaugauuacgguggacgaugacggcaccaugcggaucaaagaugacgagacagagaauauucugaccguccuucugaagacagcccugcucaucguguccggcaucuuuccguacagcauuccugccacccugcuuguuuggcacacguggcagaaacagacccgcagaucuggggugcugugggauguccccuccccucccgaaacacaaaaggcugagcucgaagagggaguguaucggaucaaacagcagggcauuuucgggaagacccagguuggagugggcguccaaaaggaggggguguuucauacaauguggcacgugacccgcggagccguucugacauacaacggcaaaagacucgaaccgaauugggcgagcgucaagaaagaccugaucucuuauggcgggggauggcggcuuuccgcucaguggcagaagggcgaggaagugcaagugauugccgucgagccugggaaaaaccccaagaauuuccagacgaugccuggaaccuuccagacaaccaccggcgaaaucggggccauugcucuggauuuuaagcccggaacaagcggcucccccaucaucaaccgcgagggcaaagugguugggcuguacggaaauggcguggucacgaagaacgggggauaugugagcggcauugcccagaccaaugcugagccugacgggccgacacccgaacucgaggaagagauguucaaaaagagaaaccugaccaucauggaucuucacccuggcucuggaaaaacacggaaguaccugcccgccauuguucgcgaagcgaucaagagacggcucagaacccugauucucgccccuacgcgcguggucgcugccgagauggaggaagcucugaaaggccuucccauccgguaucaaacaaccgccaccaagagcgagcauacagggagagaaaucguggaccugaugugccacgccaccuuuacaaugcgccugcucuccccuguucgggugccgaauuacaaccugauuaucauggaugaggcucauuucaccgaccccgcgucuauugccgcuagaggauacaucagcacgcgcgucggcaugggggaagccgccgcuauuuuuaugacagccaccccucccggaacagcggaugcuuucccucaguccaaugcccccauccaggacgaggagcgggacaucccggaaagaucuuggaacagcggcaaugaguggauuaccgauuuugccgggaaaacggugugguucgugccuuccaucaaggcuggcaacgacauugccaacugucuucgcaaaaauggaaagaaggucauccagcugucucggaaaaccuuugauacagaauaucaaaagaccaaacucaacgacugggauuucguugugacaaccgacauuagcgagaugggcgcgaauuuuaaggccgauagagugaucgacccccggcgcugccugaaacccgucauucugacagaugggccugagagagugauccucgcuggacccaugccuguuaccgccgcuuccgccgcucagcggcgcggcagaguggggcggaacccgcagaaggaaaaugaccaguacaucuucacgggacaaccccuuaacaaugaugaggaccacgcccauuggacagaagcgaagaugcugcuggacaacauuaauaccccugagggcaucauucccgcccucuucgaaccugagagagagaaaagcgcugccaucgauggggaauaucgccugaagggcgagucucggaaaaccuuugucgaacuuaugagacgcggagaccugcccguguggcucgcucacaagguugccuccgagggcauuaaauacacagaucggaaguggugcuucgacgggcagagaaacaaucagauccuggaagagaacauggauguggagaucuggaccaaagaaggagagaagaagaaacugcgcccgcgguggcucgacgccagaacauauagcgauccucuugcucugaaggaauuuaaagacuucgcggccggccgcaagucuauugcucuggaucucgucacggagaucgggagagugcccucccaccuggcccaucggacccgcaaugcccuugacaaccuggucaugcuccacacaagcgaacauggaggcaaagcuuacagacacgccguggaggagcugccugaaaccauggagacacugcuccuucugggccugaugauucuccugaccgggggagcgaugcuuuuucugaucuccggcaaggggauuggaaagacgucuaucggccucaucuguguuauugccagcuccgggaugcuguggauggcugaaaucccccugcaguggauugccagcgcuaucgugcucgaguucuuuaugauggugcuucugauuccugagcccgaaaaacaacggaccccgcaggauaaucagcuggccuaugucguuaucggaauucucacacuggcggccaucaucgcugccaacgagaugggccuucuggaaaccacaaagcgcgaccucggcaugucuaaagagccugggguggugucccccaccagcuaccuggaugucgaccugcaccccgcuucugccuggacgcucuacgcuguggccacaaccguuauuacaccuaugcuuagacauaccaucgaaaauagcaccgcgaacgugucccuggccgcuauugccaaccaagcugucgugcugaugggacucgacaagggcuggccgaucucuaaaauggaucugggggucccccuucuggcccucggaugcuauagccaggugaauccucugacacugacggccgcgguucuccuucugauuacccacuacgcuaucaucggccccgggcugcaggccaaggcuacacgggaggcccagaagagaaccgccgcuggaauuaugaaaaacccuacaguggacggcaucaugaccauugaucucgaccccgucaucuaugauuccaaguucgagaaacaacugggccaggugaugcuucugguucucugugccgugcagcugcugcucaugcgcacgucuugggcgcuuugcgaagcccugacacuggcuaccgggccuauuaccacacucugggagggaagcccgggcaaguuuuggaauaccacaaucgccgucuccauggcuaacaucuuccgggggagcuaccuggccggagcgggccuugccuuuucuauuaugaaauccguggggacgggaaagagaggcaccggcagccagggggaaacacugggagagaaguggaaaaagaaacucaaucaacugucccgcaaggaauucgaccuguauaaaaagucuggcaucaccgagguggaucggacagaggcuaaagaagggcucaagagaggagagauuacccaucacgccguuagccggggcuccgcuaagcuucagugguuugucgaacgcaacauggugauccccgaggggagagugauugaccugggauguggccggggcggguggucuuacuauugcgccggacugaaaaaggucacggaaguucgcggcuacaccaaagggggaccuggccaugaggagcccgugccuaugagcacauacggguggaauaucgugaagcucauguccggaaaagaugucuucuaucugcccccggaaaagugugacacccuucugugcgauauuggcgagagcucuccuucccccacaguggaagagagcagaaccauccggguucucaagaugguggagcccuggcugaaaaacaaucaguucuguaucaagguccugaacccuuacaugcccacagugauugaacaccucgagcgccuucagagaaaacacggcgggaugcugguucggaauccucugucucgcaacuccacccaugaaauguauuggaucagcaauggaacgggcaacauuguggcuucugucaauauggugagcagacuccugcuuaaccgguuuacaaugacccacagacgcccgaccaucgagaaggacguggaucugggggccggaacacggcaugucaacgcggaacccgagacgccuaauauggacguuauuggcgagagaaucaaacgcaucaaggaagagcacaacuccaccuggcacuacgacgaugaaaaucccuauaagacaugggccuaccaugggucuuaugaggugaaagcuaccggaagcgccuccagcaugauuaacggcguggucaagcuccugacaaaaccuugggacgugguucccauggugacccaaauggcuaugacagauaccacgccguucggccagcagcgggucuuuaaggaaaaaguggacaccagaacaccucgcuccaugcccgggacccggagaguuaugggaaucacagccgaguggcuguggcgcacccucggccggaauaagaagccuagacugugcacgcgcgaggaauucacaaaaaaggugcggaccaacgccgcgaugggggcugucuuuacagaggaaaaucaaugggauucugccaaagccgcuguggaggacgaagauuucuggaagcuuguugacagagagcgcgagcugcacaaacucggaaaguguggcagcugcguguacaacaugauggggaaaagagaaaagaagcugggcgaguuuggaaaagccaagggcucccgggcuauuugguacauguggcuuggggcccgcuaucuggaauucgaggcgcucggauuucugaaugaggaucauugguucucuagagaaaacagcuacuccggcgucgagggggaaggacugcacaaacucggcuauauccugcgggacauuucuaagauccccgggggcgccauguacgcugaugacaccgccggaugggacacgagaaucaccgaggaugaccuucauaaugaagagaaaauuacacagcagauggauccugagcaccggcagcuggcuaacgccaucuuuaagcucaccuaucaaaauaagguggucaaagugcagcgccccacaccgaccggcacaguuauggacauuaucagcagaaaggaucagcggggguccggacaggugggcaccuacgggcugaacacguucacaaauauggaagcgcaacuuauucgccagauggagggagaaggcguccugaccaaagccgaccucgagaacccucaccugagcgaaaagaaaaucacccaguggcuggagacaaaggggguggagagacucaagcggauggcuaucucuggcgaugacugcgugguuaaacccauugaugaccgcuuugccaacgcucugcuugcccugaaugauaugggaaaggugagaaaagacaucccccaguggcaaccuuccaagggcuggcaugauuggcagcaggucccguucuguagccaccauuuccacgaacucauuaugaaagacgggcggaagcuggugguucccugccgcccucaggacgagcuuaucggaagagcucggauuucucaaggcgccggguggucccugcgcgaaaccgcgugucucggaaaggccuaugcucagauguggagccugauguacuuucacagacgggaucugcgccucgccucuaacgccaucugcuccgcugugcccguccauugggugccuacaagcagaacgaccugguccauucacgcccaucaccaguggaugacaaccgaggacaugcugacagucuggaaucggguguggaucgaagauaaccccuggauggaggacaaaaccccuguuacgaccugggagaaugugcccuaccuuggcaagagagaagaucaauggugugggagccugaucggccucacaucucgcgcgaccugggcucagaacauuccgacagccauccagcagguccggagccugauuggaaaugaggaauuccuugacuauaugccuuccaugaaaagauuucgcaaggaggaggaaucugagggcgccaucugguga

SEQ ID NO: 20697 - RNA, 9873 nt, Artificial Sequence
  derived and/or modified CDS sequence (opt5) from DENV-3__FJ024465__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacacuuauugcuauggaucugggggaaaugugcgacgauacagugaccuacaaauguccgcauaucgccgaaguugaacccgaagacauugauugcugguguaaccucacauccaccugggugacauauggaaccugcaaucaggccggcgagcaccggcgggacaagcgcucuguggcucuggccccucaugucgggaugggacuggauacgagaacccagacauggaugagcgcugagggcgccuggagacagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccaaaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucaccaagaaagaggaacccgugaacauugaggccgaaccuccguucggcgaguccaauaucgugauugggaucggcgauaacgcccugaaaaucaauugguauaagaagggaucuagcauuggcaaaauguuugaagcuaccgccagaggggcuagacgcauggccauccuuggagacacggcgugggauuucggcuccguugggggaguccucaacagccugggcaagauggugcaccagauuuuugggucugccuacacagcucuguucuccggcgugagcugggucaugaaaaucggaauuggcgugcuccugaccuggaucgggcuuaauucuaagaacaccagcauguccuuuucuugcauugccaucggaaucauuacacuguaucucggcgcuguugugcaggccgacaccgggugugucaucaauuggaaaggaaaggagcugaagugcggcagcgggauuuucgugacaaacgagguucauacguggaccgaacaguacaaauuucaagcggauucccccaagcggcuggccacagcuaucgccggcgcuugggagaauggaguguguggcauuagaagcaccacacgcauggaaaaccuucucuggaaacagaucgccaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgcugaaacacaaaacuccagcuucauuaucgauggaccuaauacccccgagugcccgucugcguccagagccuggaacgugugggaaguggaggacuauggcuuuggcgucuucacaaccaauaucuggcucaaacugcgcgaaguuuacacgcagcugugugaccaccggcuuaugagcgcugccgugaaggaugagagagccgugcacgcugacaugggguacuggauugagucccagaaaaacggaucuuggaagcucgaaaaagccagccugaucgaggucaagacaugcaccuggccuaagucccauacccuguggucuaauggcgugcucgaaagcgauaugauuauccccaaaucccuggcggggccuauuagccagcacaacuaucgccccggauaccauacacaaaccgcuggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgccggaucuggcaagguggacaacuucaccauggggguccugugccucgccauucuguuugaagaggugaugcggggaaaguucggcaaaaagcauaugaucgcuggcguuuucuuuacauucgugcuucugcucagcgggcagauuaccuggcgcgauauggcccacacacugaucaugauuggauccaaugcgagcgacagaaugggcaugggggucaccuaccuggcucuuaucgccacguuuaaaauccagcccuuccuggcccucggauuuuuccugcggaagcucacaucuagagaaaaccugcuucugggcguggggcucgcuauggccaccacacugcaacugccugaggauauugaacagauggcuaauggaaucgcccuuggccugauggcgcucaaacugauuacccaguuugagaccuaucagcucuggacagcccugaucucccuuacguguagcaacaccauuuucacacugaccguggcuuggcgcacagccacccucauccuggcuggcgucucccugcuuccgguuugccaaucuagcuccaugcggaagucugacuggcugcccaugacgguggccgccaugggggugccuccccucccucuguuuaucuucagccucaaggauacacugaaaagacgcuccuggccccuuaaugagggagucauggcugugggccugguuucuauucuggcgagcucccuccugagaaacgacgugccuauggccgggccccuugucgcuggaggccugcucaucgccuguuacgugauuaccgggaccagcgccgaucuggcuguugaaaaggccgcggacgugacaugggaggaagaggcugaacagaccggagucucucauaaccucaugaucacaguggacgaugacggcacgaugcggauuaaagaugacgagaccgagaauauccugacaguccuucugaagaccgcccugcucaucguguccggcauuuuuccguacagcaucccugccacacugcuuguuuggcacaccuggcagaaacagacgcaacgcucuggggugcugugggauguccccuccccucccgaaacccagaaggcugagcucgaagagggaguguauagaauuaaacagcagggcaucuucgggaagacacaaguuggagugggcguccagaaggaggggguguuucauaccauguggcacgugacacggggagccguucugaccuacaacggcaaacgccucgaaccgaauugggcgagcgucaagaaagaccugauuucuuauggcgggggauggagacuuuccgcucaguggcaaaagggcgaggaaguccaggugaucgccgucgagccugggaaaaaccccaagaauuuccagacaaugccuggaacguuccagaccacaaccggcgaaauuggggccaucgcucuggauuuuaagcccggaaccagcggcucccccaucauuaaccgggagggcaaagugguugggcuguacggaaauggcguggucacaaagaacgggggauaugugagcggcaucgcccaaacgaaugcugagccugacgggccgacccccgaacucgaggaagagauguucaaaaagcgcaaccugacaauuauggaucuucacccuggcucuggaaaaaccagaaaguaccugcccgccaucguucgggaagcgauuaagcgcagacuccggacacugauccucgccccuaccagaguggucgcugccgagauggaggaagcucugaaaggccuucccauccgcuaucagacgacagccaccaagagcgagcauaccgggcgggaaauuguggaccugaugugccacgccacauuuaccaugagacugcucuccccuguucgcgugccgaauuacaaccugaucauuauggaugaggcucauuucacagaccccgcgucuaucgccgcucggggauacauuagcaccagagucggcaugggggaagccgccgcuaucuuuaugacggccacaccucccggaaccgcggaugcuuucccucaguccaaugcccccauccaggacgaggagcgcgacauuccggaacggucuuggaacagcggcaaugaguggaucacagauuuugccgggaaaaccgugugguucgugccuuccauuaaggcuggcaacgacaucgccaacugucuucgcaaaaauggaaagaaggucauucaacugucuagaaaaacguuugauaccgaauaucagaagacaaaacucaacgacugggauuucguugugaccacagacaucagcgagaugggcgcgaauuuuaaggccgaucgggugauugaccccagacggugccugaaacccgucauccugaccgaugggccugagcgcgugauccucgcuggacccaugccuguuacagccgcuuccgccgcucagagacggggccgcguggggagaaacccgcagaaggaaaaugaccaauacauuuucaccggacagccccuuaacaaugaugaggaccacgcccauuggacggaagcgaagaugcugcuggacaacaucaauacaccugagggcauuauccccgcccucuucgaaccugagcgggagaaaagcgcugccauugauggggaauauagacugaagggcgagucucgcaaaaccuuugucgaacuuaugcggagaggagaccugcccguguggcucgcucacaagguugccuccgagggcaucaaauacaccgaucgcaaguggugcuucgacgggcagcggaacaaucagauccuggaagagaacauggauguggagauuuggacaaaagaaggagagaagaagaaacugagaccgcgcuggcucgacgcccggaccuauagcgauccucuugcucugaaggaauuuaaagacuucgcggccggcagaaagucuaucgcucuggaucucgucacagagauugggcgcgugcccucccaccuggcccauagaacgcggaaugcccuugacaaccuggucaugcuccacaccagcgaacauggaggcaaggcuuaccgccacgccguggaggagcugccugaaacaauggagacccugcuccuucugggccugaugauccuccugacagggggagcgaugcuuuuucugauuuccggcaaggggaucggaaagaccucuaucggccucauuuguguuaucgccagcuccgggaugcuguggauggcugaaauuccccugcaauggaucgccagcgcuauugugcucgaguucuuuaugauggugcuucugaucccugagcccgaaaaacagagaacgccgcaggauaaucaacuggccuaugucguuauuggaauccucacccuggcggccaucauugcugccaacgagaugggccuucuggaaacaaccaagcgggaccucggcaugucuaaagagccugggguggugucccccacaagcuaccuggaugucgaccugcaccccgcuucugccuggacccucuacgcuguggccacgacaguuaucaccccuaugcuucgccauacaauugaaaauagcaccgcgaacgugucccuggccgcuaucgccaaccaggcugucgugcugaugggacucgacaagggcuggccgauuucuaaaauggaucugggggucccccuucuggcccucggaugcuauagccaggugaauccucugacccugacagccgcgguucuccuucugaucacgcacuacgcuaucauuggccccgggcugcaggccaaggcuaccagagaggcccaaaagcggacagccgcuggaaucaugaaaaacccuaccguggacggcauuaugacaaucgaucucgaccccgucauuuaugauuccaaguucgagaaacagcugggccaggugaugcuucugguucucugugccgugcagcugcugcucaugagaaccucuugggcgcuuugcgaagcccugacgcuggcuacagggccuaucaccacccucugggagggaagcccgggcaaguuuuggaauacaaccaucgccgucuccauggcuaacauuuuccgcgggagcuaccuggccggagcgggccuugccuuuucuaucaugaaauccguggggacaggaaagcggggcacgggcagccaaggggaaacccugggagagaaguggaaaaagaaacucaaucagcuguccagaaaggaguucgaccuguauaaaaagucuggcauuacagagguggaucgcaccgaggcuaaagaagggcucaagcggggagagaucacacaucacgccguuagcagaggcuccgcuaaacuucagugguuugucgaacggaacauggugauucccgaggggcgcgugaucgaccugggauguggcagaggcggguggucuuacuauugcgccggacugaaaaaggucaccgaaguucggggcuacacgaaagggggaccuggccaugaggagcccgugccuaugagcaccuacggguggaauauugugaagcucauguccggaaaagaugucuucuaucugcccccggaaaagugugacacacuucugugcgauaucggcgagagcucuccuucccccaccguggaagagagccgcacaaucagaguucucaagaugguggagcccuggcugaaaaacaaucaguucuguauuaagguccugaacccuuacaugcccaccgugaucgaacaccucgagcggcuucaacgcaaacacggcgggaugcugguuagaaauccucugucucggaacuccacacaugaaauguauuggauuagcaauggaaccggcaacaucguggcuucugucaauauggugagccgccuccugcuuaacagauuuacgaugacacaccggagaccgaccauugagaaggacguggaucugggggccggaacccgccaugucaacgcggaacccgagacaccuaauauggacguuaucggcgagcggaucaaaagaauuaaggaagaacacaacuccacguggcacuacgacgaugaaaaucccuauaagaccugggccuaccaugggucuuaugaggugaaagcuacaggaagcgccuccagcaugaucaacggcguggucaagcuccugaccaaaccuugggacgugguucccacagugacccagauggcuaugacagauaccacgccguucggccagcaacgcgucuuuaaggaaaaaguggacacccggacaccuagauccaugcccgggacccgccggguuaugggaauuacagccgaguggcuguggagaacccucggccgcaauaagaagccucggcugugcacgagagaggaguucaccaagaaggugcgcaccaacgccgcgaugggggcugucuuuacagaggaaaaucagugggauucugccaaagccgcuguggaggacgaagauuucuggaaacuuguugaccgggagagagagcugcacaaacucggaaaguguggcagcugcguguacaacaugauggggaaacgcgaaaagaagcugggcgaguuuggaaaagccaagggcuccagagcuaucugguacauguggcuuggggcccgguaucuggaguucgaggcgcucggauuucugaaugaggaucauugguucucucgcgaaaacagcuacuccggcgucgagggggaaggacugcacaaacucggcuauauucugagagacaucucuaagauccccgggggcgccauguacgcugaugacaccgccggaugggacacgcggauuaccgaggaugaccuucauaaugaagagaaaaucacacagcagauggauccugagcacagacaacuggcuaacgccauuuuuaagcucaccuaucagaauaagguggucaaagugcagcggcccacaccgaccggcacaguuauggacaucauuagccgcaaggaucagagaggguccggacaagugggcaccuacgggcugaacacguucacaaauauggaagcgcagcuuauccggcagauggagggagaaggcguccugagcaaagccgaccucgagaacucucaccuguccgaaaagaaaaucacccaguggcuggagaccaaggggguggagcgccucaagagaauggcuauuagcggcgaugacugcgugguuaaaccuaucgaugaccgguuugccaacgcucugcuugcccugaaugauaugggaaaggugcgcaaagacauuccccaauggcagcccucuaagggcuggcaugauuggcagcaggucccuuucuguucccaccauuuccacgaacucaucaugaaagacgggagaaagcuggugguuccgugccggccccaagacgagcuuauuggacgcgcuagaaucagccagggcgccggguggucucugcgggaaacagcgugucucggaaaggccuaugcucagauguggucccugauguacuuucaccgcagagaucugcggcucgccagcaacgccauuugcuccgcugugccuguccauugggugcccaccagccgcacaacguggucuauccacgcccaucaccaauggaugaccacagaggacaugcugaccgucuggaauagaguguggaucgaagauaacccuuggauggaggacaaaacacccguuaccacgugggagaaugugccuuaccuuggcaagcgggaagaucaguggugugggagccugauuggccucaccuccagagcgacaugggcucagaacauccccaccgccauucagcaaguccgcucucugaucggaaaugaggaguuccuugacuauaugccgagcaugaaacgguuuagaaaggaggaggaauccgagggcgccauuugguga

SEQ ID NO: 20698 - RNA, 9873 nt, Artificial Sequence
  derived and/or modified CDS sequence (opt5) from DENV-3__FJ024466__SS-prME
accagccugugccucaugaugauccugcccgccgcucuugccuuccaccugacaucccgggacggcgagccucggaugauuguggggaagaacgaacgcggaaaaucucuccuguuuaagacggcgagcggcaucaauauguguacccuuauugcuauggaucugggggagaugugcgacgauacagugaccuacaaauguccgcauaucgccgaaguugagcccgaagacauugauugcugguguaaccucacauccaccugggugacauauggaaccugcaaucaggccggcgagcaccggcgggacaagcgcucuguggcucuggccccucaugucgggaugggacuggauacgagaacccagacauggaugagcgcugagggcgccuggagacagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccaaaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagaugcgcccuguaaaauuccuuucagcacagaggacggccaagggaaggcucauaacggaagacugaucaccgccaaucccguugugaccaagaaggaggaacccgucaacauugaggccgaaccuccguucggcgaguccaauaucgugauugggaucggcgauaacgcucugaaaaucaauugguauaagaagggaucuagcauuggcaaaauguuugaagccaccgcuagaggggccagacgcauggcgauccuuggagacacggccugggauuucggcuccgucgggggaguucucaacagccugggcaagaugguccaccagauuuuugggucugcuuacacagcccuguucuccggcgugagcugggugaugaaaaucggaauuggcguccuccugaccuggaucgggcuuaauucuaagaacaccagcauguccuuuucuugcauugcuaucggaaucauuacacuguaucucggcgccgugguucaggcggacaccgggugugugaucaauuggaaaggaaaggagcugaagugcggcagcgggauuuucgucacaaacgaggugcauacguggaccgaacaguaccgguuucaagccgauucccccaaaagacuggcuacagccaucgcuggcgccugggagaauggaguuuguggcauucgcagcaccacacggauggaaaaccuucucuggaagcagaucgccaaugagcugaacuauauccugugggaaaauaacauuaaacucaccguggucgugggggacaucauuggaguucuggagcagggcaagagaacgcuuaccccucagcccauggagcugaaauacucuuggaagacaugggggaaagcuaagaucgugaccgcggaaacacaaaacuccagcuucauuaucgauggaccuaauacccccgagugcccgucugccucccgcgcuuggaacgucugggaaguggaggacuauggcuuuggcguguucacaaccaauaucuggcucaagcugcgggaagucuacacgcagcugugugaccacagacuuaugagcgccgccguuaaagaugagcgcgcugugcacgccgacaugggguacuggauugagucccagaagaacggaucuuggaaacucgaaaaggcgagccugaucgaggugaaaacaugcaccuggccuaagucccauacccuguggucuaauggcguccucgaaagcgauaugauuauccccaagucccuggcugggccuauuagccagcacaacuaucggcccggauaccauacacaaaccgccggcccuuggcaccuugggaaacuggagcucgacuuuaauuauugcgagggaacgacagugguuaucaccgauaacuguggcacaagaggccccucucugcgcaccacaaccguguccgggaagcugauccacgaauggugcugucggagcugcacgcuuccgccucucagauacaugggagaggacggcuguugguaugggauggaaauucggcccaucucugagaaagaagagaauauggucaagucccuggugagcgccggaucuggcaaaguugauaacuucaccaugggggugcugugccucgcuauucuguuugaggaagucaugcgcggaaaguucggcaagaaacauaugaucgccggcguguucuuuacauucguucuucugcucagcgggcagauuaccuggagagacauggcgcacacacugaucaugauuggauccaaugcuagcgaucggaugggcaugggggugaccuaccuggcccuuaucgccacguuuaagauccagcccuuccuggcucucggauuuuuccugagaaaacucacaucucgcgagaaccugcuucugggcgucgggcucgccauggcuaccacacugcaacugccugaagacauugagcagauggccaauggaaucgcgcuuggccugauggcccucaagcugauuacccaguuugaaaccuaucagcucuggacagcucugaucucccuuacguguagcaacaccauuuucacacugaccguggccuggcggacagcuacccucauccuggccggcgugucccugcuuccggucugccaaucuagcuccaugagaaaaucugauuggcugcccaugacgguugccgcuaugggggugccuccccucccucuguuuaucuucagccucaaggacacacugaagcgcagauccuggccccuuaaugagggagugauggcggucggccuggugucuauucuggccagcucccuccugcggaacgauguuccuauggcugggccccuuguggccggaggccugcucaucgccuguuacgucauuaccgggaccagcgcugaccugacaguggagaaagccgcggacguuaccugggaagaggaagcugagcagacaggagugucucauaaccucaugaucacggucgaugacgauggcaccaugcgcauuaaggacgaugaaacagagaauauccugaccgugcuucugaaaacagcccugcucaucgucuccggcauuuuuccguacagcaucccugccacccugcuuguguggcacacguggcagaagcagaccagacggucugggguucugugggacgugcccuccccucccgagacacaaaaagcugaacucgaggaaggagucuaucgcauuaagcagcagggcaucuucgggaaaacccaggugggaguuggcgugcaaaaggagggggucuuucauacaauguggcacgugaccagaggagccgugcugacauacaacggcaagcggcucgagccgaauugggcgagcguuaaaaaggaucugauuucuuauggcgggggauggcgccuuuccgcucaguggcagaaaggcgaagagguccaagugaucgccguggaaccugggaagaaccccaaaaauuuccagacgaugccuggaaccuuccagacaaccaccggcgagauuggggccaucgcucuggacuuuaagcccggaacaagcggcucccccaucauuaacagagaaggcaaggucguggggcuguacggaaauggcguugugacgaaaaacgggggauaugucagcggcaucgcccagaccaaugcugagccugaugggccgacacccgagcucgaagaggaaauguucaagaaacggaaccugaccauuauggaccuucacccuggcucuggaaagacacgcaaauaccugcccgccaucgugagagaggcgauuaagcggagacuccgcacccugauccucgccccuacgcggguuguggcugccgaaauggaggaggcucugaagggccuucccaucagauaucaaacaaccgccaccaaaagcgaacauacagggcgcgagauugucgaucugaugugccacgccaccuuuacaaugcggcugcucuccccugugagaguuccgaauuacaaccugaucauuauggacgaagcucauuucaccgaucccgcgucuaucgccgcucgcggauacauuagcacgcgggugggcaugggggaggccgccgcuaucuuuaugacagccaccccucccggaacagcggacgcuuucccucaguccaaugcccccauccaggacgaagagagagauauuccggagcgcucuuggaacagcggcaaugaauggaucaccgacuuugccgggaagacggucugguucgugccuuccauuaaagcuggcaacgauaucgccaacugucuucggaagaauggcaaaaaggugauucagcugucuagaaagaccuuugacacagaguaucagaagacaaagcucaacgauugggacuucgucguuacaaccgauaucagcgaaaugggagcgaauuuuaaagccgaccgggugauugauccccgcagaugccugaagcccgugauccugacagacgggccugagcgggucauccucgcuggacccaugccugugaccgccgcuuccgccgcucagcgcagaggccggguugggagaaacccgcagaaagagaaugaucaguacauuuucacgggacaaccccuuaacaaugacgaagaccacgcccauuggacagaggcgaagaugcugcuggauaacaucaauaccccugaaggcauuauccccgcccucuucgagccugaacgcgaaaagagcgcugccauugacggggaguaucggcugaaaggcgaaucuagaaagaccuuuguggagcuuaugcgccggggagaucugcccgucuggcucgcucacaaaguggccuccgaaggcaucaaguacacagacagaaaauggugcuucgaugggcagcgcaacaaucagauccuggaggaaaacauggacguugagauuuggaccaaggagggagagaaaaagaagcugcggccgagauggcucgaugcccgcacauauagcgacccucuugcucugaaagaguuuaaggauuucgcggccggcagaaaaucuaucgcucuggaccucgugacggaaauugggcggguccccucccaccuggcccaucgcaccagaaaugcccuugauaaccuggugaugcuccacacaagcgagcauggaggcaaggcuuaccggcacgccgucgaagaacugccugagaccauggaaacacugcuccuucugggccugaugauccuccugaccgggggagcgaugcuuuuucugauuuccggcaaagggaucggaaagacgucuaucggccucauuugugugaucgccagcuccgggaugcuguggauggcugagauuccccugcaguggaucgccagcgcuauuguucucgaguucuuuaugauggugcuucugaucccugagcccgagaagcaacgcaccccgcaggacaaucagcuggccuauguggucauuggaauccucacacuggcggccaucauugcugccaacgaaaugggccuucuggagaccacaaaaagagaucucggcaugucuaaggaaccugggguugugucccccaccagcuaccuggacguggaccugcaccccgcuucugccuggacgcucuacgcugucgccacaaccgugaucacaccuaugcuucggcauaccauugagaauagcaccgcgaacguuucccuggccgcuaucgccaaccaagcugugguccugaugggacucgauaaaggcuggccgauuucuaagauggaccugggggugccccuucuggcccucggaugcuauagccaggucaauccucugacacugacggccgcggugcuccuucugaucacccacuacgcuaucauuggccccgggcugcaggccaaagcuacaagagaagcccagaagcgcaccgccgcuggaaucaugaagaacccuacaguugauggcauuaugaccaucgaccucgaucccgugauuuaugacuccaaauucgagaagcaacugggccaggucaugcuucuggugcucugugccguucagcugcugcucaugcggacgucuugggcgcuuugcgaggcccugacacuggcuaccgggccuaucaccacacucugggaaggaagcccgggcaaauuuuggaauaccacaaucgccguguccauggcuaacauuuucagagggagcuaccuggccggagcgggccuugccuuuucuaucaugaaguccgucgggacgggaaaacgcggcaccggcagccagggggagacacugggagaaaaguggaagaaaaagcucaaucaacugucccggaaagaguucgaucuguauaagaaaucuggcauuaccgaaguggacagaacagaggcuaaggaggggcucaaacggggagaaaucacccaucacgccgugagccgcggcuccgcuaaacuucagugguuuguugagagaaacauggucauucccgaagggcgggugaucgaucugggauguggccgcggcggguggucuuacuauugcgccggacugaagaaagugacggaggucagaggcuacaccaaagggggaccuggccaugaggaacccguuccuaugagcacauacggguggaauauugugaaacucauguccggaaaggacguguucuaucugcccccggagaaaugugauacccuucugugcgacaucggcgaaagcucuccuucccccacagucgaggaaagccggaccauccgcgugcucaagaugguugagcccuggcugaagaacaaucaguucuguauuaaagugcugaacccuuacaugcccacagucaucgagcaccucgaaagacuucagcggaagcacggcgggaugcuggugcgcaauccucugucuagaaacuccacccaugagauguauuggauuagcaauggaacgggcaacaucguugcuucugugaauauggucagccggcuccugcuuaacagauuuacaaugacccaccgccggccgaccauugaaaaagauguggaccugggggccggaacaagacaugugaacgcggagcccgaaacgccuaauauggacgucaucggcgagcgcaucaagcggauuaaagaggaacacaacuccaccuggcacuacgaugacgagaaucccuauaagacaugggccuaccaugggucuuaugaaguuaaggcuaccggaagcgccuccagcaugaucaacggcguggugaaacuccugacaaagccuugggaugucgugcccaugguuacccaaauggcuaugacagacaccacgccguucggccagcagagaguguuuaaagagaaggucgauacccgcacaccucgguccaugcccgggaccagacgcgugaugggaauuacagccgaauggcuguggcggacccucggcagaaauaaaaagccucgccugugcacgcgggaggaguucacaaagaaaguuagaaccaacgccgcgaugggggcuguguuuacagaagagaaucaaugggacucugccaaggccgcugucgaagaugaggacuucuggaaacuuguggaucgcgaaagagagcugcacaagcucggaaaauguggcagcugcguuuacaacaugauggggaagcgggagaaaaagcugggcgaauuuggaaaggccaaaggcucccgcgcuaucugguacauguggcuuggggccagauaucuggaguucgaagcgcucggauuucugaaugaggaccauugguucucucgggagaacagcuacuccggcguggaaggggagggacugcacaagcucggcuauauucugagagauaucucuaaaauccccgggggcgccauguacgcugacgacaccgccggaugggauacgcggauuaccgaagacgaucuucauaaugaggaaaagaucacacaccagauggacccugagcaccgccagcuggcuaacgccauuuuuaaacucaccuaucagaauaaggucgugaagguccaaagacccacaccgaccggcacagugauggauaucauuagccggaaagaccagcgcggguccggacagguuggcaccuacgggcugaacacguucacaaauauggaggcgcagcuuaucagacaaauggaaggagagggcgugcugagcaaggccgaucucgaaaacccucaucugucugagaaaaagaucacccaguggcuggaaaccaaaggggucgagcggcucaagcgcauggcuauuuccggcgacgauugcguggugaagcccaucgacgauagauuugccaacgcucugcuugcccugaaugacaugggaaaaguucggaaggauauuccccaguggcagccuagcaaaggcuggcacgacuggcaacaggugccguucuguucucaucacuuccacgagcucaucaugaaggacgggcgcaaacuggucgugcccugcagaccucaggaugaacuuauuggacgggcucgcaucucccagggcgccggguggagccugagagagacagcgugucucggaaaggccuaugcucaaauguggucucugauguacuuucaucggcgcgaccugagacucgccuccaacgccauuugcagcgcuguucccgugcacugggucccuaccucccggacaacguggagcauccaugcccaccaucaguggaugaccacagaagauaugcugaccguguggaauagagucuggaucgaggacaaccccuggauggaagauaagacaccugugaccacgugggagaauguucccuaccuuggcaaacgcgaggaccaguggugugggucucugauuggccucaccagccgggcgacaugggcucaaaacaucccgaccgccauucaacaggugagaucccugaucggaaaugaagaguuccuugauuauaugccuucuaugaagcgcuuucggaaagaagaggagagcgaaggcgccauuugguga

SEQ ID NO: 20699 - RNA, 9873 nt, Artificial Sequence
  derived and/or modified CDS sequence (opt5) from DENV-3__FJ024467__SS-prME
accagccugugccucaugauggugcugcccgccgcucuugccuuccaccugacauccagagacggcgagccucggaugaucgucgggaagaacgaacgcggaaaaucucuccuguuuaagacggcgagcggcauuaauauguguacccuuaucgcuauggaucugggggagaugugcgacgauacaguuaccuacaaauguccgcauauuacagaaguggagcccgaagacaucgauugcugguguaaccucaccuccacaugggugaccuauggaacgugcaaucaggccggcgagcacagacgggacaagcgcucugucgcccuggcuccucauguggggaugggacuggauaccagaacacaaaccuggaugagcgccgagggcgcuuggcggcagguugaaaaaguggagacaugggcccuccgccaccccggcuucaccauucuggcgcuuuuucuggcccauuacaucgggacgucccucacacagaaggucgugaucuucauucugcuuaugcugguuaccccuucuaugacaaugagaugugugggagucggcaaccgggacuuuguggaagggcucagcggagcuaccuggguggaugucguucuggagcacggcgggugcgugaccacaauggccaagaauaaacccacgcuggacaucgagcuccagaagaccgaagcuacacaacuggccacccuucgcaaacuguguauugagggaaagaucacaaacauuaccacggauuccagaugcccuacacagggcgaagcggugcucccggaggaacaggaccagaauuaugucuguaaacacaccuacguggaucggggcugggggaacggaugcggccuguucgggaagggaagccuuguuaccugcgccaaguuucaaugucuggagcccaucgagggcaaagugguccaguaugaaaaucucaaguacacagugauuaucaccguucauacaggggaccagcaccaggugggaaacgagacgcaaggcgucaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaagugguugugcucgggucucaggagggagccaugcacaccgcucugacaggcgccaccgaaauucagaauuccgggggcaccagcaucuucgccggacaucugaagugucgccucaaaauggacaagcuggagcuuaaaggcaugucuuacgcuaugugcacaaacacguuuguccugaagaaagagguguccgaaacccagcacgggacaauucucaucaagguugaguacaagggagaagaugcccccuguaaaaucccuuucagcaccgaggacggccaagggaaggcgcauaacggaagacugauuacagcuaaucccguggucaccaaaaaggaggaacccgugaacaucgaggccgaaccuccguucggcgaguccaauauugugaucgggauuggcgauaacgcccugaaaaucaauugguauaagaagggaucuagcaucggcaaaauguuugaagcuacggcccggggggcuagacgcauggccauucuuggagacacagcgugggauuucggcuccguugggggaguccucaacagccugggcaagauggugcaccagaucuuugggucugccuacaccgcucuguucuccggcgugagcugggucaugaaaauuggaaucggcgugcuccugaccuggauugggcuuaauucuaagaacacaagcauguccuuuucuugcaucgccauuggaguuaucacccuguaucucggcgcugugguccaggccgacauggggugugugaucaauuggaaaggaaaggagcugaagugcggcagcgggauuuucguuacaaacgaggugcauacguggaccgaacaguacaaauuucaagcggauucccccaagcggcuggccacagcuaucgccggcgcuugggagaauggagucuguggcauuagaagcaccacacgcauggaaaaccuucucuggaaacagaucgccaaugagcugaacuauauucugugggaaaauaacaucaagcucaccgugguugugggggacaucauuggaguccuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgugugggaagucgaggacuauggcuuuggcguuuucacaaccaauauuuggcucaaacugcgcgaaguguacacgcagcugugugaccaccggcuuaugagcgcugccgugaaggaugagagagccguccacgcugacaugggguacuggaucgagucccagaaaaacggaucuuggaagcucgaaaaagccagccugaucgaggugaagacaugcaccuggccuaagucccauacccuguggucuaauggcguucucgaaagcgauaugauuauccccaaaucccuggcggggccuauuagccagcacaaccaucgccccggauaucaaacacagaccgcuggcccuuggcaccuugggaagcuggagcucgacuuuaauuacugcgagggaacgacaguggucaucaccgaaaacuguggcacacggggccccucucugagaaccacaaccguguccgggaaacugauucacgaguggugcugucgcagcugcacgcuuccgccucuccgguauaugggagaagauggcuguugguacgggauggagaucagacccaucucugaaaaggaggagaauaugguuaaaucccuggugagcgccggaucuggcaaggucgacaacuucaccaugggggugcugugccucgccauucuguuugaagagaugaugcggggaaaguucggcaaaaagcauaugaucgcuggcguuuucuuuacauucgugcuucugcucagcgggcagauuaccuggcgcgauauggcccacacacugaucaugauuggauccaaugcgagcgacagaaugggcaugggggucaccuaucuggcucuuaucgccgccuuuaaaauucaacccuuccuggcucucggauuuuuccugcggaagcucacgucuagagaaaaccugcuucugggcguggggcucgccauggcuacaacccugcagcugccugaggauaucgaacagauggccaauggaaucgcgcuuggccugauggcccucaaacugauuacacaguuugagaccuaccaacucuggaccgcucugaucucccuuacauguagcaacacgauguucacccugacaguggccuggcgcaccgcuacacucauucuggccggcgucucccugcuuccgguuugccagucuagcuccaugcggaagaccgacuggcugcccauggccguggcugcgaugggggugccuccccucccucuguuuaucuucucucucaaggauacgcugaaaagacgcagcuggccccuuaaugagggagucauggccgugggccugguuuccauucuggcuucuagccuccugagaaacgacgugccuauggccgggccccuugucgccggaggccugcucaucgcuuguuaugugaucacagggaccuccgccgaucugaccguugaaaaggcggcugacauuacaugggaggaagaggccgaacagaccggagugagccauaaccucaugaucacagucgacgaugacggcacgaugcggauuaaagaugacgagaccgagaauauccugacagugcuucugaagaccgcccugcucauugucucuggcguguuuccguacuccaucccugcuacacugcuuguuuggcacaccuggcagaaacaaacgcagcgcagcggggugcugugggauguccccucuccucccgaaacccagaaggccgagcucgaagagggaguguacagaaucaaacagcaaggcauuuucgggaagacacagguuggagugggcguccagaaggaggggguguuucauaccauguggcacgugacacggggagcgguucugaccuauaacggcaaacgccucgaaccgaauugggcuuccgucaagaaagaccugaucagcuacggcgggggauggagacuuucugcccaauggcagaagggcgaggaagugcaggugauugccgucgagccugggaaaaaccccaagaauuuccagacaaugccuggaacguuccaaaccacaaccggcgaaaucggggcuauugcccuggauuuuaagcccggaaccuccggcagccccaucauuaaccgggagggcaaagugguugggcuguauggaaauggcguggucacaaagaacgggggauacguguccggcaucgcucagacgaaugccgagccugacgggccgacccccgaacucgaggaagagauguucaaaaagcgcaaccugacaaucauggaucuucacccuggcagcggaaaaaccagaaaguaucugcccgcgauuguucgggaagccaucaagcgcagacuccggacacugauucucgcuccuaccagaguggucgccgcugagauggaggaagcccugaaaggccuucccauccgcuaccagacgacagccaccaagucugagcauaccgggcgggaaauuguggaccugaugugccacgcuacauuuaccaugagacugcucagcccuguucgcgugccgaauuauaaccugaucaucauggaugaggcgcauuucacagaccccgccuccauugcugcccggggauacaucucuaccagagucggcaugggggaagccgcugccauuuuuaugacggcgacaccucccggaaccgcugaugccuucccucagagcaaugcccccauccaagacgaggagaaagacauuccggaacgcuccuggaacucuggcaaugaguggaucacagauuuugcugggaagaccgugugguucgugccuagcaucaaagccggcaacgacauugcgaacugucuucggaagaauggaaagaaagucauccagcuguccagaaagacguuugauaccgaauaccagaaaacaaagcucaacgacugggauuucguugugaccacagacauuucugagaugggcgccaauuuuaaagcugaucgcgugaucgacccccggagaugccugaagcccgucauucugaccgaugggccugagcgggugauccucgccggacccaugccuguuacagcugccagcgcugcccagcgcagaggccggguggggcgcaacccgcaaaaggaaaaugaccaguauauuuucaccggacagccccuuaacaaugaugaggaccacgcgcauuggacggaagccaaaaugcugcuggacaacaucaauacaccugagggcaucauucccgcucucuucgaaccugagagagagaaguccgccgcuaucgauggggaauaccggcugaaaggcgagagcagaaagaccuuugucgaacuuaugcgccggggagaccugcccguguggcucgcccacaaaguugccucugagggcauuaaguauaccgauagaaaauggugcuucgacgggcagcgcaacaaucaaauccuggaagagaacauggauguggagauuuggacaaaggaaggagagaagaaaaagcugcggccgagauggcucgacgcucgcaccuacuccgauccucuugcgcugaaagaauuuaaggacuucgccgcuggccggaaaagcaucgcccuggaucucgucacagagaucgggagagugcccucucaccuggcccaucgcacgagaaaugcucuugacaaccuggucaugcuccacaccuccgaacauggaggccgggccuaucgccacgcgguggaggagcugccugaaacaauggagacccugcuccuucugggccugaugauucuccugacagggggagccaugcuuuuucugaucagcggcaaggggauuggaaagaccuccaucggccucauuuguguuaucgcuucuagcgggaugcuguggauggccgaaaucccccugcaguggauugcuuccgccaucgugcucgaguucuuuaugauggugcuucugauuccugagcccgaaaaacagagaacgccgcaagauaaucagcuggcguacgucguuaucggaauucucacccuggccgcuaucauugccgcuaacgagaugggccuucuggaaacaaccaagcgggaccucggcaugagcaaagagccugggguggugucucccacauccuaucuggaugucgaccugcaccccgccagcgcuuggacccucuacgccguggcgacgacaguuaucaccccuaugcuucgccauacaaucgaaaauucuaccgccaacgugagccuggcugccauugcuaaccaggccgucgugcugaugggacucgacaagggcuggccgaucuccaaaauggaucugggggucccccuucuggcccucggaugcuacucucaggugaauccucugacccugacagcggcuguucuccuucugauuacgcacuaugccaucauuggccccgggcugcaagcuaaggccaccagagaggcccagaagcggacagcugccggaaucaugaaaaacccuaccguggacggcaucaugacaauugaucucgaccccgucaucuacgauagcaaguucgagaaacagcugggccaggugaugcuucugguucucugugcggugcaacugcugcucaugagaaccuccugggcccuuugcgaagcucugacgcuggccacagggccuauuaccacccucugggagggaucuccgggcaaguuuuggaauacaaccaucgcugucagcauggccaacauuuuccgcggguccuaucuggcgggagccggccuugcuuuuagcaucaugaaaucuguggggacaggaaagcggggcacgggcucccagggggaaacccugggagagaaguggaaaaagaaacucaaucagcugagcagaaaggaauucgaccuguacaaaaaguccggcaucacagagguggaucgcaccgaggccaaagaagggcucaagcggggagagacaacccaucacgcuguuucuagaggcacggccaagcuucagugguuugucgaacggaacauggugauucccgaggggcgcgugaucgaccugggauguggcagaggcggguggagcuauuacugcgcuggacugaaaaaggucaccgaaguucggggcuauacaaaagggggaccuggccaugaggagcccgugccuauguccaccuacggguggaauauugugaagcucaugucuggaaaagaugucuucuaccugcccccggaaaagugugacacacuucugugcgauaucggcgagagcuccccuagccccaccguggaagagucucgcacaauuagaguucucaagaugguggagcccuggcugaaaaacaaucaauucuguaucaagguccugaacccuuauaugcccaccgugauugaacaccucgagcggcuucagcgcaaacacggcgggaugcugguuagaaauccucugucccggaacagcacgcaugaaauguacuggaucucuaauggaacaggcaacaucguggccuccgucaauauggugagccgccuccugcuuaacagauuuaccaugacccaccggagaccgacaauugagaaggacguggaucugggggcgggaacgcgccaugucaacgccgaacccgagaccccuaauauggacguuaucggcgagcggauuaaaagaaucaaggaagagcacaacucuacauggcacuaugacgaugaaaaucccuacaagaccugggcuuaucaugggagcuacgaggugaaagccacaggauccgcuucuagcaugauuaacggcguggucaagcuccugaccaaaccuugggacgugguucccauggugacacagauggccaugaccgauacgaccccguucggccaacagcgcgucuuuaaggaaaaaguggacacacggaccccuagauccaugcccgggacacgccgggccaugggaaucaccgcggaguggcuguggagaacgcucggccgcaauaagaagccucggcugugcacaagagaggaauucaccaaaaagguucgcacaaacgcugccaugggggccguguuuaccgaggaaaaucagugggauagcgcuaaagccgcugucgaggacgaaaacuucuggaagcuuguggaucgggagagagagcugcacaaacucggaaaguguggcuccugcguuuauaauaugauggggaaacgcgaaaagaagcugggcgaguuuggaaaagccaagggcucuagagcgaucugguacauguggcuuggggcccgguaccuggaauucgaggcucucggauuucugaacgaggaccauugguucagccgcgaaaauuccuauucuggcguggagggggaaggacugcacaaacucggcuacauucugagagauaucagcaagauucccgggggcgccauguaugcugacgauacggccggaugggacacccggaucacagaggacgaucuucauaacgaagagaaaauuacccagcaaauggacccugagcacagacagcuggcgaaugccaucuuuaagcucacauaccagaacaaggucgugaaaguccagcggcccaccccgacaggcaccgugauggauaucauuucccgcaaggaccaaagagggucuggacagguuggcacguaugggcugaauacauucaccaacauggaagcucagcuuauccggcagauggagggagaaggcgugcugagcaaagccgaucucgagaacccucaccugcccgaaaagaaaauuacccaauggcuggagacaaagggggucgagcgccucagacggauggcuaucuccggcgacgauugcguggugaagcccauugacgaucgcuuugccaaugcucugcuugcccugaacgacaugggaaaaguuagaaaggauaucccucaguggcagccgagcaaaggcuggcaugacuggcagcaagugcccuucuguucucaccauuuccacgaacucaucaugaaggaugggcggaaacuggucgugccuugccgcccccaggacgagcuuauuggaagagcgcggaucucccagggcgccggguggagccugcgcgaaaccgcuugucucggaaaggccuacgcccaaauguggucucugauguauuuucacagacgggaccugcgccucgcuuccaaugccauuugcagcgcgguuccugugcauuggguccccacaucuagaacgaccugguccauccacgcucaucaccaguggaugacaaccgaggauaugcugacaguguggaaccgggucuggauugaagacaauccuuggauggaggauaagacccccgugacgaccugggagaacguuccguaccuuggcaaaagagaagaccaguggugugggagccugaucggccucacaucccgcgccaccugggcccagaauauuccuacagcuauccaacaggugcggagccugaucggaaacgaggaauuccuugauuacaugcccucuaugaagagauuucgcaaagaggaggaaagcgagggcgccauuugguga

SEQ ID NO: 20700 - RNA, 9873 nt, Artificial Sequence
  derived and/or modified CDS sequence (opt5) from DENV-3__FJ024468__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggcccggggggcuagacgcauggccauccuuggagacacagcgugggauuucggcuccguggggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggagugaucacccuguaucucggcgcuguugugcaggccgacauggggugugucauuaauuggaaaggaaaggagcugaagugcggcagcgggaucuucgugacaaacgagguucauacguggaccgaacaguacaaauuucaagcggauucccccaagcggcuggccacagcuauugccggcgcuugggagaauggaguguguggcaucagaagcaccacacgcauggaaaaccuucucuggaaacagauugccaaugagcugaacuauauccugugggaaaauaacaucaagcucaccgucgugguuggggacauuaucggagugcuggagcagggcaaacggacgcuuaccccucagcccauggagcugaaguacucuuggaaaacaugggggaaggccaagauugucaccgcugaaacacaaaacuccagcuucaucauugauggaccuaauacccccgagugcccgucugcguccagagccuggaacgugugggaaguggaggacuauggcuuuggcgucuucacaaccaauaucuggcucaaacugcgcgaaguuuacacgcagcugugugaccaccggcuuaugagcgcugccgugaaggaugagagagccgugcacgcugacaugggguacuggaucgagucccagaaaaacggaucuuggaagcucgaaaaagccagccugauugaggucaagacaugcaccuggccuaagucccauacccuguggucuaauggcgugcucgaaagcgauaugaucauucccaaaucccuggcggggccuaucagccagcacaacuaucgccccggauaccauacacaaaccgcuggcccuuggcaccuugggaagcuggagcucgacuuuaauuauugcgagggaacgacaguugugauuaccgaaaacuguggcacacggggccccucucugagaaccacaaccgucuccgggaaacugauccacgaguggugcugucgcagcugcacgcuuccgccucuccgguacaugggagaagauggcuguugguaugggauggagaucagacccauuucugaaaaggaggagaauauggugaaaucccugguuagcgccggaucuggcaagguggacaacuucaccauggggguccugugccucgccauccuguuugaagaggugaugcggggaaaguucggcaaaaagcauaugauugcuggcguuuucuuuacauucgugcuucugcucagcgggcagaucaccuggcgcgauauggcccacacacugauuaugaucggauccaaugcgagcgacaaaaugggcaugggggucaccuaccuggcucuuauugccacguuuaagauccagcccuuccuggcccucggauuuuuccugagaaaacucacaucucgggaaaaccugcuucugggcguggggcucgcuauggccaccacacugcaacugccugaggauaucgaacagauggcuaauggaauugcccuuggccugauggcgcucaagcugaucacccaguuugagaccuaucagcucuggacagcccugauuucccuuacguguagcaacaccauguucacacugaccguggcuuggagaacagccacccucauccuggcuggcgucucccugcuuccgguuugccaaucuagcuccaugcgcaagacggacuggcugcccauggccguggccgcuaugggggugccuccccucccucuguuuauuuucucucucaaagauacacugaagcggagaagcuggccccuuaaugagggagucauggcggugggccugguuuccauccuggccucuagccuccugcgcaacgacgugccuauggcugggccccuugucgccggaggccugcucaucgccuguuacgugauuaccgggaccuccgcugaucugacaguugaaaaagccgcggacaucaccugggaggaagaggcugaacagacaggagugagccauaaccucaugauuacggucgacgaugacggcaccaugagaaucaaggaugacgagacagagaauauucugaccgugcuucugaaaacagcccugcucaucgucucuggcguguuuccguacuccaucccugccacccugcuuguuuggcacacguggcagaagcagacccaacggagcggggugcugugggauguccccucuccucccgaaacacagaaagcugagcucgaagagggaguguaucgcauuaagcagcagggcaucuucgggaagacccaaguuggagugggcguccagaaagaggggguguuucauacaauguggcacgugaccagaggagccguucugacauacaacggcaagcggcucgaaccgaauugggcguccgucaaaaaggaccugauuagcuauggcgggggauggcgccuuucugcucaguggcaaaaaggcgaggaagugcaggugaucgccgucgagccugggaagaaccccaagaauuuccagacgaugccuggaaccuuccagacaaccaccggcgaaauuggggccaucgcucuggauuuuaaacccggaacauccggcagccccauuaucaacagagagggcaaggugguugggcuguacggaaauggcguggucacgaaaaacgggggauauguguccggcaucgcccaaaccaaugcugagccugacgggccgacacccgaacucgaggaagagauguucaagaaacggaaccugaccauuauggaucuucacccuggcagcggaaagacacgcaaguaccugcccgccaucguuagagaagcgauuaaacggcgccucagaacccugauccucgccccuacgcggguggucgcugccgagauggaggaagcucugaagggccuucccauuagauaucagacaaccgccaccaaaucugagcauacagggcgcgaaaucguggaccugaugugccacgccaccuuuacaaugcggcugcucagcccuguuagagugccgaauuacaaccugaucauuauggaugaggcucauuucaccgaccccgcguccaucgccgcucgcggauacauuucuacgcgggucggcaugggggaagccgccgcuaucuuuaugacagccaccccucccggaacagcggaugcuuucccucagagcaaugcccccauucaggacgaggagagagacaucccggaacgcuccuggaacucuggcaaugaguggaucaccgauuuugccgggaagacggugugguucgugccuagcauuaaagcuggcaacgacaucgccaacugucuucggaagaauggaaagaaagucauucaacuguccagaaagaccuuugauacagaauaucagaaaaccaagcucaacgacugggauuucguugugacaaccgacaucucugagaugggcgcgaauuuuaaagccgaucgcgugauugacccccggagaugccugaagcccgucauccugacagaugggccugagcgggugauucucgcuggacccaugccuguuaccgccgcuagcgccgcucagcgcagaggccggguggggcgcaacccgcagaaggaaaaugaccaauacaucuucacgggacagccccuuaacaaugaugaggaccacgcccauuggacagaagcgaaaaugcugcuggacaacaucaauaccccugagggcauuauccccgcccucuucgaaccugagagagagaaguccgcugccauugauggggaauaucggcugaaaggcgagagcagaaagaccuuugucgaacuuaugcgccggggagaccugcccguguggcucgcucacaaaguugccucugagggcaucaaguacacagauagaaaauggugcuucgacgggcagcgcaacaaucagauucuggaagagaacauggauguggagaucuggaccaaggaaggagagaagaaaaagcugcggccgagauggcucgacgcccgcacauauuccgauccucuugcucugaaagaauuuaaggacuucgcggccggccggaaaagcaucgcucuggaucucgucacggagauugggagagugcccucucaccuggcccaucgcaccagaaaugcccuugacaaccuggucaugcuccacacauccgaacauggaggccgggcuuaccgccacgccguggaggagcugccugaaaccauggagacacugcuccuucugggccugaugauccuccugaccgggggagcgaugcuuuuucugauuagcggcaaggggaucggaaagacguccauuggccucaucuguguuaucgccucuagcgggaugcuguggauggcugaaauuccccugcaauggaucgccuccgcuauugugcucgaguucuuuaugauggugcuucugaucccugagcccgaaaaacagagaaccccgcaggauaaucaacuggccuaugucguuauuggaauccucacacuggcggccauuaucgcugccaacgagaugggccuucuggaaaccacaaagcgggaccucggcaugagcaaagagccugggguggugucucccaccuccuaccuggaugucgaccugcaccccgcuagcgccuggacgcucuacgcuguggccacaaccguuaucacaccuaugcuucgccauaccauugaaaauucuaccgcgaacgugagccuggccgcuaucgccaaccaggcugucgugcugaugggacucgacaagggcuggccgauuuccaaaauggaucugggggucccccuucuggcccucggaugcuauucucaggugaauccucugacacugacggccgcgguucuccuucugaucacccacuacgcuauuaucggccccgggcugcaggccaaggcuacaagagaggcccaaaagcggaccgccgcuggaaucaugaaaaacccuacaguggacggcauuaugaccaucgaucucgaccccgucauuuaugauagcaaguucgagaaacagcugggccaggugaugcuucugguucucugugccgugcagcugcugcucaugagaacguccugggcgcuuugcgaagcccugacacuggcuaccgggccuaucaccacacucugggagggaucuccgggcaaguuuuggaauaccacaauugccgucagcauggcuaacaucuuccgcggguccuaccuggccggagcgggccuugccuuuagcaucaugaaaucuguggggacgggaaagcggggcaccggcucccaaggggaaacacugggagagaaguggaaaaagaaacucaaucagcugagcagaaaggaauucgaccuguauaaaaaguccggcauuaccgagguggaucgcacagaggcuaaagaagggcucaagcggggagagaccacgcaucacgccguuucuagaggcaccgcuaagcuucagugguuugucgaacggaacauggugauccccgaggggcgcgugauugaccugggauguggcagaggcggguggagcuacuauugcgccggacugaaaaaggucacagaaguucggggcuacaccaaagggggaccuggccaugaggagcccgugccuauguccacauacggguggaauaucgugaagcucaugucuggaaaagaugucuucuaucugcccccggaaaagugugacacccuucugugcgauauuggcgagagcuccccuagccccacaguggaagagucucgcaccaucagaguucucaagaugguggagcccuggcugaaaaacaaucaguucuguauuaagguccugaacccuuacaugcccacggugaucgaacaccucgagcggcuucaacgcaaacacggcgggaugcugguuagaaauccucugucccggaacagcacacaugaaauguauuggaucucuaauggaaccggcaacauuguggcuuccgucaauauggugagccgccuccugcuuaacagauuuaccaugacacaccggagaccgacgaucgagaaggacguggaucugggggccggaacccgccaugucaacgcggaacccgagacaccuaauauggacguuauuggcgagcggaucaaaagaauuaaggaagagcacaacucuaccuggcacuacgacgaugaaaaucccuauaagacaugggccuaccaugggagcuaugaggugaaagcuaccggauccgccucuagcaugaucaacggcguggucaagcuccugacaaaaccuugggacgugguucccauggugacccagauggcuaugacggauaccacaccguucggccagcaacgcgucuuuaaggaaaaaguggacacccggacaccuagauccaugcccgggacccgccggguuaugggaaucacggccgaguggcuguggagaacacucggccgcaauaagaagccucggcugugcaccagagaggaauucacaaaaaaggugcgcaccaacgccgcgaugggggcugucuuuacggaggaaaaucagugggauagcgccaaagccgcuguggaggacgaagauuucuggaagcuuguugaccgggagagagagcugcacaaacucggaaaguguggcuccugcguguacaacaugauggggaaacgcgaaaagaagcugggcgaguuuggaaaagccaagggcucuagagcuauuugguacauguggcuuggggcccgguaucuggaauucgaggcgcucggauuucugaaugaggaucauugguucagccgcgaaaacuccuacucuggcgucgagggggaaggacugcacaaacucggcuauauccugagagacauuagcaagauccccgggggcgccauguacgcugaugacaccgccggaugggacacacggauuaccgaggaugaccuucauaaugaagagaaaaucacacagcagauggauccugagcacagacaacuggcuaacgccaucuuuaagcucaccuaucagaauaagguggucaaagugcagcggcccacaccgaccggcacgguuauggacauuaucucccgcaaggaucagagagggucuggacaagugggcacauacgggcugaacaccuucaccaauauggaagcgcagcuuauucggcagauggagggagaaggcguccugagcaaagccgaccucgagaacccucaccugcccgaaaagaaaaucacacaguggcuggagaccaaggggguggagcgccucagacggauggcuauuuccggcgaugacugcgugguuaagcccaucgaugaccgcuuugccaacgcucugcuugcccugaaugauaugggaaaagugagaaaggacaucccucaauggcagccgagcaaaggcuggcaugauuggcagcagguccccuucuguucucaccauuuccacgaacucauuaugaaggacgggcggaaacuggugguuccuugccgcccccaagacgagcuuaucggaagagcucggauuucccagggcgccggguggagccugcgcgaaacagcgugucucggaaaggccuaugcucagauguggucucugauguacuuucacagacgggaucugcgccucgccuccaacgccaucugcagcgcugugccuguccauugggugcccacgucuagaaccacaugguccauucacgcccaucaccaauggaugaccacagaggacaugcugaccgucuggaaucggguguggaucgaagauaacccuuggauggaggacaagacgcccguuaccacaugggagaaugugccguaccuuggcaaaagagaagaucaguggugugggagccugauuggccucaccucccgcgcgacaugggcucagaacaucccuaccgccauccagcaaguccggagccugauuggaaaugaggaauuccuugacuauaugcccucuaugaagagauuucgcaaagaggaggaaagcgagggcgccaucugguga

SEQ ID NO: 20701 - RNA, 9873 nt, Artificial Sequence
  derived and/or modified CDS sequence (opt5) from DENV-3__FJ024470__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggcccucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaaccaucgccccggauaucacacacaaaccgcuggcccuuggcaccuugggaagcuggagcucgacuuuaauuacugcgagggaacgacagugguuaucaccgaaaacuguggcacacggggccccucucugagaaccacaaccguguccgggaaacugauccaugaguggugcugucgcagcugcacgcuuccgccucuccgguauaugggagaagauggcuguugguacgggauggagauuagacccaucucugaaaaggaggagaauauggucaaaucccuggugagcgccggaucuggcaagguugacaacuucaccaugggggugcugugccucgccauucuguuugaagaggucaugcggggaaaguucggcaaaaagcacaugaucgcuggcguguucuuuacauucguucuucugcucagcgggcagauuaccuggcgcgauauggcccauacacugaucaugauuggauccaaugcgagcgacagaaugggcaugggggugaccuaucuggcucuuaucgccacguuuaaaauccagcccuuccuggcccucggauuuuuccugcggaagcucacaucuagagaaaaccugcuucugggcgucgggcucgcuauggccaccacacugcaacugccugaggauauugaacagauggcuaauggaaucgcccuuggccugauggcgcucaaacugauuacccaguuugagaccuaccagcucuggacagcccugaucucccuuacguguagcaacaccauuuucacacugaccguggcuuggcgcacagccacccucauccuggcuggcgugucccugcuuccggucugccaaucuagcuccaugcggaagacggacuggcugcccauggccguugccgcuaugggggugccuccccucccucuguuuaucuucucucucaaggauacacugaaaagacgcagcuggccccuuaaugagggagugauggcggucggccugguguccauucuggccucuagccuccugagaaacgacguuccuauggcugggccccuuguggccggaggccugcucaucgccuguuaugucauuaccgggaccuccgcugaucugacaguggaaaaggccgcggacaucaccugggaggaagaggcugaacagacaggaguuagccacaaccucaugauuacgguggacgaugacggcaccaugcggaucaaagaugacgagacagagaauauccugaccguccuucugaagacagcccugcucauugugucuggcaucuuuccguacuccauuccugccacccugcuugucuggcauacguggcagaaacagacccaacgcagcggggugcugugggauguucccucuccucccgaaacacagaaggcugagcucgaagagggaguguacagaaucaaacagcagggcauuuucgggaagacccaagucggagugggcguucagaaggaggggguguuucacacaauguggcacgucacccggggagccgugcugacauauaacggcaaacgccucgaaccgaauugggcguccgugaagaaagaccugaucagcuacggcgggggauggagacuuucugcucaguggcaaaagggcgaggaaguucaggucauugccguggagccugggaaaaaccccaagaauuuccagacgaugccuggaaccuuccagacaaccaccggcgaaaucggggccaucgcucuggauuuuaagcccggaacauccggcagccccauuaucaaccgggagggcaaaguggucgggcuguauggaaauggcgugguuacgaagaacgggggauacguguccggcauugcccaaaccaaugcugagccugacgggccgacacccgaacucgaggaagagauguucaaaaagcgcaaccugaccaucauggaucuucauccuggcagcggaaaaacaagaaaguaucugcccgccauuguccgggaagcgaucaagcgcagacuccggacccugauccucgccccuacgagagugguugcugccgagauggaggaagcucugaaaggccuucccauucgcuaccagacaaccgccaccaagucugagcacacagggcgggaaaucguggaccugaugugccaugccaccuuuacaaugagacugcucagcccuguccgcgugccgaauuauaaccugauuaucauggaugaggcucacuucaccgaccccgcguccauugccgcucggggauacaucucuacgagaguuggcaugggggaagccgccgcuaucuuuaugacagccaccccucccggaacagcggaugcuuucccucagagcaaugcccccauucaggacgaggagcgcgacaucccggaacgguccuggaacucuggcaaugaguggauuaccgauuuugccgggaaaacggugugguucgucccuagcaucaaggcuggcaacgacauugccaacugucuucgcaaaaauggaaagaaggugauccaacuguccagaaaaaccuuugauacagaauaccagaagaccaaacucaacgacugggauuucguggucacaaccgacauuucugagaugggcgcgaauuuuaaggccgaucggguuaucgaccccagacggugccugaaacccgugauccugacagaugggccugagcgcgugauucucgcuggacccaugccugucaccgccgcuagcgccgcucagagacggggccgcguggggagaaacccgcagaaggaaaaugaccaauauaucuucacgggacagccccuuaacaaugaugaggaccaugcccacuggacagaagcgaagaugcugcuggacaacauuaauaccccugagggcaucauucccgcccucuucgaaccugagcgggagaaauccgcugccaucgauggggaauacagacugaagggcgagagccgcaaaaccuuuguugaacuuaugcggagaggagaccugcccguguggcucgcucacaaggucgccucugagggcaucaaauauacagaucgcaaguggugcuucgacgggcagcggaacaaucagauucuggaagagaacauggauguggagaucuggaccaaagaaggagagaagaagaaacugagaccgcgcuggcucgacgcccggacauacuccgauccucuugcucugaaggaauuuaaagacuucgcggccggcagaaagagcauugcucuggaucucguuacggagaucgggcgcgugcccucucaucuggcccacagaacccggaaugcccuugacaaccuggucaugcuccauacauccgaacacggaggccgcgcuuauagacacgccguggaggagcugccugaaaccauggagacacugcuccuucugggccugaugauucuccugaccgggggagcgaugcuuuuucugaucagcggcaaagggaucggaaagacguccauuggccucaucugugucauugccucuagcgggaugcuguggauggcugaaaucccccugcaauggauugccuccgcuaucgugcucgaguucuuuaugaugguucuucugauuccugagcccgaaaagcagcggaccccgcaggauaaucaacuggccuacguggugaucggaauccucacacuggcggccauuaucgcugccaacgagaugggccuucuggaaaccacaaaacgcgaccucggcaugagcaaggagccuggggucguuucucccaccuccuaucuggauguggaccugcaucccgcuagcgccuggacgcucuacgcuguggccacaaccgucauuacaccuaugcuuagacacaccaucgaaaauucuaccgcgaacgugagccuggccgcuauugccaaccaggcuguugugcugaugggacucgacaaaggcuggccgaucuccaagauggaucugggggucccccuucuggcccucggaugcuacucucaggugaauccucugacacugacggccgcgguccuccuucugaucacccauuaugcuauuaucggccccgggcugcaggccaaagcuacacgggaggcccaaaagagaaccgccgcuggaauuaugaagaacccuacaguggacggcaucaugaccauugaucucgaccccguuaucuacgauagcaaauucgagaagcagcugggccaggugaugcuucugguccucugugccgugcagcugcugcucaugcgcacguccugggcgcuuugcgaagcccugacacuggcuaccgggccuaucaccacacucugggagggaucuccgggcaaauuuuggaauaccacaauugccguuagcauggcuaacaucuuccggggguccuaucuggccggagcgggccuugccuuuagcauuaugaagucuguggggacgggaaaaagaggcaccggcucccaaggggaaacacugggagagaaguggaagaaaaagcucaaucagcugagccgcaaagaguucgaccuguacaagaaauccggcaucaccgaggucgaucggacagaggcuaaggaagggcucaaaagaggagagauuacccaccaugccgugucucggggcagcgcuaaacuucagugguuuguggaacgcaacaugguuauccccgaggggagagucauugaccugggauguggccggggcgggugguccuauuacugcgccggacugaagaaagugacggaagugcgcggcuauaccaaagggggaccuggccacgaggagcccgucccuaugucuacauacggguggaauaucguuaaacucaugagcggaaaggauguguucuaccugcccccggaaaaaugugacacccuucugugcgauaucggcgaguccagcccuucucccacaguggaagaguccagaaccauucggguccucaagaugguggagcccuggcugaagaacaaucaguucuguaucaaaguucugaacccuuauaugcccacagugauugaacaccucgagcgccuucaaagaaagcauggcgggaugcugguccggaauccucugagccgcaacucuacccacgaaauguacuggaucuccaauggaacgggcaacauuguggcuagcguuaauauggugucuagacuccugcuuaaccgguuuacaaugacccauagacgcccgaccaucgagaaagacgucgaucugggggccggaacacggcacgugaacgcggaacccgagacgccuaauauggacgugaucggcgagagaauuaagcgcaucaaagaagaacacaacagcaccuggcauuaugacgaugaaaaucccuacaagacaugggccuaucacggguccuacgaggucaaggcuaccggaucugccagcuccaugauuaacggcguugugaaacuccugacaaagccuugggacgugguccccauggugacccagauggcuaugacagauaccacgccguucggccagcaacggguuuuuaaagaaaagguggacaccagaacaccucgcagcaugcccgggacccggagagucaugggaaucacagccgaguggcuguggcgcacccucggccggaauaaaaagccuagacugugcacgcgcgaggaguucacaaagaaagugcggaccaacgccgcgaugggggcuguuuuuacagaggaaaaucagugggauuccgccaaggccgcuguggaggacgaagauuucuggaaacuugucgacagagagcgcgagcugcauaagcucggaaaauguggcucuugcguguauaacaugauggggaagagagagaagaagcugggcgaguuuggaaaggccaaaggcagccgggcuauuugguacauguggcuuggggcccgcuaccuggaguucgaggcgcucggauuucugaaugaggaucacugguucuccagagaaaacucuuauagcggcguugagggggaaggacugcauaagcucggcuacauccugcgggacaucuccaaaauucccgggggcgccauguaugcugaugacaccgccggaugggacacgagaaucaccgaggaugaccuucacaaugaagagaagauuacacagcagauggauccugagcaccggcaacuggcuaacgccaucuuuaaacucaccuaccagaauaagguggucaaggugcagcgccccacaccgaccggcacagucauggacauuaucucuagaaaagaucagcgggggagcggacaagugggcaccuaugggcugaacacguucacaaauauggaagcgcagcuuauccgccagauggagggagaaggcguucuguccaaggccgaccucgagagccaucaucugccugagaagaagauuacccaguggcuggagaccaaagggguggagagacucaagcggauggcuaucucuggcgaugacugcgucgugaagcccauugaugaccgcuuugccaacgcucugcuugcccugaacgauaugggaaaagugagaaaggacaucccccaauggcagccuuccaaaggcuggcaugauuggcagcagguuccguucuguagccaccacuuccaugaacucauuaugaaggacgggcggaaacuggugguccccugccgcccucaagacgagcuuaucggacgggcucggauuucucagggcgccggguggucccugcgcgaaacagcgugucucggaaaggccuacgcucagauguggagccugauguauuuucacagacgggaucugcgccucgccucuaaugccaucugcuccgcugugcccguucauugggugccuaccagcagaacaacgugguccauccacgcccaucaccaauggaugaccacagaggacaugcugaccgucuggaaccggguguggauugaagauaaucccuggauggaggacaagacaccugucaccacgugggagaacgugcccuaccuuggcaaaagagaagaucaguggugugggagccugaucggccucaccucucgcgcgacaugggcucagaauauuccgaccgccauccagcaaguucggagccugauuggaaacgaggaguuccuugacuacaugccuuccaugaagagauuucgcaaagaggaggaaucugagggcgccaucugguga

SEQ ID NO: 20702 - RNA, 9873 nt, Artificial Sequence
  derived and/or modified CDS sequence (opt5) from DENV-3__FJ024471__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggcccucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaaccaucgccccggauaucacacacaaaccgcuggcccuuggcaccuugggaagcuggagcucgacuuuaauuacugcgagggaacgacagugguuaucaccgaaaacuguggcacacggggccccucucugagaaccacaaccguguccgggaaacugauccaugaguggugcugucgcagcugcacgcuuccgccucuccgguauaugggagaagauggcuguugguacgggauggagauuagacccaucucugaaaaggaggagaauauggucaaaucccuggugagcgccggaucuggcaagguugacaacuucaccaugggggugcugugccucgccauucuguuugaagaggucaugcggggaaaguucggcaaaaagcacaugaucgcuggcguguucuuuacauucguucuucugcucagcgggcagauuaccuggcgcgauauggcccauacacugaucaugauuggauccaaugcgagcgacagaaugggcaugggggugaccuaucuggcucuuaucgccacguuuaaaauccagcccuuccuggcccucggauuuuuccugcggaagcucacaucuagagaaaaccugcuucugggcgucgggcucgcuauggccaccacacugcaacugccugaggauauugaacagauggcuaauggaaucgcccuuggccugauggcgcucaaacugauuacccaguuugagaccuaccagcucuggacagcccugaucucccuuacguguagcaacaccauuuucacacugaccguggcuuggcgcacagccacccucauccuggcuggcgugucccugcuuccggucugccaaucuagcuccaugcggaagacggacuggcugcccauggccguugccgcuaugggggugccuccccucccucuguuuaucuucucucucaaggauacacugaaaagacgcagcuggccccuuaaugagggagugauggcggucggccugguguccauucuggccucuagccuccugagaaacgacguuccuauggcugggccccuuguggccggaggccugcucaucgccuguuaugucauuaccgggaccuccgcugaucugacaguggaaaaggccgcggacaucaccugggaggaagaggcugaacagacaggaguuagccacaaccucaugauuacgguggacgaugacggcaccaugcggaucaaagaugacgagacagagaauauccugaccguccuucugaagacagcccugcucauugugucuggcaucuuuccguacuccauuccugccacccugcuugucuggcauacguggcagaaacagacccaacgcagcggggugcugugggauguucccucuccucccgaaacacagaaggcugagcucgaagagggaguguacagaaucaaacagcagggcauuuucgggaagacccaagucggagugggcguucagaaggaggggguguuucacacaauguggcacgucacccggggagccgugcugacauauaacggcaaacgccucgaaccgaauugggcguccgugaagaaagaccugaucagcuacggcgggggauggagacuuucugcucaguggcaaaagggcgaggaaguucaggucauugccguggagccugggaaaaaccccaagaauuuccagacgaugccuggaaccuuccagacaaccaccggcgaaaucggggccaucgcucuggauuuuaagcccggaacauccggcagccccauuaucaaccgggagggcaaaguggucgggcuguauggaaauggcgugguuacgaagaacgggggauacguguccggcauugcccaaaccaaugcugagccugacgggccgacacccgaacucgaggaagagauguucaaaaagcgcaaccugaccaucauggaucuucauccuggcagcggaaaaacaagaaaguaucugcccgccauuguccgggaagcgaucaagcgcagacuccggacccugauccucgccccuacgagagugguugcugccgagauggaggaagcucugaaaggccuucccauucgcuaccagacaaccgccaccaagucugagcacacagggcgggaaaucguggaccugaugugccaugccaccuuuacaaugagacugcucagcccuguccgcgugccgaauuauaaccugauuaucauggaugaggcucacuucaccgaccccgcguccauugccgcucggggauacaucucuacgagaguuggcaugggggaagccgccgcuaucuuuaugacagccaccccucccggaacagcggaugcuuucccucagagcaaugcccccauucaggacgaggagcgcgacaucccggaacgguccuggaacucuggcaaugaguggauuaccgauuuugccgggaaaacggugugguucgucccuagcaucaaggcuggcaacgacauugccaacugucuucgcaaaaauggaaagaaggugauccaacuguccagaaaaaccuuuaacacagaauaccagaagaccaaacucaaugauugggacuucguggucacaaccgauauuucugagaugggcgcgaacuuuaaggccgaccggguuaucgaucccagacggugccugaaacccgugauccugacagacgggccugagcgcgugauucucgcuggacccaugccugucaccgccgcuagcgccgcucagagacggggccgcguggggagaaauccgcagaaggaaaacgaucaauauaucuucacgggacagccccuuaauaacgacgaggaucaugcccacuggacagaagcgaagaugcugcuggacaauauuaacaccccugagggcaucauucccgcccucuucgaaccugagcgggagaaauccgcugccaucgacggggaauacagacugaagggcgagagccgcaaaaccuuuguugaacuuaugcggagaggagaucugcccguguggcucgcucacaaggucgccucugagggcaucaaauauacagaccgcaaguggugcuucgaugggcagcggaauaaccagauucuggaagagaauauggacguggagaucuggaccaaagaaggagagaagaagaaacugagaccgcgcuggcucgaugcccggacauacuccgacccucuugcucugaaggaauuuaaagauuucgcggccggcagaaagagcauugcucuggaccucguuacggagaucgggcgcgugcccucucaucuggcccacagaacccggaacgcccuugauaaucuggucaugcuccauacauccgaacacggaggccgcgcuuauagacacgccguggaggagcugccugaaaccauggagacacugcuccuucugggccugaugauucuccugaccgggggagcgaugcuuuuucugaucagcggcaaagggaucggaaagacguccauuggccucaucugugucauugccucuagcgggaugcuguggauggcugaaaucccccugcaauggauugccuccgcuaucgugcucgaguucuuuaugaugguucuucugauuccugagcccgaaaagcagcggaccccgcaggacaaccaacuggccuacguggugaucggaauccucacacuggcggccauuaucgcugccaaugagaugggccuucuggaaaccacaaaacgcgaucucggcaugagcaaggagccuggggucguuucucccaccuccuaucuggacguggaucugcaucccgcuagcgccuggacgcucuacgcuguggccacaaccgucauuacaccuaugcuuagacacaccaucgaaaacucuaccgcgaacgugagccuggccgcuauugccaaucaggcuguugugcugaugggacucgacaaaggcuggccgaucuccaagauggaccugggggucccccuucuggcccucggaugcuacucucaggugaacccucugacacugacggccgcgguccuccuucugaucacccauuaugcuauuaucggccccgggcugcaggccaaagcuacacgggaggcccaaaagagaaccgccgcuggaauuaugaagaauccuacaguggauggcaucaugaccauugaccucgaucccguuaucuacgacagcaaauucgagaagcagcugggccaggugaugcuucugguccucugugccgugcagcugcugcucaugcgcacguccugggcgcuuugcgaagcccugacacuggcuaccgggccuaucaccacacucugggagggaucuccgggcaaauuuuggaacaccacaauugccguuagcauggcuaauaucuuccggggguccuaucuggccggagcgggccuugccuuuagcauuaugaagucuguggggacgggaaaaagaggcaccggcucccaaggggaaacacugggagagaaguggaagaaaaagcucaaccagcugagccgcaaagaguucgaucuguacaagaaauccggcaucaccgaggucgaccggacagaggcuaaggaagggcucaaaagaggagagauuacccaccaugccgugucucggggcagcgcuaaacuucagugguuuguggaacgcaauaugguuauccccgaggggagagucauugaucugggauguggccggggcgggugguccuauuacugcgccggacugaagaaagugacggaagugcgcggcuauaccaaagggggaccuggccacgaggagcccgucccuaugucuacauacggguggaacaucguuaaacucaugagcggaaaggacguguucuaccugcccccggaaaaaugugauacccuucugugcgacaucggcgaguccagcccuucucccacaguggaagaguccagaaccauucggguccucaagaugguggagcccuggcugaagaauaaccaguucuguaucaaaguucugaauccuuauaugcccacagugauugaacaccucgagcgccuucaaagaaagcauggcgggaugcugguccggaacccucugagccgcaauucuacccacgaaauguacuggaucuccaacggaacgggcaauauuguggcuagcguuaacauggugucuagacuccugcuuaaccgguuuacaaugacccauagacgcccgaccaucgagaaagaugucgaccugggggccggaacacggcacgugaaugcggaacccgagacgccuaacauggaugugaucggcgagagaauuaagcgcaucaaagaagaacacaauagcaccuggcauuaugacgacgaaaaccccuacaagacaugggccuaucacggguccuacgaggucaaggcuaccggaucugccagcuccaugauuaauggcguugugaaacuccugacaaagccuugggaugugguccccauggugacccagauggcuaugacagacaccacgccguucggccagcaacggguuuuuaaagaaaagguggauaccagaacaccucgcagcaugcccgggacccggagagucaugggaaucacagccgaguggcuguggcgcacccucggccggaacaaaaagccuagacugugcacgcgcgaggaguucacaaagaaagugcggaccaaugccgcgaugggggcuguuuuuacagaggaaaaccagugggacuccgccaaggccgcuguggaggaugaagacuucuggaaacuugucgauagagagcgcgagcugcauaagcucggaaaauguggcucuugcguguauaauaugauggggaagagagagaagaagcugggcgaguuuggaaaggccaaaggcagccgggcuauuugguacauguggcuuggggcccgcuaccuggaguucgaggcgcucggauuucugaacgaggaccacugguucuccagagaaaauucuuauagcggcguugagggggaaggacugcauaagcucggcuacauccugcgggauaucuccaaaauucccgggggcgccauguaugcugacgauaccgccggaugggacacgagaaucaccgaggacgaucuucacaacgaagagaagauuacacagcagauggacccugagcaccggcaacuggcuaaugccaucuuuaaacucaccuaccagaacaagguggucaaggugcagcgccccacaccgaccggcacagucauggauauuaucucuagaaaagaccagcgggggagcggacaagugggcaccuaugggcugaauacguucacaaacauggaagcgcagcuuauccgccagauggagggagaaggcguucuguccaaggccgaucucgagagccaucaccugucugagaagaagauuacccaguggcuggagaccaaagggguggagagacucaagcggauggcuaucuccggcgacgauugcgucgugaagccuauugacgaucgcuuugccaacgcucugcuugcccugaaugacaugggaaaagugagaaaggauaucccccaauggcagcccagcaaaggcuggcaugacuggcagcagguuccuuucuguucucaccacuuccaugaacucauuaugaaggaugggcggaaacugguggucccgugccgcccccaagacgagcuuaucggacgggcucggauuucccagggcgccggguggagccugcgcgaaacagcgugucucggaaaggccuacgcucagauguggucucugauguauuuucacagacgggaccugcgccucgccuccaacgccaucugcagcgcugugccuguucauugggugcccaccuccagaacaacguggagcauccacgcccaucaccaauggaugaccacagaggauaugcugaccgucuggaaucggguguggauugaagacaacccuuggauggaggauaagacacccgucaccacgugggagaaugugccuuaccuuggcaaaagagaagaccaguggugugggucucugaucggccucaccagccgcgcgacaugggcucagaacauucccaccgccauccagcaaguucggucccugauuggaaaugaggaguuccuugauuacaugccgucuaugaagagauuucgcaaagaggaggaaagcgagggcgccaucugguga

SEQ ID NO: 20703 - RNA, 9873 nt, Artificial Sequence
  derived and/or modified CDS sequence (opt5) from DENV-3__FJ182005__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaagugccuuucagcaccgaggacggccaagggaaggcccauuccggaagacugauuacagcgaaccccgucgugaccaaaaaggaggaacccgugaauaucgaggcugaaccuccguucggcgagucuaacauuguuaucgggauuggcgauaaugcccugaaaaucaacugguauaagaagggaagcuccaucggcaaaauguuugaagccacggcuagaggggccagacgcauggcuauucuuggagacacagccugggauuucggcagcgucgggggagugcucaauucucugggcaagauggugcaccagaucuuuggguccgcguacaccgcccuguucagcggcgucucuugggugaugaaaauuggaaucggcauucuccugaccuggaucgggcuuaacagcaagaauacauccaugucuuuuagcugcauuguuaucggaaucauuacccuguaucucggcgcugugguccaggccgacauggggugugugaucaacuggaaaggaaaggagcugaagugcggcuccgggauuuucguuacaaaugaggugcauacguggaccgaacaguacaaauuucaagcugauagccccaagcggcuggccacagcgaucgccggcgcuugggagaacggagucuguggcauuagaucuaccacacgcauggaaaaucuucucuggaaacagaucgccaacgagcugaauuauauccugugggaaaacaauauuaagcucaccgugguugugggggacaucauuggaguccuggagcagggcaaacggacgcuuaccccucagcccauggagcugaaguacuccuggaaggcuugggggaaggccaagaucgugacagccgaaacccaaaacagcucuuucauuaucgauggaccuaacacacccgagugcccguccgcuagcagagcguggaaugugugggaagucgaggacuauggcuuuggcguuuucaccacaaacaucuggcucaaacugcgcgaaguguacacccagcugugugaccaccggcuuauguccgccgcugugaaggaugagagagccguccacgccgacaugggguacuggauugagucucagaaaaauggaagcuggaagcucgaaaaggcuucccugaucgaggugaagacgugcacauggccuaagucucauacccuguggagcaacggcguucucgaauccgauaugauuauccccaaaagccuggccgggccuauuucucagcacaauuaucgccccggauaccauacccaaacagcgggcccuuggcaccuugggaagcuggagcucgacuuuaacuauugcgagggaaccacgguggucaucacagaaaauuguggcacccggggccccucccugagaacaaccacagugagcgggaaacugauccacgaguggugcugucgcucuugcacccuuccgccucuccgguacaugggagaagauggcuguugguaugggauggagauuagacccaucuccgaaaaggaggagaacaugguuaaaagccuggugucugcuggaagcggcaaggucgacaauuucacgaugggggugcugugccucgccauucuguuugaagagguuaugcggggaaaguucggcaaaaagcauaugaucgccggcguguucuuuaccuucguccuucugcucuccgggcagauuacauggcgcgauauggcucacacccugaucaugauuggaagcaacgccucugacagaaugggcaugggggugacauaccuggcgcuuaucgcuaccuuuaaaauccagcccuuccuggcccucggauuuuuccugcggaagcucacguccagagaaaaucugcuucugggcguggggcucgccauggcuacaacccugcaacugccugaggauauugaacagauggccaacggaaucgcucuuggccugauggcccucaaacugauuacacaguuugagaccuaucagcucuggaccgcgcugaucagccuuacauguuccaauacgauuuucacccugacagucgccuggcgcaccgcuacacucauccuggccggcguuucucugcuuccggugugccaaagcuccucuaugcggaagaccgacuggcugcccaugacgguggcugccaugggggucccuccccucccucuguuuaucuucagccucaaggauacacugaaaagacgcuccuggccccuuaacgagggagugauggccguuggccuggugucuauucuggcuagcucccuccugagaaaugacgucccuauggcggggccccuuguggccggaggccugcucaucgcuuguuacguuauuaccgggaccagcgccgaucugacaguggaaaaggccgcugacgucaccugggaggaagaggccgaacagacaggagugucucauaaccucaugaucacggucgacgaugacggcaccaugcggauuaaagaugacgagacagagaacauccugaccgugcuucugaagacagcgcugcucaucguuuccggcauuuuuccguacagcaucccugcuacccugcuuguguggcacacguggcagaaacagacccaacgcucugggguccugugggaugugcccuccccucccgaaacacagaaggccgagcucgaagagggaguuuauagaauuaaacagcagggcaucuucgggaagacccaagugggagucggcgugcagaaggaggggguguuucauacaauguggcacguuacccggggagccguccugacauacaauggcaaacgccucgaaccgaacugggcuagcgugaagaaagaccugauuucuuauggcgggggauggagacuuuccgcccaguggcaaaagggcgaggaagugcaggucaucgcgguggagccugggaaaaaucccaagaacuuccagacgaugccuggaaccuuccagacaaccaccggcgaaauuggggcuaucgcccuggauuuuaagcccggaacaagcggcucccccaucauuaaucgggagggcaaaguuguggggcuguacggaaacggcgucgugacgaagaaugggggauauguuagcggcaucgcccaaaccaacgcugagccugacgggccgacacccgaacucgaggaagagauguucaaaaagcgcaaucugaccauuauggaucuucacccuggcucuggaaaaacaagaaaguaccugcccgccaucgugcgggaagcuauuaagcgcagacuccggacccugauccucgccccuacgagagucguggcggccgagauggaggaagcucugaaaggccuucccauccgcuaucagacaaccgccaccaagagcgagcauacagggcgggaaauuguugaccugaugugccacgcuaccuuuacaaugagacugcucuccccugugcgcgucccgaacuacaaucugaucauuauggaugaggcccauuucaccgaccccgccucuaucgcugcgcggggauacauuagcacgagagugggcaugggggaagccgcugccaucuuuaugacagccaccccucccggaacagcugaugccuucccucaguccaacgcgcccauccaggacgaggagcgcgacauuccggaacggucuuggaauagcggcaacgaguggaucaccgauuuugcugggaaaacggugugguucgucccuuccauuaaggccggcaaugacaucgccaacugucuucgcaaaaacggaaagaagguuauucaacugucuagaaaaaccuuugauacagaauaucagaagaccaaacucaaugacugggauuucguggugacaaccgacaucagcgagaugggcgcuaacuuuaaggccgaucgggucauugaccccagacggugccugaaacccgugauccugacagaugggccugagcgcguuauccucgcgggacccaugccugugaccgccgcuuccgccgcucagagacggggccgcgucgggagaaauccgcagaaggaaaacgaccaauacauuuucacgggacagccccuuaauaacgaugaggaccacgcccauuggacagaagcuaagaugcugcuggacaauaucaacaccccugagggcauuauccccgcccucuucgaaccugagcgggagaaaagcgcggccauugauggggaauauagacugaagggcgagucucgcaaaaccuuuguggaacuuaugcggagaggagaccugcccguuuggcucgcucacaagguggccuccgagggcaucaaauacacagaucgcaaguggugcuucgacgggcagcggaauaaccagauccuggaagagaauauggaugucgagauuuggaccaaagaaggagagaagaagaaacugagaccgcgcuggcucgacgcucggacauauagcgauccucuugcccugaaggaauuuaaagacuucgccgcuggcagaaagucuaucgcgcuggaucucgugacggagauugggcgcguccccucccaccuggcccauagaacccggaacgcucuugacaaucuggugaugcuccacacaagcgaacauggaggccgcgccuacagacacgccguugaggagcugccugaaaccauggagacacugcuccuucugggccugaugauccuccugaccgggggagcuaugcuuuuucugauuuccggcaaagggaucggaaagacgucuaucggccucauuugugugaucgccagcuccgggaugcuguggauggcggaaauuccccugcaauggaucgccagcgcuauugugcucgaguucuuuaugaugguccuucugaucccugagcccgaaaagcagcggaccccgcaggauaaccaacuggccuauguugugauuggaauccucacacuggcugccaucauugcggccaaugagaugggccuucuggaaaccacaaaacgcgaccucggcaugucuaaggagccugggguggucucccccaccagcuaccuggauguggaccugcaccccgcuucugccuggacgcucuacgcuguugccacaaccgugaucacaccuaugcuuagacauaccauugaaaacagcaccgcuaaugucucccuggccgcgaucgccaaccaggcugugguccugaugggacucgacaaaggcuggccgauuucuaagauggaucugggggugccccuucuggcccucggaugcuauagccagguuaacccucugacacugacggcugccgugcuccuucugaucacccacuacgccaucauuggccccgggcugcaggcgaaagcuacacgggaggcccaaaagagaaccgcugccggaaucaugaagaauccuacagucgacggcauuaugaccaucgaucucgaccccgugauuuaugauuccaaauucgagaagcagcugggccagguuaugcuucuggugcucugugccguccagcugcugcucaugcgcacgucuugggcucuuugcgaagcccugacacuggcgaccgggccuaucaccacacucugggagggaagcccgggcaaauuuuggaacaccacaaucgccguguccauggcuaauauuuuccgggggagcuaccuggccggagcuggccuugccuuuucuaucaugaaguccguggggacgggaaaaagaggcaccggcagccaaggggaaacacugggagagaaguggaagaaaaagcucaaccagcugucccgcaaagaguucgaccuguauaagaaaucuggcauuaccgagguugaucggacagaggcgaaggaagggcucaaaagaggagagaucacccaucacgccgucagccggggcuccgcuaaacuucagugguuuguggaacgcaauauggugauucccgaggggagagucaucgaccugggauguggccggggcggguggucuuacuauugcgccggacugaagaaaguuacggaagugcgcggcuacaccaaagggggaccuggccaugaggagcccgugccuaugagcacauacggguggaacauugucaaacucauguccggaaaggauguguucuaucugcccccggaaaaaugugacacccuucugugcgauaucggcgagagcucuccuucccccacaguugaagagagcagaaccauccgggugcucaagauggucgagcccuggcugaagaauaaccaguucuguauuaaagugcugaauccuuacaugcccacaguuaucgaacaccucgagcgccuucaaagaaagcacggcgggaugcuggugcggaacccucugucucgcaauuccacccaugaaauguauuggauuagcaacggaacgggcaauaucgucgcuucugugaacauggugagcagacuccugcuuaaucgguuuacaaugacccacagacgcccgaccauugagaaagacgucgaucugggggccggaacacggcauguuaacgcugaacccgagacgccuaacauggacgugaucggcgagagaaucaagcgcauuaaagaagaacacaauuccaccuggcacuacgacgaugaaaaccccuauaagacaugggccuaccaugggucuuaugaggugaaggcgaccggaagcgccuccagcaugaucaauggcgucgugaaacuccugacaaagccuugggacguugugcccauggucacccagauggcuaugacagauaccacgccguucggccagcaacggguguuuaaagaaaagguugacaccagaacaccucgcuccaugcccgggacccggagagugaugggaauuacagccgaguggcuguggcgcacccucggccggaacaaaaagccuagacugugcacgcgcgaggaguucacaaagaaaguccggaccaaugcugccaugggggccguguuuacagaggaaaaccagugggauucugcgaaggcugccguugaggacgaagauuucuggauccuuguggacagagagcgcgagcugcacaaacucggaaaguguggcagcugcgucuacaauaugauggggaaaagagaaaagaaacugggcgaguuuggaaaggccaagggcucccgggcuauuugguacauguggcuuggggcccgcuaucuggaguucgaggcucucggauuucugaacgaggaucauugguucucuagagaaaauagcuacuccggcguggagggggaaggacugcacaaacucggcuauauccugcgggacaucucuaagauucccgggggcgccauguacgcggaugacaccgccggaugggacacgagaaucaccgaggaugaccuucauaacgaagagaaaauuacacagcagauggauccugagcaccggcaacuggcuagcgccaucuuuaagcucaccuaucagaauaaagucgugaagguucagcgccccacaccgaccggcacagugauggacauuaucuccagaaaggaucagcgggggagcggacaagucggcaccuacgggcugaacacguucacaaauauggaagcucagcuuauccgccagauggagggagaaggcgugcugucuaaagccgaccucgagaacccucaucugcccgaaaagaaaauuacccaguggcuggagaccaaggggguggagagacucaaacggauggcgaucuccggcgaugacugcguugugaagcccauugaugaccgcuuugccaaugcucugcuugcccugaacgauaugggaaaggucagaaaagacaucccucaauggcagccgagcaagggcuggcaugauuggcaacaggugcccuucuguucucaccauuuccacgaacucauuaugaaagacgggcggaagcugguugugccuugccgcccccaagacgagcuuaucggacgggcucggauuucccagggcgccggguggagccugcgcgaaacagcuugucucggaaaagccuaugcgcagauguggucucugauguacuuucacagacgggaucugcgccucgccuccaacgcuaucugcagcgccgucccugugcauuggguccccaccuccagaacaacguggagcauccacgcccaucaccaauggaugaccacagaggacaugcugaccguguggaaucggguuuggauugaagauaacccuuggauggaggacaagacacccgugaccacgugggagaaugucccguaccuuggcaagagagaagaucaguggugugggucucugaucggccucaccagccgcgcuacaugggcccagaacauuccuaccgcgauccagcaagugcggucccugauuggaaaugaggaguuccuugacuauaugcccucuaugaaaagauuucgcaaggaggaggaaagcgagggcgcuaucugguga

SEQ ID NO: 20704 - RNA, 9873 nt, Artificial Sequence
  derived and/or modified CDS sequence (opt5) from DENV-3__FJ373302__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccagaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagaugcgcccuguaaaauuccuuucagcacagaggacggccaagggaaggcucauaacggaagacugaucaccgccaaucccguugugacaaaaaaggaggaacccgucaacauugaggccgaaccuccguucggcgaguccaauaucgugauugggaucggcgauaacgcucugaaaaucaauugguauaagaagggaucuagcauuggcaaaauguuugaagccaccgcucggggggccagacgcauggcgauccuuggagacacggccugggauuucggcuccguggggggaguucucaacagccugggcaagaugguccaccagauuuuugggucugcuuacacagcccuguucuccggcgugagcugggugaugaaaaucggaauuggcguccuccugaccuggaucgggcuuaauucuaagaacaccagcauguccuuuucuugcauugcuaucggaaucauuacacuguaucucggcgccgugguucaggcggacaccgggugugugaucaauuggaaaggaaaggagcugaagugcggcagcgggauuuucgucacaaacgaggugcauacguggaccgaacaguacaaauuucaagccgauucccccaagcggcuggcuacagccaucgcuggcgccugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggcuaagaucgugaccgcggaaacacaaaacuccagcuucauuaucgauggaccuaauacccccgagugcccgucugccuccagagcuuggaacgucugggaaguggaggacuauggcuuuggcguguucacaaccaauaucuggcucaaacugcgcgaagccuacacgcagcugugugaccaccggcuuaugagcgccgcugucaaggaugagagagccguucacgcggacaugggguacuggauugagucccagaaaaagggaucuuggaaacucgaaaaggcuagccugaucgaggugaagacaugcaccuggccuaaaucccauacccuguggucuaacggcgugcucgaaagcgauaugauuauccccaagucccuggccgggccuauuagccagcacaauuaucgccccggauaccauacacaaaccgccggcccuuggcaccuugggaaacuggagcucgacuuuaacuauugcgagggaacgacagucgugaucaccgaaaauuguggcacacggggccccucucugagaaccacaaccguuuccgggaagcugauccacgaguggugcugucgcagcugcacgcuuccgccucuccgguacaugggagaagauggcuguugguaugggauggagauuagacccaucucugaaaaagaggagaacauggugaagucccuggucagcgcuggaucuggcaagguggacaauuucaccauggggguucugugccucgccauucuguuugaagaggugaugcggggaaaauucggcaagaaacauaugaucgcgggcgucuucuuuacauucgugcuucugcucagcgggcagauuaccuggcgcgauauggcucacacacugaucaugauuggauccaacgccagcgacagaaugggcauggggguuaccuaccuggcccuuaucgcuacguuuaagauccagcccuuccuggcccucggauuuuuccugcggaaacucacaucuagagaaaaucugcuucugggcguggggcucgcuauggccaccacacugcaacugccugaggauauugaacagauggcgaacggaaucgcccuuggccugauggcucucaagcugauuacccaguuugagaccuaucagcucuggacagcccugaucucccuuacguguagcaauaccauuuucacacugaccgucgcuuggcgcacagccacccucauccuggccggcgugucccugcuuccggugugccaaucuagcuccaugcggaagucugacuggcugcccaugacggucgcugcgauggggguuccuccccucccucuguuuaucuucagccucaaagauacacugaagagacgcuccuggccccuuaacgagggagugauggccgugggccuggucucuauucuggcuagcucccuccugagaaaugacgugccuauggccgggccccuuguugccggaggccugcucaucgcuuguuacgugauuaccgggaccagcgccgaucugacagucgaaaaagcggcugacgugaccugggaggaagaggccgaacagacaggaguuucucauaaccucaugaucacgguggacgaugacggcaccaugcggauuaaggaugacgagacagagaacauccugaccguccuucugaaaacagcccugcucaucguguccggcauuuuuccguacagcaucccugcuacccugcuugucuggcacacguggcagaagcagacccgcagaucuggggugcugugggauguucccuccccucccgaaacacaaaaagccgagcucgaagagggaguguaucggauuaagcagcagggcaucuucgggaagacccaggucggagugggcguucaaaaagaggggguguuucauacaauguggcacgucacccgcggagcggugcugacauacaauggcaagagacucgaaccgaacugggcuagcgugaaaaaggaccugauuucuuauggcgggggauggcggcuuuccgcccaguggcagaaaggcgaggaaguucaagucaucgccguggagccugggaagaaucccaagaacuuccagacgaugccuggaaccuuccagacaaccaccggcgaaauuggggcuaucgcccuggauuuuaaacccggaacaagcggcucccccaucauuaaucgcgagggcaagguggucgggcuguacggaaacggcgugguuacgaaaaaugggggauaugugagcggcaucgcucagaccaacgccgagccugacgggccgacacccgaacucgaggaagagauguucaagaaaagaaaucugaccauuauggaucuucacccuggcucuggaaagacacggaaguaccugcccgcgaucguccgcgaagccauuaaaagacggcucagaacccugauccucgcuccuacgcgcgugguugccgcugagauggaggaagcccugaagggccuucccauccgguaucaaacaaccgccaccaaaagcgagcauacagggagagaaauuguggaccugaugugccacgcuaccuuuacaaugcgccugcucuccccuguccgggugccgaacuacaaucugaucauuauggaugaggcgcauuucaccgaccccgccucuaucgcugccagaggauacauuagcacgcgcguuggcaugggggaagccgcugccaucuuuaugacagcgaccccucccggaacagcugaugccuucccucaguccaacgcccccauccaggacgaggagcgggacauuccggaaagaucuuggaauagcggcaacgaguggaucaccgauuuugcugggaagacggugugguucgucccuuccauuaaagccggcaaugacaucgcgaacugucuucgcaagaacggaaagaaagugauucagcugucucggaagaccuuugauacagaauaucaaaaaaccaagcucaaugacugggauuucguggucacaaccgacaucagcgagaugggcgccaacuuuaaagcugauagaguuauugacccccggcgcugccugaagcccgugauccugacagaugggccugagagagugauccucgccggacccaugccugucaccgcugccuccgcugcccagcggcgcggcagaguggggcggaauccgcagaaggaaaacgaccaguacauuuucacgggacaaccccuuaauaacgaugaggaccacgcgcauuggacagaagccaaaaugcugcuggacaauaucaacaccccugagggcauuauccccgcucucuucgaaccugagagagagaagagcgccgcuauugauggggaauaucgccugaaaggcgagucucggaagaccuuuguugaacuuaugagacgcggagaccugcccguguggcucgcccacaaagucgccuccgagggcaucaaguacacagaucggaaauggugcuucgacgggcagagaaauaaccagauccuggaagagaauauggauguggagauuuggaccaaggaaggagagaagaaaaagcugcgcccgcgguggcucgacgcuagaacauauagcgauccucuugcgcugaaagaauuuaaggacuucgccgcuggccgcaaaucuaucgcccuggaucucguuacggagauugggagagugcccucccaccuggcccaucggacccgcaacgcucuugacaaucuggucaugcuccacacaagcgaacauggaggcaaggccuacagacacgcgguggaggagcugccugaaaccauggagacacugcuccuucugggccugaugauccuccugaccgggggagccaugcuuuuucugauuuccggcaaggggaucggaaaaacgucuaucggccucauuugugucaucgcuagcuccgggaugcuguggauggccgaaauuccccugcaguggaucgcuagcgccauugugcucgaguucuuuaugaugguucuucugaucccugagcccgaaaagcaacggaccccgcaggauaaccagcuggcguauguggugauuggaauccucacacuggccgcuaucauugccgcuaaugagaugggccuucuggaaaccacaaaacgcgaccucggcaugucuaaggagccuggggucguuucccccaccagcuaccuggauguggaccugcaccccgccucugcuuggacgcucuacgccguggcgacaaccgucaucacaccuaugcuuagacauaccauugaaaacagcaccgccaaugugucccuggcugccaucgcuaaccaagccguugugcugaugggacucgacaaaggcuggccgauuucuaagauggaucugggggucccccuucuggcccucggaugcuauagccaggugaacccucugacacugacggcggcuguccuccuucugaucacccacuacgccaucauuggccccgggcugcaggcuaaggccacacgggaggcccagaaaagaaccgcugccggaaucaugaagaauccuacaguggacggcauuaugaccaucgaucucgaccccguuauuuaugauuccaaauucgagaagcaacugggccaggugaugcuucugguccucugugcggugcagcugcugcucaugcgcacgucuugggcccuuugcgaagcucugacacuggccaccgggccuaucaccacacucugggagggaagcccgggcaaauuuuggaacaccacaaucgcuguuuccauggccaauauuuuccgggggagcuaccuggcgggagccggccuugcuuuuucuaucaugaaguccguggggacgggaaagagaggcaccggcagcaaaggggaaacacugggagagaaguggaaaaagaaacucaaccagcugucccgcaaggaauucgaccuguauaaaaagucuggcauuaccgaggucgaucggacagaggccaaggaagggcucaaaagaggagagaucacccaucacgcugugagccggggcuccgccaagcuucaaugguuuguggaacgcaauaugguuauucccgaggggagagucaucgaccugggauguggccggggcggguggucuuacuauugcgcuggacugaaaaaggugacggaagugcgcggcuacaccaaagggggaccuggccaugaggagcccgucccuaugagcacauacggguggaacauuguuaagcucauguccggaaaggauguguucuaucugcccccggaaaaaugugacacccuucugugcgauaucggcgagagcucuccuucccccacaguggaagagagcagaaccauccggguccucaagaugguggagcccuggcugaaaaauaaccaguucuguauuaagguucugaauccuuacaugcccacagugaucgaacaccucgagcgccuucagagaaaacacggcgggaugcugguccggaacccucugucucgcaauuccacccaugaaauguauuggauuagcaacggaacgggcaauaucguggccucuguuaacauggugagcagacuccugcuuaaucgguuuacaaugacccacagacgcccgaccauugagaaggacgucgaucugggggcgggaacacggcaugugaacgccgaacccgagacgccuaacauggacgugaucggcgagagaaucaagcgcauuaaagaagagcacaauuccaccuggcacuacgacgaugaaaaccccuauaagacaugggcuuaccaugggucuuaugaggucaaagccaccggaagcgcuuccagcaugaucaauggcguugugaagcuccugacaaaaccuugggacgugguccccauggugacccagauggccaugacagauaccacgccguucggccaacagcggguuuuuaaggaaaagguggacaccagaacaccucgcuccaugcccgggacccggagagucaugggaauuacagccgaguggcuguggcgcacccucggccggaacaaaaagccuagacugugcacgcgcgaggaauucacaaaaaaggugcggaccaaugcggcuaugggggccguuuuuacagaggaaaaccagugggauucugccaaagcugccguggaggacgaagauuucuggaagcuugucgacagagagcgcgagcugcacaaacucggaaaguguggcagcugcguguacaauaugauggggaagagagaaaaaaagcugggcgaguuuggaaaagcuaagggcucccgggccaucugguacauguggcuuggggcgcgcuaucuggaauucgaggcccucggauuucugaacgaggaucauugguucucuagagaaaauagcuacuccggcguugagggggaaggacugcacaaacucggcuauauucugcgggacaucucuaagauccccgggggcgcuauguacgccgaugacaccgcuggaugggacacgagaauuaccgaggaugaccuucauaacgaagagaagaucacacaacagauggauccugagcaccggcagcuggccaaugcgauuuuuaaacucaccuaucagaacaagguggucaaagugcaacgccccacaccgaccggcacagucauggacaucauuagcagaaaggaucagcggggguccggacaggugggcaccuacgggcugaauacguucacaaacauggaagcccagcuuauccgccaaauggagggagaaggcguucugagcaaagcugaccucgagaauccucaccugucugaaaagaagaucacccaguggcuggagaccaaagggguggagagacucaagcggauggccauuuccggcgaugacugcgucgugaaacccaucgaugaccgcuuugcuaacgcccugcuugcucugaacgauaugggaaaggugagaaaagacauuccccaguggcagccuagcaagggcuggcaugauuggcaacagguuccguucuguucucaccauuuccacgaacucaucaugaaggacgggcggaaacuggugguccccugccgcccucaggacgagcuuauuggaagagcccggaucucccagggcgcgggguggagccugcgcgaaacagccugucucggaaaggcuuaugcccaaauguggucucugauguacuuucacagacgggaucugcgccucgccuccaaugcuauuugcagcgccgugcccguucauugggugccuaccuccagaacaacguggagcauccacgcgcaucaccaguggaugaccacagaggacaugcugaccgucuggaaccggguguggaucgaagauaaucccuggauggaggacaaaacaccugucaccacgugggagaacgugcccuaccuuggcaagagagaagaucaguggugugggucucugauuggccucaccagccgcgcuacaugggcccaaaauaucccgaccgccauucagcagguucggucccugaucggaaacgaggaauuccuugacuauaugccuucuaugaaaagauuucgcaaggaggaggaaagcgagggcgcuauuugguga

SEQ ID NO: 20705 - RNA, 9873 nt, Artificial Sequence
  derived and/or modified CDS sequence (opt5) from DENV-3__FJ182007__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccagaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagaugcgcccuguaaaauuccuuucagcacagaggacggccaagggaaggcucauaacggaagacugaucaccgccaaucccguugugacaaaaaaggaggaacccgucaacauugaggccgaaccuccguucggcgaguccaauaucgugauugggaccggcgauaacgcucugaaaaucaauugguauaagaagggaucuagcaucggcaaaauguuugaagccacggcucggggggccagacgcauggcgauucuuggagacacagccugggauuucggcuccguggggggaguucucaacagccugggcaagaugguccaccagaucuuugggucugcuuacaccgcccuguucuccggcgugagcugggugaugaaaauuggaaucggcguccuccugaccuggauugggcuuaauucuaagaacacaagcauguccuuuucuugcaucgcuauuggaaucaucacccuguaucucggcgccgugguucaggcggacacagggugugugauuaauuggaaaggaaaggagcugaagugcggcagcgggaucuucgucacgaacgaggugcauaccuggacagaacaguacaaauuucaagccgauucccccaagcggcuggcuaccgccauugcuggcgccugggagaauggaguuuguggcaucagaagcacaacccgcauggaaaaccuucucuggaaacagauugccaaugagcugaacuauauccugugggaaaauaacaucaagcucacgguggucgugggggacauuaucggaguucuggagcagggcaaacggacccuuacaccucagcccauggagcugaaguacucuuggaaaaccugggggaaggcuaagauugugacagcggaaacccaaaacuccagcuucaucauugauggaccuaauacacccgagugcccgucugccuccagagcuuggaacgucugggaaguggaggacuauggcuuuggcguguucaccacgaauaucuggcucaaacugcgcgaagucuacacacagcugugugaccaccggcuuaugagcgccgccguuaaggaugagagagcugugcacgccgacaugggguacuggaucgagucccagaaaaacggaucuuggaagcucgaaaaagcgagccugauugaggugaagaccugcaccuggccuaagucccauacacuguggucuaauggcguccucgaaagcgauaugaucauucccaaaucccuggcugggccuaucagccagcacaacuaucgccccggauaccauacccaaacggccggcccuuggcaccuugggaagcuggagcucgacuuuaauuauugcgagggaacaaccgugguuauuacagaagauuguggcacccggggccccucucugagaacaaccacgguguccgggaaacugauccacgaguggugcugucgcagcugcacccuuccgccucuccgguacaugggagaagacggcuguugguaugggauggagaucagacccauuucugaaaaggaggagaacauggucaaaucccuggugagcgccggaucuggcaagguugauaauuucacaaugggggugcugugccucgcuauccuguuugaagaggucaugcggggaaaguucggcaaaaagcauaugauugccggcguguucuuuaccuucguucuucugcucagcgggcagaucacauggcgcgacauggcgcacacccugauuaugaucggauccaacgcuagcgauagaaugggcaugggggugacguaccuggcccuuauugccacauuuaaaauccagcccuuccuggcucucggauuuuuccugcggaagcucaccucuagagaaaaucugcuucugggcgucgggcucgccauggcuacaacccugcaacugccugaggacaucgaacagauggccaacggaauugcgcuuggccugauggcccucaaacugaucacccaguuugagacauaucagcucuggacggcucugauuucccuuaccuguagcaauacaaucuucacccugacaguggccuggcgcaccgcuacgcucauucuggccggcgugucccugcuuccggucugccaaucuagcuccaugcggaagucugauuggcugcccaugacaguugccgcuaugggggugccuccccucccucuguuuaucuucagccucaaggacacccugaaaagacgcuccuggccccuuaacgagggagugauggcggucggccuggugucuauccuggccagcucccuccugagaaaugauguuccuauggcugggccccuuguggccggaggccugcucauugccuguuacgucaucaccgggacaagcgcugaccugaccguggaaaaggccgcggacguuacaugggaggaagaggcugaacagacgggagugucucauaaccucaugauuaccgucgaugacgauggcacaaugcggaucaaagacgaugagaccgagaacauucugacagugcuucugaagaccgcccugcucaucgucuccggcaucuuuccguacagcauuccugccacgcugcuuguguggcacaccuggcagaaacagacacgcagaucugggguucugugggacgugcccuccccucccgaaacccaaaaggcugagcucgaagagggagucuaucggaucaaacagcagggcauuuucgggaagacacaggugggaguuggcgugcaaaaggagggggucuuucauaccauguggcacgugacacgcggagccgugcugacguacaauggcaaaagacucgaaccgaacugggcgagcguuaagaaagaucugaucucuuauggcgggggauggcggcuuuccgcucaguggcagaagggcgaggaaguccaagugauugccguggagccugggaaaaaucccaagaacuuccagaccaugccuggaacauuccagaccaccacaggcgaaaucggggccauugcucuggacuuuaagcccggaacgagcggcucccccaucaucaaucgcgagggcaaagucguggggcuguacggaaacggcguugugaccaagaaugggggauaugucagcggcauugcccagacaaacgcugagccugaugggccgacccccgaacucgaggaagagauguucaaaaagagaaaucugacaaucauggaccuucacccuggcucuggaaaaacccggaaguaccugcccgccauugugcgcgaagcgaucaagagacggcucagaacgcugauucucgccccuacacgcguuguggcugccgagauggaggaagcucugaaaggccuucccauccgguaucaaaccaccgccacaaagagcgagcauaccgggagagaaaucgucgaucugaugugccacgccacauuuaccaugcgccugcucuccccugugcggguuccgaacuacaaucugauuaucauggacgaggcucauuucacggaucccgcgucuauugccgcuagaggauacaucagcacacgcgugggcaugggggaagccgccgcuauuuuuaugaccgccacaccucccggaaccgcggacgcuuucccucaguccaacgcccccauccaggacgaggagcgggauaucccggaaagaucuuggaauagcggcaacgaguggauuacggacuuugccgggaaaaccgucugguucgugccuuccaucaaggcuggcaaugauauugccaacugucuucgcaaaaacggaaagaaggugauccagcugucucggaaaacauuugacaccgaauaucaaaagacaaaacucaaugauugggacuucgucguuaccacagauauuagcgagaugggcgcgaacuuuaaggccgacagagugaucgauccccggcgcugccugaaacccgugauucugaccgacgggccugagagagucauccucgcuggacccaugccugugacggccgcuuccgccgcucagcggcgcggcagaguugggcggaauccgcagaaggaaaacgaucaguacaucuucacaggacaaccccuuaauaacgacgaggaccacgcccauuggaccgaagcgaagaugcugcuggauaauauuaacaccccugagggcaucauucccgcccucuucgaaccugagagagagaaaagcgcugccaucgacggggaauaucgccugaagggcgagucucggaaaacauuuguggaacuuaugagacgcggagaucugcccgucuggcucgcucacaagguggccuccgagggcauuaaauacaccgaccggaaguggugcuucgaugggcagagaaauaaccagauccuggaagagaauauggacguugagaucuggacaaaagaaggagagaagaagaaacugcgcccgcgguggcucgaugccagaacguauagcgacccucuugcucugaaggaauuuaaagauuucgcggccggccgcaagucuauugcucuggaccucgugaccgagaucgggagaguccccucccaccuggcccaucggacacgcaacgcccuugauaaucuggugaugcuccacaccagcgaacauggaggcaaagcuuacagacacgccgucgaggagcugccugaaacaauggagacccugcuccuucugggccugaugauucuccugacggggggagcgaugcuuuuucugaucuccggcaaggggauuggaaagaccucuaucggccucaucugugugauugccagcuccgggaugcuguggaucgcugaaauuccccugcaguggaucgccagcgcuauuguucucgaguucuuuaugauggugcuucugaucccugagcccgaaaaacaacggacaccgcaggacaaccagcuggccuauguggucauuggaauccucacccuggcggccaucauugcugccaaugagaugggccuucuggaaacaaccaagcgcgaucucggcaugucuaaagagccugggguugugucccccacgagcuaccuggacguggaccugcaccccgcuucugccuggacacucuacgcugucgccaccacagugaucaccccuaugcuuagacauaccauugaaaacagcacagcgaauguuucccuggccgcuaucgccaaccaagcugugguccugaugggacucgauaagggcuggccgauuucuaaaauggaccugggggugccccuucuggcccucggaugcuauagccaggucaacccucugacgcugaccgccgcggugcuccuucugaucacacacuacgcuaucauuggccccgggcugcaggccaaggcuacccgggaggcccagaagagaacagccgcuggaaucaugaaaaauccuaccguugauggcauuaugacgaucgaccucgaucccgugauuuaugacuccaaguucgagaaacaacugggccaggucaugcuucuggugcucugugccguucagcugcugcucaugcgcacaucuugggcgcuuugcgaagcccugacccuggcuaccgggccuaucacaacccucugggagggaagcccgggcaaguuuuggaacacaacgaucgccguguccauggcuaauauuuuccgggggagcuaccuggccggagcgggccuugccuuuucuaucaugaaauccgucgggaccggaaagagaggcacaggcagccagggggaaacccugggagagaaguggaaacgcaagcucaaccaacugucccggaaagaauucgaucuguauaagaaaucuggcauuacagagguggacagaaccgaggcuaaggaagggcucaaacggggagagaucacgcaucacgccgugagccgcggcuccgcuaagcuucagugguuuguugaaagaaauauggucauucccgaggggcgggugaucgaucugggauguggccgcggcggguggucuuacuauugcgccggacugaagaaagugaccgaagucagaggcuacacaaaggggggaccuggccaugaggagcccguuccuaugagcaccuacggguggaacauugugaaacucauguccggaaaggacguguucuaucugcccccggaaaaaugugauacacuucugugcgacaucggcgagagcucuccuucccccaccgucgaagagagccggacaauccgcgugcucaagaugguugagcccuggcugaagaauaaccaguucuguauuaaagugcugaauccuuacaugcccaccgucaucgaacaccucgagagacuucagcggaagcacggcgggaugcuggugcgcaacccucugucuagaaauuccacgcaugaaauguauuggauuagcaacggaacaggcaauaucguugcuucugugaacauggucagccggcuccugcuuaauagauuuaccaugacccaccgccggccgacaauugagaaagauguggaccugggggccggaacgagacaugugaacgcggaacccgagaccccuaacauggacgucaucggcgagcgcaucaagcggauuaaagaagagcacaauuccacauggcacuacgaugacgaaaaccccuauaagaccugggccuaccaugggucuuaugagguuaaggcuacaggaagcgccuccagcaugaucaauggcguggugaaacuccugaccaagccuugggaugucgugcccaugguuacacaaauggcuaugaccgacacgaccccguucggccagcagagaguguuuaaagaaaaggucgauacacgcaccccucgguccaugcccgggacaagacgcgugaugggaauuaccgccgaguggcuguggcggacgcucggcagaaacaaaaagccucgccugugcacacgggaggaauucaccaagaaaguuagaacaaaugccgcgaugggggcuguguuuaccgaggaaaaccaaugggacucugccaaggccgcugucgaggaugaagacuucuggaaacuuguggaucgcgagagagagcugcacaagcucggaaaauguggcagcugcguuuacaauaugauggggaagcgggaaaaaaagcugggcgaguuuggaaaggccaaaggcucccgcgcuaucugguacauguggcuuggggccagauaucuggaauucgaggcgcucggauuucugaacgaggaccauugguucucucgggaaaauagcuacuccggcguggagggggaaggacugcacaagcucggcuauauucugagagauaucucuaaaauccccgggggcgccauguacgcugacgacacggccggaugggauacccggauuacagaggacgaucuucauaacgaagagaagaucacccagcagauggacccugagcaccgccagcuggcuaaugccauuuuuaaacucacauaucaaaacaaggucgugaagguccagagacccaccccgacaggcaccgugauggauaucauuagccggaaagaccagcgcggguccggacagguuggcacguacgggcugaauacauucaccaacauggaagcgcaacuuaucagacagauggagggagaaggcgugcugagcaaggccgaucucgagaauccucaccugucugaaaaaaagaucacccaguggcuggagacaaaaggggucgagcggcucaagcgcauggcuauuuccggcgacgauugcguggugaagcccaucgacgauagauuugccaacgcucugcuugcccugaacgacaugggaaaaguucggaaggauauuccccaguggcaaccuagcaaaggcuggcaugacuggcagcaggugccguucuguucucaccauuuccacgaacucaucaugaaggacgggcgcaaacuggucgugcccugcagaccucaggaugagcuuauuggacgggcucgcaucucccaaggcgccggguggagccugagagaaaccgcgugucucggaaaggccuaugcucagauguggucucugauguacuuucaccggcgcgaccugagacucgccuccaaugccauuugcagcgcuguucccgugcauugggucccuacaucccggacgaccuggagcauccacgcccaucaccaguggaugacaaccgaggauaugcugacaguguggaacagagucuggaucgaagacaaucccuggauggaggauaagaccccugugacgaccugggagaacguucccuaccuuggcaaacgcgaagaccaauggugugggucucugauuggccucacaagccgggcgaccugggcucagaauaucccgacagccauucagcaggugagaucccugaucggaaacgaggaauuccuugauuauaugccuucuaugaagcgcuuucggaaagaggaggaaagcgagggcgccauuugguga

SEQ ID NO: 20706 - RNA, 9873 nt, Artificial Sequence
  derived and/or modified CDS sequence (opt5) from DENV-3__FJ182008__SS-prME
accagccugugcaucaugaugauucuccccgccgcucuggccuuccaccuuacauccagagacggcgagccucggaugaucguggggaagaacgaacgcggaaaaucucugcucuuuaagacggcgagcggcauuaauauguguacccugaucgcuauggaucuuggggagaugugcgacgauacagucaccuacaaauguccgcauauuacagaaguugagcccgaagacaucgauugcugguguaaccugaccuccacaugggugaccuauggaacgugcaaucaggccggcgagcacagacgggacaagcgcucuguggcccucgcuccucaugucgggaugggacuggauaccagaacacaaaccuggaugagcgccgagggcgcuuggcggcagguggaaaaaguugagacaugggcccugcgccaccccggcuucaccauccucgcgcuguuucuugcccauuacauugggacgucccugacacagaagguggucaucuucauucuccugaugcuugugaccccuucuaugacaaugagauguguuggagugggcaaccgggacuuugucgaagggcugagcggagcuaccuggguggaugugguccucgagcacggcgggugcguuaccacaauggccaagaauaaacccacgcuggacaucgagcugcagaagaccgaagcuacacaacucgccacccugcgcaaacuuuguauugagggaaagaucacaaacauuaccacggauuccagaugcccuacacagggcgaagcggugcugccggaggaacaggaccagaauuauguguguaaacacaccuacgucgaucggggcugggggaacggaugcggccucuucgggaagggaagccuggugaccugcgccaaguuucaaugucuugagcccaucgagggcaaaguugugcaguaugaaaaucugaaguacacagucaucauuaccgugcauacaggggaccagcaccagguuggaaacgagacgcaaggcgugaccgcugaaaucacaccucaggccucuaccacagaggcuauucuccccgaauauggcacccuggggcuggagugcuccccucgcacgggacucgacuucaaugagaugauccugcuuaccaugaaaaacaaggccuggaugguccauagacagugguuuuucgaucugccccucccguggacaagcggcgccaccacagaaaccccuacguggaaucggaaagagcugcuugugacauuuaagaacgcucacgcgaaaaagcaagaagucgugguucuggggucucaggagggagccaugcacaccgcucucacaggcgccaccgaaauucagaauuccgggggcaccagcaucuucgccggacaucugaagugucgccugaaaauggacaagcucgagcugaaaggcaugucuuacgcuaugugcacaaacacguuugugcuuaagaaagaggucuccgaaacccagcacgggacaauccugauuaagguggaguacaagggagaagaugcccccuguaaaaucccuuucagcaccgaggacggccaagggaaggcgcauaacggaagacucauuacagcuaaucccguugugaccaaaaaggaggaacccgucaacaucgaggccgaaccuccguucggcgaguccaauauugugaucgggaucggcgauaacgcccugaaaauuaauugguauaagaagggaucuagcaucggcaaaauguuugaagcuacggcccggggggcuagacgcauggccauucugggagacacagcgugggauuucggcuccguggggggaguucuuaacagccucggcaagaugguccaccagaucuuugggucugccuacaccgcucuguucuccggcgugagcugggugaugaaaauuggaaucggcguccugcucaccuggauugggcugaauucuaagaacacaagcauguccuuuucuugcaucgccaucggagugauuacccuuuaucugggcgcuguugugcaggccgacauggggugugucaucaauuggaaaggaaaggagcucaagugcggcagcgggauuuucgugacaaacgagguucauacguggaccgaacaguacaaauuucaagcggauucccccaagcggcuggccacagcuaucgccggcgcuugggagaauggaguguguggcauuagaagcaccacacgcauggaaaaccugcuuuggaaacagaucgccaaugagcucaacuauauccugugggaaaauaacauuaagcugaccgucgugguuggggacaucauuggagugcucgagcagggcaaacggacgcugaccccucagcccauggagcuuaaguacucuuggaaaacaugggggaaggccaagaucgucaccgcugaaacacaaaacuccagcuucauuaucgauggaccuaauacccccgagugcccgucugcguccagagccuggaacgugugggaaguggaggacuauggcuuuggcgucuucacaaccaauaucuggcugaaacuccgcgaaguuuacacgcagcugugugaccaccggcugaugagcgcugccgugaaggaugagagagccgugcacgcugacaugggguacuggauugagucccagaaaaacggaucuuggaagcuugaaaaagccagccucaucgaggucaagacaugcaccuggccuaagucccauacccuguggucuaauggcgugcuggaaagcgauaugauuauccccaaaucccucgcggggccuauuagccagcacaacuaucgccccggauaccauacacaaaccgcuggcccuuggcaccuggggaagcuugagcuggacuuuaauuauugcgagggaacgacaguugugaucaccgaaaacuguggcacacggggccccucucucagaaccacaaccgucuccgggaaacugauccacgaguggugcugucgcagcugcacgcugccgccucuucgguacaugggagaagauggcuguugguaugggauggagauuagacccaucucugaaaaggaggagaauauggugaaaucccucguuagcgccggaucuggcaagguggacaacuucaccauggggguccugugccuggccauucucuuugaagaggugaugcggggaaaguucggcaaaaagcauaugaucgcuggcguuuucuuuacauucgugcugcuucugagcgggcagauuaccuggcgcgauauggcccacacacucaucaugauuggauccaaugcgagcgacaaaaugggcaugggggucaccuaccuggcucugaucgccacguuuaagauccagcccuuccuugcccugggauuuuuccucagaaaacugacaucucgggaaaaccuccugcuuggcguggggcuggcuauggccaccacacuccaacugccugaggauauugaacagauggcuaauggaaucgcccugggccuuauggcgcugaagcucauuacccaguuugagaccuaucagcuguggacagcccucaucucccugacguguagcaacaccauguucacacuuaccguggcuuggagaacagccacccugauucucgcuggcgucucccugcugccgguuugccaaucuagcuccaugcgcaagacggacuggcuucccauggccguggccgcuaugggggugccuccccugccucucuuuaucuucucucugaaagauacacucaagcggagaagcuggccccugaaugagggagucauggcggugggccuuguuuccauccuggccucuagccugcuccgcaacgacgugccuauggcugggccccuggucgccggaggccuucugauugccuguuacgugaucaccgggaccuccgcugaucucacaguugaaaaagccgcggacauuaccugggaggaagaggcugaacagacaggagugagccauaaccugaugaucacggucgacgaugacggcaccaugagaauuaaggaugacgagacagagaauauccucaccgugcugcuuaaaacagcccugcugaucauuucuggcgucuuuccguacuccaucccugccacccuccugguguggcacacguggcagaagcagacccaacggagcgggguucuuugggaugugcccucuccucccgaaacacagaaagcugagcuggaagagggagucuaucgcauuaagcagcagggcaucuucgggaagacccaagugggaguuggcgugcagaaagagggggucuuucauacaauguggcacgugaccagaggagccgugcucacauacaacggcaagcggcuggaaccgaauugggcguccguuaaaaaggaccucauuagcuauggcgggggauggcgccugucugcucaguggcaaaaaggcgaggaaguccaggugaucgccguggagccugggaagaaccccaagaauuuccagacgaugccuggaaccuuccagacaaccaccggcgaaauuggggccaucgcucuugauuuuaaacccggaacauccggcagccccaucauuaacagagagggcaaggucguggggcuguacggaaauggcguugugacgaaaaacgggggauaugucuccggcaucgcccaaaccaaugcugagccugacgggccgacacccgaacuggaggaagagauguucaagaaacggaaccucaccauuauggaucugcacccuggcagcggaaagacacgcaaguaccuucccgccaucgugagagaagcgauuaaacggcgccugagaacccucauccuggccccuacgcggguuguggcugccgagauggaggaagcucucaagggccugcccaucagauaucagacaaccgccaccaaaucugagcauacagggcgcgaaauugucgaccuuaugugccacgccaccuuuacaaugcggcugcugagcccugugagaguuccgaauuacaaccucaucauuauggaugaggcucauuucaccgaccccgcguccaucgccgcucgcggauacauuucuacgcgggugggcaugggggaagccgccgcuaucuuuaugacagccaccccucccggaacagcggaugcuuucccucagagcaaugcccccauccaggacgaggagagagacauuccggaacgcuccuggaacucuggcaaugaguggaucaccgauuuugccgggaagacggucugguucgugccuagcauuaaagcuggcaacgacaucgccaacugucugcggaagaauggaaagaaagugauucaacuuuccagaaagaccuuugauacagaauaucagaaaaccaagcugaacgacugggauuucgucguuacaaccgacaucucugagaugggcgcgaauuuuaaagccgaucgcgugauugacccccggagaugccucaagcccgugauccugacagaugggccugagcgggucauccuggcuggacccaugccugugaccgccgcuagcgccgcucagcgcagaggccggguugggcgcaacccgcagaaggaaaaugaccaauacauuuucacgggacagccccucaacaaugaugaggaccacgcccauuggacagaagcgaaaaugcuucuggacaacaucaauaccccugagggcauuauccccgcccuguucgaaccugagagagagaaguccgcugccauugauggggaauaucggcucaaaggcgagagcagaaagaccuuuguggaacugaugcgccggggagaccuucccgucuggcuggcucacaaaguggccucugagggcaucaaguacacagauagaaaauggugcuucgacgggcagcgcaacaaucagauccucgaagagaacauggauguugagauuuggaccaaggaaggagagaagaaaaagcugcggccgagauggcuggacgcccgcacauauuccgauccucucgcucuuaaagaauuuaaggacuucgcggccggccggaaaagcaucgcucuggaucuggugacggagauugggagaguccccucucaccucgcccaucgcaccagaaaugcccuggacaaccuugugaugcugcacacauccgaacauggaggccgggcuuaccgccacgccgucgaggagcucccugaaaccauggagacacugcugcuccuuggccugaugauccugcucaccgggggagcgaugcuguuucuuauuagcggcaaggggaucggaaagacguccaucggccugauuugugugaucgccucuagcgggaugcucuggauggcugaaauuccccugcaauggaucgccuccgcuauuguucuggaguucuuuaugauggugcuccuuaucccugagcccgaaaaacagagaaccccgcaggauaaucaacuggccuauguggucauuggaauccugacacucgcggccaucauugcugccaacgagaugggccugcuugaaaccacaaagcgggaccugggcaugagcaaagagccugggguugugucucccaccuccuaccucgauguggaccugcaccccgcuagcgccuggacgcuguacgcugucgccacaaccgugaucacaccuaugcuccgccauaccauugaaaauucuaccgcgaacguuagccuugccgcuaucgccaaccaggcugugguccugaugggacuggacaagggcuggccgauuuccaaaauggaucucggggugccccugcuugcccugggaugcuauucucaggucaauccucucacacugacggccgcggugcugcuccuuaucacccacuacgcuaucauuggccccgggcugcaggccaaggcuacaagagaggcccaaaagcggaccgccgcuggaaucaugaaaaacccuacaguugacggcauuaugaccaucgaucuggaccccgugauuuaugauagcaaguucgagaaacagcucggccaggucaugcugcuugugcugugugccguucagcuccugcugaugagaacguccugggcgcucugcgaagcccuuacacuggcuaccgggccuaucaccacacugugggagggaucuccgggcaaguuuuggaauaccacaaucgccgugagcauggcuaacauuuuccgcggguccuaccucgccggagcgggccuggccuuuagcaucaugaaaucugucgggacgggaaagcggggcaccggcucccaaggggaaacacuuggagagaaguggaaaaagaaacugaaucagcucagcagaaaggaauucgaccuguauaaaaaguccggcauuaccgagguggaucgcacagaggcuaaagaagggcugaagcggggagagaccacgcaucacgccgugucuagaggcaccgcuaagcuccagugguuuguugaacggaacauggucauccccgaggggcgcgugauugaccuuggauguggcagaggcggguggagcuacuauugcgccggacugaaaaaggugacagaaguccggggcuacaccaaagggggaccuggccaugaggagcccguuccuauguccacauacggguggaauaucgugaagcugaugucuggaaaagauguguucuaucuccccccggaaaagugugacacccugcuuugcgauauuggcgagagcuccccuagccccacagucgaagagucucgcaccaucagagugcugaagaugguugagcccuggcucaaaaacaaucaguucuguaucaaggugcugaacccuuacaugcccacggucauugaacaccuggagcggcuccaacgcaaacacggcgggaugcuugugagaaauccucugucccggaacagcacacaugaaauguauuggaucucuaauggaaccggcaacauuguugcuuccgugaauauggucagccgccugcuccugaacagauuuaccaugacacaccggagaccgacgaucgagaaggacguggaucuuggggccggaacccgccaugugaacgcggaacccgagacaccuaauauggacgucauuggcgagcggaucaaaagaaucaaggaagagcacaacucuaccuggcacuacgacgaugaaaaucccuauaagacaugggccuaccaugggagcuaugagguuaaagcuaccggauccgccucuagcaugauuaacggcguggugaagcugcucacaaaaccuugggacgucgugcccaugguuacccagauggcuaugacggauaccacaccguucggccagcaacgcguguuuaaggaaaaagucgacacccggacaccuagauccaugcccgggacccgccgggugaugggaaucacggccgaguggcuguggagaacacugggccgcaauaagaagccucggcucugcaccagagaggaauucacaaaaaagguucgcaccaacgccgcgaugggggcuguguuuacggaggaaaaucagugggauagcgccaaagccgcugucgaggacgaagauuucuggaagcugguggaccgggagagagagcuucacaaacugggaaaguguggcuccugcguuuacaacaugauggggaaacgcgaaaagaagcucggcgaguuuggaaaagccaagggcucuagagcuauuugguacauguggcugggggcccgguaucuugaauucgaggcgcugggauuucucaaugaggaucauugguucagccgcgaaaacuccuacucuggcguggagggggaaggacugcacaaacugggcuauauccucagagacauuagcaagauccccgggggcgccauguacgcugaugacaccgccggaugggacacacggaucaccgaggaugaccugcauaaugaagagaaaauuacacagcagauggauccugagcacagacaacuugcuaacgccaucuuuaagcugaccuaucagaauaaggucgugaaaguccagcggcccacaccgaccggcacggugauggacauuaucucccgcaaggaucagagagggucuggacaaguuggcacauacgggcucaacaccuucaccaauauggaagcgcagcugauucggcagauggagggagaaggcgugcuuagcaaagccgaccuggagaacccucaccuccccgaaaagaaaaucacacaguggcuggagaccaagggggucgagcgccugagacggauggcuaucuccggcgaugacugcguggugaagcccauugaugaccgcuuugccaacgcucuccuggcccuuaaugauaugggaaaaguuagaaaggacaucccucaauggcagccgagcaaaggcuggcaugauuggcagcaggugcccuucuguucucaccauuuccacgaacugauuaugaaggacgggcggaaacucgucgugccuugccgcccccaagacgagcugaucggaagagcucggauuucccagggcgccggguggagccuucgcgaaacagcgugucugggaaaggccuaugcucagauguggucucucauguacuuucacagacgggaucugcgccuggccuccaacgccaucugcagcgcuguuccugugcauuggguccccacgucuagaaccacaugguccauucacgcccaucaccaauggaugaccacagaggacaugcucaccguguggaaucgggucuggaucgaagauaacccuuggauggaggacaagacgcccgugaccacaugggagaauguuccguaccugggcaaaagagaagaucaguggugugggagccuuaucggccugaccucccgcgcgacaugggcucagaacauuccuaccgccauccagcaagugcggagccucauuggaaaugaggaauuccuggacuauaugcccucuaugaagagauuucgcaaagaggaggaaagcgagggcgccaucugguga

SEQ ID NO: 20707 - RNA, 9873 nt, Artificial Sequence
  derived and/or modified CDS sequence (opt5) from DENV-3__FJ182010__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucgugcugcuuaugcugguuacaccuucuaugaccaugagaugugugggagucggcaaccgggacuuuguggaagggcucagcggagccacauggguggaugucguucuggagcacggcgggugcgugaccaccauggcuaagaauaaacccacacuggacaucgagcuccagaagacggaagccacccaacuggcgacacuucgcaaacuguguauugagggaaagaucaccaacauuacaaccgauuccagaugcccuacgcagggcgaagccgugcucccggaggaacaggaccagaauuaugucuguaaacacacauacguggaucggggcugggggaacggaugcggccuguucgggaagggaagccuuguuaccugcgcuaaguuucaaugucuggagcccaucgagggcaaagugguccaguaugaaaaucucaaguacaccgugauuaucacaguucauaccggggaccagcaccaggugggaaacgagacacaaggcgucacggccgaaaucaccccucaggcuucuacaaccgaggccauucugcccgaauauggcacacuggggcucgagugcuccccucgcaccggacuggacuucaaugagaugauccuucugacgaugaaaaacaaggccuggauggugcauagacagugguuuuucgaucucccccugccguggaccagcggcgcuacaaccgaaacaccuaccuggaaucggaaagagcuucuggucacguuuaagaacgcgcacgccaaaaagcaagaagugguugugcucgggucucaggagggagcuaugcacacagcccugaccggcgccacagaaauucagaauuccgggggcaccagcaucuucgcuggacaucugaagugucgccucaaaauggacaagcuggagcuuaaaggcaugucuuacgccaugugcaccaacacauuuguccugaagaaagagguguccgaaacgcagcacgggaccauucucaucaagguugaguacaagggagaagaugcgcccuguaaaaucccuuucagcacagaggacggccaagggaaggcucauaacggaagacugauuaccgccaaucccguggucacaaaaaaggaggaacccgugaacaucgaggccgaaccuccguucggcgaguccaauauugugaucgggauuggcgauaacgcucugaaaaucaauugguauaagaagggaucuagcaucggcaaaauguuugaagccaccgcucggggggccagacgcauggcgauucuuggagacacggccugggauuucggcuccguugggggaguccucaacagccugggcaagauggugcaccagaucuuugggucugcuuacacagcccuguucuccggcgugagcugggucaugaaaauuggaaucggcgugcuccugaccuggauugggcuuaauucuaagaacaccagcauguccuuuucuugcaucgcuauuggaaucaucacacuguaucucggcgccguugugcaggcggacaccgggugugucauuaauuggaaaggaaaggagcugaagugcggcagcgggaucuucgugacaaacgagguucauacguggaccgaacaguacaaauuucaagccgauucccccaagcggcuggcuacagccauugcuggcgccugggagaauggaguguguggcaucagaagcaccacacgcauggaaaaccuucucuggaaacaggucgccaaugagcugaacuauauucugugggaaaauaacaucaagcucaccgugguugugggggacaucauuggaguccuggagcagggcaaacggacgcuuaccccucagcccauggagcugaaguacucuuggaaaacaugggggaaggcuaagaucgugaccgcggaaacacaaaacuccagcuucauuaucgauggaccuaauacccccgagugcccgucugccuccagagcuuggaacgugugggaagucgaggacuauggcuuuggcguuuucacaaccaauauuuggcucaaacugcgcgaaguguacacgcagcugugugaccaccggcuuaugagcgccgccgugaaggaugagagagcuguccacgccgacaugggguacuggaucgagucccagaaaaacggaucuuggaagcucgaaaaagcgagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauucacgaguggugcugucgcagcugcacgcuuccgccucuccgguacaugggagaagauggcuguugguaugggauggagaucagacccaucucugaaaaggaggagaauaugguuaaaucccuggugagcgccggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcgcacacacugaucaugauuggauccaaugcuagcgacagaaugggcaugggggugaccuaccuggcccuuaucgccacguuuaaaauucagcccuuccuggcucucggauuuuuccugcggaagcucacaucuagagaaaaccugcuucugggcguggggcucgccauggcuaccacacugcaacugccugaggauaucgaacagauggccaauggaaucgcgcuuggccugauggcccucaaacugauuacccaguuugagaccuaucagcucuggacagcucugaucucccuuacguguagcaacaccauuuucacacugaccgucgccuggcgcacagcuacccucauccuggccggcguuucccugcuuccggugugccaaucuagcuccaugcggaagucugacuggcugcccaugacgguggccgcuaugggggucccuccccucccucuguuuauuuucagccucaaggauacacugaaaagacgcuccuggccccuuaaugagggagugauggcgguuggccuggugucuauccuggccagcucccuccugagaaacgacgucccuauggcugggccccuuguggccggaggccugcucaucgccuguuacguuauuaccgggaccagcgcugaucugacaguggaaaaggccgcggacgucaccugggaggaagaggcugaacagacaggagugucucauaaccucaugaucacggucgacgaugacggcaccaugcggauuaaagaugacgagacagagaauauccugaccgugcuucugaagacagcccugcucauuguuuccggcaucuuuccguacagcaucccugccacccugcuuguguggcacacguggcagaaacagacccgcagaucugggguccugugggaugugcccuccccucccgaaacacaaaaggcugagcucgaagagggaguuuaucggauuaaacagcagggcaucuucgggaagacccaggugggagucggcgugcaaaaggaggggguguuucauacaauguggcacguuacccgcggagccguccugacauacaacggcaaaagacucgaaccgaauugggcgagcgugaagaaagaccugauuucuuauggcgggggauggcggcuuuccgcucaguggcagaagggcgaggaagugcaagucaucgccguggagccugggaaaaaccccaagaauuuccagacgaugccuggaaccuuccagacaaccaccggcgaaauuggggccaucgcucuggauuuuaagcccggaacaagcggcucccccauuaucaaccgcgagggcaaaguuguggggcuguacggaaauggcgucgugacgaagaacgggggauauguuagcggcaucgcccagaccaaugcugagccugacgggccgacacccgaacucgaggaagagauguucaaaaagagaaaccugaccauuauggaucuucacccuggcucuggaaaaacacggaaguaccugcccgccaucgugcgcgaagcgauuaagagacggcucagaacccugauccucgccccuacgcgcgucguggcugccgagauggaggaagcucugaaaggccuucccauucgguaucaaacaaccgccaccaagagcgagcauacagggagagaaaucguugaccugaugugccacgccaccuuuacaaugcgccugcucuccccugugcgggucccgaauuacaaccugaucauuauggaugaggcucauuucaccgaccccgcgucuaucgccgcuagaggauacauuagcacgcgcgugggcaugggggaagccgccgcuaucuuuaugacagccaccccucccggaacagcggaugcuuucccucaguccaaugcccccauucaggacgaggagcgggacaucccggaaagaucuuggaacagcggcaaugaguggaucaccgauuuugccgggaaaacggugugguucgucccuuccauuaaggcuggcaacgacaucgccaacugucuucgcaaaaauggaaagaagguuauucagcugucucggaaaaccuuugauacagaauaucaaaagaccaaacucaacgacugggauuucguggugacaaccgacaucagcgagaugggcgcgaauuuuaaggccgauagagucauugacccccggcgcugccugaaacccgugauccugacagaugggccugagagaguuauucucgcuggacccaugccugugaccgccgcuuccgccgcucagcggcgcggcagagucgggcggaacccgcagaaggaaaaugaccaguacaucuucacgggacaaccccuuaacaaugaugaggaccacgcccauuggacagaagcgaagaugcugcuggacaacaucaauaccccugagggcauuauccccgcccucuucgaaccugagagagagaaaagcgcugccauugauggggaauaucgccugaagggcgagucucggaaaaccuuuguggaacuuaugagacgcggagaccugcccguuuggcucgcucacaagguggccuccgagggcaucaaauacacagaucggaaguggugcuucgacgggcagagaaacaaucagauucuggaagagaacauggaugucgagaucuggaccaaagaaggagagaagaagaaacugcgcccgcgguggcucgacgccagaacauauagcgauccucuugcucugaaggaauuuaaagacuucgcggccggccgcaagucuaucgcucuggaucucgugacggagauugggagaguccccucccaccuggcccaucggacccgcaaugcccuugacaaccuggugaugcuccacacaagcgaacauggaggcaaagcuuacagacacgccguugaggagcugccugaaaccauggagacacugcuccuucugggccugaugauccuccugaccgggggagcgaugcuuuuucugauuuccggcaaggggaucggaaagacgucuauuggccucaucugugugaucgccagcuccgggaugcuguggauggcugaaauuccccugcaguggaucgccagcgcuauugugcucgaguucuuuaugaugguccuucugaucccugagcccgaaaaacaacggaccccgcaggauaaucagcuggccuauguugugauuggaauccucacacuggcggccauuaucgcugccaacgagaugggccuucuggaaaccacaaagcgcgaccucggcaugucuaaagagccugggguggucucccccaccagcuaccuggauguggaccugcaccccgcuucugccuggacgcucuacgcuguugccacaaccgugaucacaccuaugcuuagacauaccauugaaaauagcaccgcgaacgucucccuggccgcuaucgccaaccaagcugugguccugaugggacucgacaagggcuggccgauuucuaaaauggaucugggggugccccuucuggcccucggaugcuauagccagguuaauccucugacacugacggccgcggugcuccuucugaucacccacuacgcuauuaucggccccgggcugcaggccaaggcuacacgggaggcccagaagagaaccgccgcuggaaucaugaaaaacccuacagucgacggcauuaugaccaucgaucucgaccccgugauuuaugauuccaaguucgagaaacaacugggccagguuaugcuucuggugcucugugccguccagcugcugcucaugcgcacgucuugggcgcuuugcgaagcccugacacuggcuaccgggccuaucaccacacucugggagggaagcccgggcaaguuuuggaauaccacaauugccguguccauggcuaacaucuuccgggggagcuaccuggccggagcgggccuugccuuuucuaucaugaaauccguggggacgggaaagagaggcaccggcagccagggggaaacacugggagagaaguggaaaaagaaacucaaucaacugucccgcaaggaauucgaccuguauaaaaagucuggcauuaccgagguugaucggacagaggcuaaagaagggcucaagagaggagagaucacccaucacgccgucagccggggcuccgcuaagcuucagugguuuguggaacgcaacauggugauucccgaggggagagucaucgaccugggauguggccggggcggguggucuuacuauugcgccggacugaaaaagguuacggaagugcgcggcuacaccaaagggggaccuggccaugaggagcccgugccuaugagcacauacggguggaauauugucaagcucauguccggaaaagauguguucuaucugcccccggaaaagugugacacccuucugugcgauaucggcgagagcucuccuucccccacaguugaagagagcagaaccauucgggugcucaagauggucgagcccuggcugaaaaacaaucaguucuguaucaaggugcugaacccuuacaugcccacaguuaucgaacaccucgagcgccuucagagaaaacacggcgggaugcuggugcggaauccucugucucgcaacuccacccaugaaauguauuggauuagcaauggaacgggcaacaucgucgcuucugugaauauggugagcagacuccugcuuaaccgguuuacaaugacccacagacgcccgaccauugagaaggacgucgaucugggggccggaacacggcauguuaacgcggaacccgagacgccuaauauggacgugaucggcgagagaauuaaacgcaucaaggaagagcacaacuccaccuggcacuacgacgaugaaaaucccuauaagacaugggccuaccaugggucuuaugaggugaaagcuaccggaagcgccuccagcaugaucaacggcgucgugaagcuccugacaaaaccuugggacguugugcccauggucacccaaauggcuaugacagauaccacgccguucggccagcagcggguguuuaaggaaaaaguugacaccagaacaccucgcuccaugcccgggacccggagagugaugggaauuacagccgaguggcuguggcgcacccucggccggaauaagaagccuagacugugcacgcgcgaggaauucacaaaaaagguccggaccaacgccgcgaugggggcuguguuuacagaggaaaaucaaugggauucugccaaagccgcuguugaggacgaagauuucuggaagcuuguggacagagagcgcgagcugcacaaacucggaaaguguggcagcugcgucuacaacaugauggggaaaagagaaaagaagcugggcgaguuuggaaaagccaagggcucccgggcuaucugguacauguggcuuggggcccgcuaucuggaauucgaggcgcucggauuucugaaugaggaucauugguucucuagagaaaacagcuacuccggcguggagggggaaggacugcacaaacucggcuauauucugcgggacaucucuaagauucccgggggcgccauguacgcugaugacaccgccggaugggacacgagaaucaccgaggaugaccuucauaaugaagagaaaaucacacagcagauggauccugagcaccggcagcuggcugacgccauuuuuaagcucaccuaucaaaacaaggucgugaaaguucagcgccccacaccgaccggcacagugauggauaucauuagcagaaaggaccagcggggguccggacaggucggcaccuacgggcugaauacguucacaaacauggaagcgcaacuuauccgccagauggagggagaaggcgugcugaccaaagccgaucucgagaauccucaccugagcgaaaagaaaauuacccaguggcuggagacaaaggggguggagagacucaagcggauggcuaucucuggcgacgauugcguugugaaacccaucgacgaucgcuuugccaacgcucugcuugcccugaacgacaugggaaaggucagaaaagauauuccccaguggcaaccuuccaagggcuggcaugacuggcagcaggugccguucuguagccaccauuuccacgaacucaucaugaaagacgggcggaagcugguugugcccugccgcccucaggaugagcuuauuggaagagcucggaucucucaaggcgccggguggucccugcgcgaaaccgcgugucucggaaaggccuaugcucagauguggagccugauguacuuucacagacgggaccugcgccucgccucuaaugccauuugcuccgcuguccccgugcauugggucccuacaagcagaacgaccugguccauccacgcccaucaccaguggaugacaaccgaggauaugcugacaguguggaaccggguuuggauugaagacaaucccuggauggaggauaaaaccccugugacgaccugggagaacguccccuaccuuggcaagagagaagaccaauggugugggagccugaucggccucacaucucgcgcgaccugggcucagaauaucccgacagccauucagcaggugcggagccugaucggaaacgaggaauuccuugauuauaugccuuccaugaaaagauuucgcaaggaggaggaaucugagggcgccauuugguga

SEQ ID NO: 20708 - RNA, 9873 nt, Artificial Sequence
  derived and/or modified CDS sequence (opt5) from DENV-3__FJ182011__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccagaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagaugcgcccuguaaaauuccuuucagcacagaggacggccaagggaaggcucauaacggaagacugaucaccgccaaucccguugugacaaaaaaggaggaacccgucaacauugaggccgaaccuccguucggcgaguccaauaucgugauugggaucggcgauaacgcucugaaaaucaauugguauaagaagggaucuagcauuggcaaaauguuugaagccaccgcucggggggccagacgcauggcgauccuuggagacacggccugggauuucggcuccguggggggaguucucaacagccugggcaagaugguccaccagauuuuugggucugcuuacacagcccuguucuccggcgugagcugggugaugaaaaucggaauuggcguccuccugaccuggaucgggcuuaauucuaagaacaccagcauguccuuuucuugcauugcuaucggaaucauuacacuguaucucggcgccgugguucaggcggacaccgggugugugaucaauuggaaaggaaaggagcugaagugcggcagcgggauuuucgucacaaacgaggugcauacguggaccgaacaguacaaauuucaagccgauucccccaagcggcuggcuacagccaucgcuggcgccugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggcuaagaucgugaccgcggaaacacaaaacuccagcuucauuaucgauggaccuaauacccccgagugcccgucugccuccagagcuuggaacgucugggaaguggaggacuauggcuuuggcguguucacaaccaauaucuggcucaaacugcgcgaagucuacacgcagcugugugaccaccggcuuaugagcgccgccguuaaggaugagagagcugugcacgccgacaugggguacuggauugagucccagaaaaacggaucuuggaagcucgaaaaagcgagccugaucgaggugaagacaugcaccuggccuaagucccauacccuguggucuaauggcguccucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacagugguuaucaccgauaacuguggcacacggggccccucucugagaaccacaaccguguccgggaaacugauccacgaauggugcugucgcagcugcacgcuuccgccucuccgguacaugggagaggacggcuguugguaugggauggaaauuagacccaucucugagaaggaagagaauauggucaaaucccuggugagcgccggaucuggcaagguugauaacuucaccaugggggugcugugccucgcuauucuguuugaggaagucaugcggggaaaguucggcaaaaagcauaugaucgccggcguguucuuuacauucguucuucugcucagcgggcagauuaccuggcgcgacauggcgcacacacugaucaugauuggauccaaugcuagcgauagaaugggcaugggggugaccuaccuggcccuuaucgccacguuuaaaauccagcccuuccuggcucucggauuuuuccugcggaagcucacaucuagagagaaccugcuucugggcgucgggcucgccauggcuaccacacugcaacugccugaagacauugagcagauggccaauggaaucgcgcuuggccugauggcccucaaacugauuacccaguuugaaaccuaucagcucuggacagcucugaucucccuuacguguagcaacaccauuuucacacugaccguggccuggcgcacagcuacccucauccuggccggcgugucccugcuuccggucugccaaucuagcuccaugcggaagucugauuggcugcccaugacgguugccgcuaugggggugccuccccucccucuguuuaucuucagccucaaggacacacugaaaagacgcuccuggccccuuaaugagggagugauggcggucggccuggugucuauucuggccagcucccuccugagaaacgauguuccuauggcugggccccuuguggccggaggccugcucaucgccuguuacgucauuaccgggaccagcgcugaccugacaguggagaaggccgcggacguuaccugggaagaggaagcugagcagacaggagugucucauaaccucaugaucacggucgaugacgauggcaccaugcggauuaaagacgaugaaacagagaauauccugaccgugcuucugaagacagcccugcucaucgucuccggcauuuuuccguacagcaucccugccacccugcuuguguggcacacguggcagaaacagacccgcagaucugggguucugugggacgugcccuccccucccgagacacaaaaggcugaacucgaggaaggagucuaucggauuaaacagcagggcaucuucgggaagacccaggugggaguuggcgugcaaaaggagggggucuuucauacaauguggcacgugacccgcggagccgugcugacauacaacggcaaaagacucgagccgaauugggcgagcguuaagaaagaucugauuucuuauggcgggggauggcggcuuuccgcucaguggcagaagggcgaagagguccaagugaucgccguggaaccugggaaaaaccccaagaauuuccagacgaugccuggaaccuuccagacaaccaccggcgagauuggggccaucgcucuggacuuuaagcccggaacaagcggcucccccaucauuaaccgcgaaggcaaagucguggggcuguacggaaauggcguugugacgaagaacgggggauaugucagcggcaucgcccagaccaaugcugagccugaugggccgacacccgagcucgaagaggaaauguucaaaaagagaaaccugaccauuauggaccuucacccuggcucuggaaaaacacggaaguaccugcccgccaucgugcgcgaggcgauuaagagacggcucagaacccugauccucgccccuacgcgcguuguggcugccgaaauggaggaggcucugaaaggccuucccauccgguaucaaacaaccgccaccaagagcgaacauacagggagagagauugucgaucugaugugccacgccaccuuuacaaugcgccugcucuccccugugcggguuccgaauuacaaccugaucauuauggacgaagcucauuucaccgaucccgcgucuaucgccgcuagaggauacauuagcacgcgcgugggcaugggggaggccgccgcuaucuuuaugacagccaccccucccggaacagcggacgcuuucccucaguccaaugcccccauccaggacgaagagcgggauauuccggagagaucuuggaacagcggcaaugaauggaucaccgacuuugccgggaaaacggucugguucgugccuuccauuaaggcuggcaacgauaucgccaacugucuucgcaaaaauggaaagaaggugauucagcugucucggaaaaccuuugacacagaguaucaaaagaccaaacucaacgauugggacuucgucguuacaaccgauaucagcgaaaugggcgcgaauuuuaaggccgacagagugauugauccccggcgcugccugaaacccgugauccugacagacgggccugagagagucauccucgcuggacccaugccugugaccgccgcuuccgccgcucagcggcgcggcagaguugggcggaacccgcagaaggagaaugaucaguacauuuucacgggacaaccccuuaacaaugacgaagaccacgcccauuggacagaggcgaagaugcugcuggauaacaucaauaccccugaaggcauuauccccgcccucuucgagccugaaagagagaaaagcgcugccauugacggggaguaucgccugaagggcgaaucucggaaaaccuuuguggagcuuaugagacgcggagaucugcccgucuggcucgcucacaagguggccuccgaaggcaucaaauacacagaccggaaguggugcuucgaugggcagagaaacaaucagauccuggaggaaaacauggacguugagauuuggaccaaagagggagaaaagaagaaacugcgcccgcgguggcucgaugccagaacauauagcgacccucuugcucugaaggaguuuaaagauuucgcggccggccgcaagucuaucgcucuggaccucgugacggaaauugggagaguccccucccaccuggcccaucggacccgcaaugcccuugauaaccuggugaugcuccacacaagcgagcauggaggcaaagcuuacagacacgccgucgaagagcugccugagaccauggaaacacugcuccuucugggccugaugauccuccugaccgggggagcgaugcuuuuucugauuuccggcaaggggaucggaaagacgucuaucggccucauuugugugaucgccagcuccgggaugcuguggauggcugagauuccccugcaguggaucgccagcgcuauuguucucgaauucuuuaugauggugcuucugaucccugagcccgagaaacaacggaccccgcaggacaaucagcuggccuauguggucauuggaauccucacacuggcggccaucauugcugccaacgaaaugggccuucuggagaccacaaagcgcgaucucggcaugucuaaagaaccugggguugugucccccaccagcuaccuggacguggaccugcaccccgcuucugccuggacgcucuacgcugucgccacaaccgugaucacaccuaugcuuagacauaccauugagaauagcaccgcgaacguuucccuggccgcuaucgccaaccaagcugugguccugaugggacucgauaagggcuggccgauuucuaaaauggaccugggggugccccuucuggcccucggaugcuauagccaggucaauccucugacacugacggccgcggugcuccuucugaucacccacuacgcuaucauuggccccgggcugcaggccaaggcuacacgggaagcccagaagagaaccgccgcuggaaucaugaaaaacccuacaguugauggcauuaugaccaucgaccucgaucccgugauuuaugacuccaaguucgagaaacaacugggccaggucaugcuucuggugcucugugccguucagcugcugcucaugcgcacgucuugggcgcuuugcgaggcccugacacuggcuaccgggccuaucaccacacucugggaaggaagcccgggcaaguuuuggaauaccacaaucgccguguccauggcuaacauuuuccgggggagcuaccuggccggagcgggccuugccuuuucuaucaugaaauccgucgggacgggaaagagaggcaccggcagccagggggagacacugggagaaaaguggaaaaagaaacucaaucaacugucccgcaaggaguucgaucuguauaaaaagucuggcauuaccgaaguggaccggacagaggcuaaagaggggcucaagagaggagaaaucacccaucacgccgugagccggggcuccgcuaagcuucagugguuuguugagcgcaacauggucauucccgaagggagagugaucgaucugggauguggccggggcggguggucuuacuauugcgccggacugaaaaaggugacggagguccgcggcuacaccaaagggggaccuggccaugaagagcccguuccuaugagcacauacggguggaauauugugaagcucauguccggaaaagacguguucuaucugcccccggagaagugugauacccuucugugcgacaucggcgaaagcucuccuucccccacagucgaggaaagcagaaccauccgggugcucaagaugguugagcccuggcugaaaaacaaucaguucuguauuaaggugcugaacccuuacaugcccacagucaucgagcaccucgaacgccuucagagaaaacacggcgggaugcuggugcggaauccucugucucgcaacuccacccaugagauguauuggauuagcaauggaacgggcaacaucguugcuucugugaauauggucagcagacuccugcuuaaccgguuuacaaugacccacagacgcccgaccauugaaaaggauguggaccugggggccggaacacggcaugugaacgcggagcccgaaacgccuaauauggacgucaucggcgagagaaucaaacgcauuaaggaggaacacaacuccaccuggcacuacgaugacgagaaucccuauaagacaugggccuaccaugggucuuaugaaguuaaagcuaccggaagcgccuccagcaugaucaacggcguggugaagcuccugacaaaaccuugggaugucgugcccaugguuacccaaauggcuaugacagacaccacgccguucggccagcagcggguguuuaaggagaaagucgauaccagaacaccucgcuccaugcccgggacccggagagugaugggaauuacagccgaauggcuguggcgcacccucggccggaauaagaagccuagacugugcacgcgcgaggaguucacaaaaaagguucggaccaacgccgcgaugggggcuguguuuacagaagagaaucaaugggacucugccaaagccgcugucgaagaugaggacuucuggaagcuuguggauagagaacgcgagcugcacaaacucggaaaguguggcagcugcguuuacaacaugauggggaaaagagagaagaagcugggcgaauuuggaaaagccaagggcucccgggcuaucugguacauguggcuuggggcccgcuaucuggaguucgaagcgcucggauuucugaaugaggaccauugguucucuagagagaacagcuacuccggcguggaaggggagggacugcacaaacucggcuauauucugcgggauaucucuaagauccccgggggcgccauguacgcugacgacaccgccggaugggauacgagaauuaccgaagacgaucuucauaaugaggaaaaaaucacacaccagauggacccugagcaccggcagcuggcuaacgccauuuuuaagcucaccuaucagaauaaggucgugaaaguccaacgccccacaccgaccggcacagugauggauaucauuagcagaaaggaccagcggggguccggacagguuggcaccuacgggcugaacacguucacaaauauggaggcgcagcuuauccgccaaauggaaggagagggcgugcugagcaaagccgaucucgaaaacccucaucugucugagaagaaaaucacccaguggcuggaaaccaagggggucgagagacucaagcggauggcuauuuccggcgacgauugcguggugaaacccaucgacgaucgcuuugccaacgcucugcuugcccugaaugacaugggaaagguuagaaaagauauuccccaguggcagccuagcaagggcuggcacgacuggcaacaggugccguucuguucucaucacuuccacgagcucaucaugaaagacgggcggaagcuggucgugcccugccgcccucaggaugaacuuauuggaagagcucggaucucccagggcgccggguggagccugcgcgagacagcgugucucggaaaggccuaugcucaaauguggucucugauguacuuucauagacgggaccugcgccucgccuccaacgccauuugcagcgcuguucccgugcacugggucccuaccuccagaacaacguggagcauccaugcccaccaucaguggaugaccacagaagauaugcugaccguguggaaucgggucuggaucgaggacaaccccuggauggaagauaaaacaccugugaccacgugggagaauguucccuaccuuggcaagagagaggaccaguggugugggucucugauuggccucaccagccgcgcgacaugggcucaaaacaucccgaccgccauucagcaggugcggucccugaucggaaaugaagaguuccuugauuauaugccuucuaugaaaagauuucgcaaggaagaggagagcgaaggcgccauuugguga

SEQ ID NO: 20709 - RNA, 9873 nt, Artificial Sequence
  derived and/or modified CDS sequence (opt5) from DENV-3__FJ182038__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggcccggggggcuagacgcauggccauccuuggagacacagcgugggauuucggcuccguggggggaguucucaacagccugggcaagaugguccaccagauuuuugggucugccuacaccacccuguucuccggcgugagcugggugaugaaaaucggaauuggcguccuccugacauggaucgggcuuaauucuaagaacaccagcauguccuuuucuugcauugcuaucggagugaucacacuguaucucggcgccguugugcaggcugacauggggugugucauuaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcaagguggacaacuucacaauggggguccugugccucgccauccuguuugaagaggugaugcggggaaaguucggcaaaaagcauaugauugccggcguuuucuuuaccuucgugcuucugcucagcgggcagaucacauggcgcgauauggcucacacccugauuaugaucggauccaaugccagcgacaaaaugggcaugggggucacguaccuggcgcuuauugcuacauuuaagauccagcccuuccuggcccucggauuuuuccugagaaaacucaccucucgggaaaaccugcuucugggcguggggcucgccauggcuacaacccugcaacugccugaggauaucgaacagauggccaauggaauugcucuuggccugauggcccucaagcugaucacccaguuugagacauaucagcucuggacggcgcugauuucccuuaccuguagcaacacaauguucacccugacaguggccuggagaaccgcuacgcucauccuggccggcgucucccugcuuccgguuugccaaucuagcuccaugcgcaagacagacuggcugcccauggcuguggccgccaugggggugccuccccucccucuguuuauuuucucucucaaagauacccugaagcggagaagcuggccccuuaaugagggagucauggcugugggccugguuuccauccuggcgucuagccuccugcgcaacgacgugccuauggccgggccccuugucgcuggaggccugcucaucgccuguuacgugauuaccgggacauccgccgaucugaccguugaaaaagcugccgacaucacaugggaggaagaggcggaacagacgggagugagccauaaccucaugauuaccgucgacgaugacggcacaaugagaaucaaggaugacgagaccgagaauauucugacagugcuucugaaaaccgcucugcucaucgucucuggcguguuuccguacuccaucccugccacgcugcuuguuuggcacaccuggcagaagcagacacaacggagcggggugcugugggauguccccucuccucccgaaacccagaaagccgagcucgaagagggaguguaucgcauuaagcagcagggcaucuucgggaagacacaaguuggagugggcguccagaaagaggggguguuucauaccauguggcacgugacaagaggagcuguucugacguacaacggcaagcggcucgaaccgaauugggccuccgucaaaaaggaccugauuagcuauggcgggggauggcgccuuucugcgcaguggcaaaaaggcgaggaagugcaggugaucgcugucgagccugggaagaaccccaagaauuuccagaccaugccuggaacauuccagaccaccacaggcgaaauuggggccaucgcccuggauuuuaaacccggaacguccggcagccccauuaucaacagagagggcaaggugguugggcuguacggaaauggcguggucaccaaaaacgggggauauguguccggcaucgcucaaacaaaugccgagccugacgggccgacccccgaacucgaggaagagauguucaagaaacggaaccugacaauuauggaucuucacccuggcagcggaaagacccgcaaguaccugcccgcuaucguuagagaagccauuaaacggcgccucagaacgcugauccucgcgccuacacggguggucgccgcugagauggaggaagcccugaagggccuucccauuagauaucagaccaccgcuacaaaaucugagcauaccgggcgcgaaaucguggaccugaugugccacgccacauuuaccaugcggcugcucagcccuguuagagugccgaauuacaaccugaucauuauggaugaggcccauuucacggaccccgcuuccaucgcggcccgcggauacauuucuacacgggucggcaugggggaagcugccgccaucuuuaugaccgcuacaccucccggaaccgccgaugcguucccucagagcaaugcucccauucaggacgaggagagagacaucccggaacgcuccuggaacucuggcaaugaguggaucacggauuuugccgggaagaccgugugguucgugccuagcauuaaagccggcaacgacaucgcuaacugucuucggaagaauggaaagaaagucauucaacuguccagaaagacauuugauaccgaauaucagaaaacaaagcucaacgacugggauuucguugugaccacagacaucucugagaugggcgccaauuuuaaagcggaucgcgugauugacccccggagaugccugaagcccgucauccugaccgaugggccugagcgggugauucucgccggacccaugccuguuacggcugccagcgcugcccagcgcagaggccggguggggcgcaacccgcagaaggaaaaugaccaauacaucuucaugggacagccccuuaacaaugaugaggaccacgcucauuggacagaagccaaaaugcugcuggacaacaucaauaccccugagggcauuauccccgcgcucuucgaaccugagagagagaaguccgccgcuauugauggggaauaucggcugaaaggcgagagcagaaagaccuuugucgaacuuaugcgccggggagaccugcccguguggcucgcccacaaaguugcuucugagggcaucaaguacacagauagaaaauggugcuucgacgggcagcgcaacaaucagauucuggaagagaacauggauguggagaucuggaccaaggaaggagagaagaaaaagcugcggccgagauggcucgacgcccgcacauauuccgauccucuugcccugaaagaauuuaaggacuucgcugcgggccggaaaagcaucgcccuggaucucgucacggagauugggagagugcccucucaccuggcucaucgcaccagaaaugcccuugacaaccuggucaugcuccacacauccgaacauggaggccgggccuaccgccacgcuguggaggagcugccugaaaccauggagacacugcuccuucugggccugaugauccuccugaccgggggagccaugcuuuuucugauuagcggcaaggggaucggaaagacguccauuggccucaucuguguuaucgcgucuagcgggaugcuguggauggccgaaauuccccugcaauggaucgcuuccgccauugugcucgaguucuuuaugauggugcuucugaucccugagcccgaaaaacagagaaccccgcaggauaaucaacuggcuuaugucguuauuggaauccucacacuggccgcgaccauugccgcuaacgagaugggccuucuggaaacaaccaagcgggaccucggcaugagcaaagagccugggguggugucucccacguccuaccuggaugucgaccugcaccccgccagcgcuuggacacucuacgccguggcuaccacaguuaucaccccuaugcuucgccauaccaucgaaaauucuacagccaacgugagccuggcggccauugcuaaccaggccgucgugcugaugggacucgacaagggcuggccgaucuccaaaauggaucugggggucccccuucuggcucucggaugcuauucucaggugaauccucugacgcugaccgccgccguucuccuucugauuacacacuacgcgaucauuggccccgggcugcaggcuaaggccaccagagaggcucaaaagcggacagccgccggaaucaugaaaaacccuaccguggacggcaucaugacgauugaucucgaccccgucaucuaugauagcaaguucgagaaacagcugggccaggugaugcuucugguucucugugcugugcagcugcugcucaugagaacauccugggcccuuugcgaagcgcugacccuggccaccgggccuauuacaacccucugggagggaucuccgggcaaguuuuggaauacaacgaucgcugucagcauggccaacauuuuccgcggguccuaccuggcuggagccggccuugcguuuagcaucaugaaaucuguggggaccggaaagcggggcacaggcucccaaggggaaacccugggagagaaguggaaaaagaaacucaaucagcugagcagaaaggaauucgaccuguauaaaaaguccggcaucacagagguggaucgcaccgaggccaaagaagggcucaagcggggagagacgacccaucacgcuguuucuagaggcacagccaagcuucagugguuugucgaacggaacauggugauucccgaggggcgcgugaucgaccugggauguggcagaggcggguggagcuacuauugcgcuggacugaaaaaggucaccgaaguucggggcuacacaaaagggggaccuggccaugaggagcccgugccuauguccaccuacggguggaauauugugaagcucaugucuggaaaagaugucuucuaucugcccccggaaaagugugacacacuucugugcgauaucggcgagagcuccccuagccccaccguggaagagucucgcacgauuagaguucucaagaugguggagcccuggcugaaaaacaaucaguucuguaucaagguccugaacccuuacaugcccacagugauugaacaccucgagcggcuucaacgcaaacacggcgggaugcugguuagaaauccucugucccggaacagcacccaugaaauguauuggaucucuaauggaaccggcaacaucguggccuccgucaauauggugagccgccuccugcuuaacagauuuacaaugacgcaccggagaccgaccauugagaaggacguggaucugggggcuggaacacgccaugucaacgccgaacccgagaccccuaauauggacguuaucggcgagcggauuaaaagaaucaaggaagagcacaacucuacauggcacuacgacgaugaaaaucccuauaagaccugggcguaccaugggagcuaugaggugaaagccacaggauccgcuucuagcaugauuaacggcguggucaagcuccugaccaaaccuugggacgugguucccauggugacgcagauggccaugaccgauacaaccccguucggccagcaacgcgucuuuaaggaaaaaguggacacacggaccccuagauccaugcccgggacgcgccggguuaugggaaucacagcugaguggcuguggagaacccucggccgcaauaagaagccucggcugugcacaagagaggaauucaccaaaaaggugcgcacgaacgccgccaugggggcggucuuuaccgaggaaaaucagugggauagcgcuaaagccgccguggaggacgaagauuucuggaagcuuguugaccgggagagagagcugcacaaacucggaaaguguggcuccugcguguacaacaugauggggaaacgcgaaaagaagcugggcgaguuuggaaaagcuaagggcucuagagccaucugguacauguggcuuggggcucgguaucuggaauucgaggcccucggauuucugaaugaggaucauugguucagccgcgaaaacuccuacucuggcgucgagggggaaggacugcacaaacucggcuauauucugagagacaucagcaagauucccgggggcgcgauguacgccgaugacacagcuggaugggacacccggaucacagaggaugaccuucauaaugaagagaaaauuacccagcagauggauccugagcacagacaacuggccaacgcuaucuuuaagcucacauaucagaauaagguggucaaagugcagcggcccaccccgacgggcacaguuauggacaucauuucccgcaaggaucagagagggucuggacaagugggcaccuacgggcugaacaccuucacaaauauggaagcccagcuuauccggcagauggagggagaaggcguccugagcaaagcggaccucgagaacccucaccugcccgaaaagaaaauuacccaguggcuggagacaaaggggguggagcgccucagacggauggccaucuccggcgaugacugcgugguuaagcccauugaugaccgcuuugcuaacgcccugcuugcucugaaugauaugggaaaagugagaaaggacaucccucaauggcagccgagcaaaggcuggcaugauuggcagcagguccccuucuguucucaccauuuccacgaacucaucaugaaggacgggcggaaacuggugguuccuugccgcccccaagacgagcuuauuggaagagcccggaucucccagggcgcuggguggagccugcgcgaaacggccugucucggaaaggcguaugcccagauguggucucugauguacuuucacagacgggaucugcgccucgcuuccaacgccauuugcagcgccgugccuguccauugggugcccaccucuagaacaaccugguccauccacgcucaucaccaauggaugacaaccgaggacaugcugacggucuggaaucggguguggauugaagauaacccuuggauggaggacaagacccccguuacaaccugggagaaugugccguaccuuggcaaaagagaagaucaguggugugggagccugaucggccucacaucccgcgccaccugggcgcagaacauuccuacggcuauccagcaaguccggagccugaucggaaaugaggaauuccuugacuauaugcccucuaugaagagauuucgcaaagaggaggaaagcgagggcgccauuugguga

SEQ ID NO: 20710 - RNA, 9873 nt, Artificial Sequence
  derived and/or modified CDS sequence (opt5) from DENV-3__FJ182041__SS-prME
acaagccugugccucaugaugauccugcccgcggcucuugccuuccaccugacaucccgggacggcgaaccucggaugauuguggggaagaacgaacgcggaaagucucuccuguuuaagacggcgagcggcaucaauauguguacccuuauugcuauggaucugggggaaaugugcgacgauacagugaccuacaaauguccgcauaucgccgaaguugaacccgaagacauugauugcugguguaaccucacauccaccugggugacauauggaaccugcaaucaggccggcgagcaccggcgggacaagcgcucuguggcucuggccccucaugucgggaugggacuggauacgagaacccagacauggaugagcgcugagggcgccuggagacagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccaaaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucaccaagaaggaggaacccgugaacauugaggccgaaccuccguucggcgaguccaauaucgugauugggaucggcgauaacgcccugaaaaucaauugguauaagaagggaucuagcauuggcaaaauguuugaagcuaccgccagaggggcuagacgcauggccauccuuggagacacggcgugggauuucggcuccguugggggaguccucaacagccugggcaagauggugcaccagauuuuugggucugccuacacagcucuguucuccggcgugagcugggucaugaaaaucggaauuggcgugcuccugaccuggaucgggcuuaauucuaagaacaccagcauguccuuuucuugcauugccaucggaaucauuacacuguaucucggcgcuguugugcaggccgacaccgggugugucaucaauuggaaaggaaaggagcugaagugcggcagcgggauuuucgugacaaacgagguucauacguggaccgaacaguacaaauuucaagcggauucccccaagcggcuggccacagcuaucgccggcgcuugggagaauggaguguguggcauuagaagcaccacacgcauggaaaaccuucucuggaaacagaucgccaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgcugaaacacaaaacuccagcuucauuaucgauggaccuaauacccccgagugcccgucugcguccagagccuggaacgugugggaaguggaggacuauggcuuuggcgucuucacaaccaauaucuggcucaaacugcgcgaaguuuacacgcagcugugugaccaccggcuuaugagcgcugccgugaaggaugagagagccgugcacgcugacaugggguacuggauugagucccagaaaaacggaucuuggaagcucgaaaaagccagccugaucgaggucaagacaugcaccuggccuaagucccauacccuguggucuaauggcgugcucgaaagcgauaugauuauccccaaaucccuggcggggccuauuagccagcacaacuaucgccccggauaccauacacaaaccgcuggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgccggaucuggcaagguggacaacuucaccauggggguccugugccucgccauucuguuugaagaggugaugcggggaaaguucggcaaaaagcauaugaucgcuggcguuuucuuuacauucgugcuucugcucagcgggcagauuaccuggcgcgauauggcccacacacugaucaugauuggauccaaugcgagcgacagaaugggcaugggggucaccuaccuggcucuuaucgccacguuuaaaauccagcccuuccuggcccucggauuuuuccugcggaagcucacaucuagagaaaaccugcuucugggcguggggcucgcuauggccaccacacugcaacugccugaggauauugaacagauggcuaauggaaucgcccuuggccugauggcgcucaaacugauuacccaguuugagaccuaucagcucuggacagcccugaucucccuuacguguagcaacaccauuuucacacugaccguggcuuggcgcacagccacccucauccuggcuggcgucucccugcuuccgguuugccaaucuagcuccaugcggaagucugacuggcugcccaugacgguggccgccaugggggugccuccccucccucuguuuaucuucagccucaaggauacacugaaaagacgcuccuggccccuuaaugagggagucauggcugugggccugguuucuauucuggcgagcucccuccugagaaacgacgugccuauggccgggccccuugucgcuggaggccugcucaucgccuguuacgugauuaccgggaccagcgccgaucugacaguugaaaaggcugccgacgugaccugggaggaagaggcggaacagacaggagucucucauaaccucaugaucacgguggacgaugacggcaccaugcggauuaaagaugacgagacagagaauauccugaccguccuucugaagacagcucugcucaucguguccggcauuuuuccguacagcaucccugccacccugcuuguuuggcacacguggcagaaacagacccaacgcucuggggugcugugggauguccccuccccucccgaaacacagaaggccgagcucgaagagggaguguauagaauuaaacagcagggcaucuucgggaagacccaaguuggagugggcguccagaaggaggggguguuucauacaauguggcacgugacccggggagcuguucugacauacaacggcaaacgccucgaaccgaauugggccagcgucaagaaagaccugauuucuuauggcgggggauggagacuuuccgcgcaguggcaaaagggcgaggaaguccaggugaucgcugucgagccugggaaaaaccccaagaauuuccagacgaugccuggaaccuuccagacaaccaccggcgaaauuggggccaucgcccuggauuuuaagcccggaacaagcggcucccccaucauuaaccgggagggcaaagugguugggcuguacggaaauggcguggucacgaagaacgggggauaugugagcggcaucgcucaaaccaaugccgagccugacgggccgacacccgaacucgaggaagagauguucaaaaagcgcaaccugaccauuauggaucuucacccuggcucuggaaaaacaagaaaguaccugcccgcuaucguucgggaagccauuaagcgcagacuccggacccugauccucgcgccuacgagaguggucgccgcugagauggaggaagcccugaaaggccuucccauccgcuaucagacaaccgcuaccaagagcgagcauacagggcgggaaauuguggaccugaugugccacgccaccuuuacaaugagacugcucuccccuguucgcgugccgaauuacaaccugaucauuauggaugaggcccauuucaccgaccccgcuucuaucgcggcccggggauacauuagcacgagagucggcaugggggaagcugccgccaucuuuaugacagcuaccccucccggaacagccgaugcguucccucaguccaaugcucccauccaggacgaggagcgcgacauuccggaacggucuuggaacagcggcaaugaguggaucaccgauuuugccgggaaaacggugugguucgugccuuccauuaaggccggcaacgacaucgcuaacugucuucgcaaaaauggaaagaaggucauucaacugucuagaaaaaccuuugauacagaauaucagaagaccaaacucaacgacugggauuucguugugacaaccgacaucagcgagaugggcgccaauuuuaaggcggaucgggugauugaccccagacggugccugaaacccgucauccugacagaugggccugagcgcgugauccucgccggacccaugccuguuaccgcugccuccgcugcccagagacggggccgcguggggagaaacccgcagaaggaaaaugaccaauacauuuucacgggacagccccuuaacaaugaugaggaccacgcucauuggacagaagccaagaugcugcuggacaacaucaauaccccugagggcauuauccccgcccucuucgaaccugagcgggagaaaagcgccgcuauugauggggaauauagacugaagggcgagucucgcaaaaccuuugucgaacuuaugcggagaggagaccugcccguguggcucgcccacaagguugcuuccgagggcaucaaauacacagaucgcaaguggugcuucgacgggcagcggaacaaucagauccuggaagagaacauggauguggagauuuggaccaaagaaggagagaagaagaaacugagaccgcgcuggcucgacgcccggacauauagcgauccucuugcccugaaggaauuuaaagacuucgcugcgggcagaaagucuaucgcccuggaucucgucacggagauugggcgcgugcccucccaccuggcucauagaacccggaaugcccuugacaaccuggucaugcuccacacaagcgaacauggaggcaaagccuaccgccacgcuguggaggagcugccugaaaccauggagacacugcuccuucugggccugaugauccuccugaccgggggagccaugcuuuuucugauuuccggcaaggggaucggaaagacgucuaucggccucauuuguguuaucgcgagcuccgggaugcuguggauggccgaaauuccccugcaauggaucgcuagcgccauugugcucgaguucuuuaugauggugcuucugaucccugagcccgaaaaacagagaaccccgcaggauaaucaacuggcuuaugucguuauuggaauccucacacuggccgcgaucauugccgcuaacgagaugggccuucuggaaaccacaaagcgggaccucggcaugucuaaagagccugggguggugucccccaccagcuaccuggaugucgaccugcaccccgccucugcuuggacgcucuacgccguggcuacaaccguuaucacaccuaugcuucgccauaccauugaaaauagcaccgccaacgugucccuggcggccaucgcuaaccaggccgucgugcugaugggacucgacaagggcuggccgauuucuaaaauggaucugggggucccccuucuggcucucggaugcuauagccaggugaauccucugacacugacggccgccguucuccuucugaucacccacuacgcgaucauuggccccgggcugcaggcuaaggccacaagagaggcucaaaagcggaccgccgccggaaucaugaaaaacccuacaguggacggcauuaugaccaucgaucucgaccccgucauuuaugauuccaaguucgagaaacagcugggccaggugaugcuucugguucucugugcugugcagcugcugcucaugagaacgucuugggcccuuugcgaagcgcugacacuggccaccgggccuaucaccacacucugggagggaagcccgggcaaguuuuggaauaccacaaucgcugucuccauggccaacauuuuccgcgggagcuaccuggcuggagccggccuugcguuuucuaucaugaaauccguggggacgggaaagcggggcaccggcacacaaggggaaacccugggagagaaguggaaaaagaaacucaaucagcugagcagaaaggaguucgaccuguauaaaaaguccggcauuacagagguggaucgcaccgaggccaaagaagggcucaagcggggagagaucacgcaucacgcuguuucuagaggcagcgccaaacuucagugguuugucgaacggaacauggugauucccgaggggcgcgugaucgaccugggauguggcagaggcgggugguccuacuauugcgcuggacugaaaaaggucaccgaaguucggggcuacacaaaagggggaccuggccaugaggagcccgugccuaugucuaccuacggguggaauauugugaagcucaugagcggaaaagaugucuucuaucugcccccggaaaagugugacacacuucugugcgauaucggcgaguccagcccuucucccaccguggaagagucccgcacaaucagaguucucaagaugguggagcccuggcugaaaaacaaucaguucuguauuaagguccugaacccuuacaugcccaccgugaucgaacaccucgagcggcuucaacgcaaacacggcgggaugcugguuagaaauccucugagccggaacucuacgcaugaaauguauuggauuuccaauggaacaggcaacaucguggccagcgucaauauggugucucgccuccugcuuaacagauuuaccaugacccaccggagaccgacaauugagaaggacguggaucugggggcuggaacgcgccaugucaacgccgaacccgagaccccuaauauggacguuaucggcgagcggaucaaaagaauuaaggaagaacacaacagcacauggcacuacgacgaugaaaaucccuauaagaccugggcguaccauggguccuaugaggugaaagccacaggaucugcuagcuccaugaucaacggcguggucaagcuccugaccaaaccuugggacgugguucccauggugacacagauggccaugaccgauacgaccccguucggccagcaacgcgucuuuaaggaaaaaguggacacacggaccccuagaagcaugcccgggacacgccggguuaugggaauuaccgcugaguggcuguggagaacgcucggccgcaauaagaagccucggcugugcacaagagaggaguucaccaaaaaggugcgcacaaacgccgccaugggggcggucuuuaccgaggaaaaucagugggauuccgcuaaagccgccguggaggacgaagauuucuggaaacuuguugaccgggagagagagcugcacaaacucggaaaguguggcucuugcguguacaacaugauggggaaacgcgaaaagaagcugggcgaguuuggaaaagcuaagggcagcagagccaucugguacauguggcuuggggcucgguaucuggaguucgaggcccucggauuucugaaugaggaucauugguucucccgcgaaaacucuuacagcggcgucgagggggaaggacugcacaaacucggcuauauucugagagacaucuccaagauccccgggggcgcgauguacgccgaugacacggcuggaugggacacccggauuacagaggaugaccuucauaaugaagagaaaaucacccagcagauggauccugagcacagacaacuggccaacgcuauuuuuaagcucacauaucagaauaagguggucaaagugcagcggcccaccccgacaggcaccguuauggacaucauuucucgcaaggaucagagagggagcggacaagugggcacguacgggcugaacacauucaccaauauggaagcccagcuuauccggcagauggagggagaaggcguccuguccaaagcggaccucgagaacccucaccugagcgaaaagaaaaucacccaguggcuggagacaaaggggguggagcgccucaagagaauggccauuucuggcgaugacugcgugguuaaacccaucgaugaccgguuugcuaacgcccugcuugcucugaaugauaugggaaaggugcgcaaagacauuccccaauggcagccuuccaagggcuggcaugauuggcagcaggucccguucuguagccaccauuuccacgaacucaucaugaaagacgggagaaagcuggugguucccugccggccucaagacgagcuuauuggacgcgccagaaucucucagggcgcuggguggucccugcgggaaaccgccugucucggaaaggcguaugcccagauguggagccugauguacuuucaccgcagagaucugcggcucgcuucuaacgccauuugcuccgccgugcccguccauugggugccuacaagccgcacgaccugguccauccacgcucaucaccaauggaugacaaccgaggacaugcugacagucuggaauagaguguggaucgaagauaaccccuggauggaggacaaaaccccuguuacgaccugggagaaugugcccuaccuuggcaagcgggaagaucaguggugugggagccugauuggccucacaucuagagccaccugggcgcagaacaucccgacagcuauucagcaaguccgcagccugaucggaaaugaggaguuccuugacuauaugccuuccaugaaacgguuuagaaaggaggaggaaucugagggcgccauuugguga

SEQ ID NO: 20711 - RNA, 9873 nt, Artificial Sequence
  derived and/or modified CDS sequence (opt5) from DENV-3__FJ390371__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccagaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagaugcgcccuguaaaauuccuuucagcacagaggacggccaagggaaggcucauaacggaagacugaucaccgccaaucccguugugacaaaaaaggaggaacccgucaacauugaggccgaaccuccguucggcgaguccaauaucgugauugggaucggcgauaacgcucugaaaaucaauugguauaagaagggaucuagcauuggcaaaauguuugaagccaccgcucggggggccagacgcauggcgauccuuggagacacggccugggauuucggcuccguggggggaguucucaacagccugggcaagaugguccaccagauuuuugggucugcuuacacagcccuguucuccggcgugagcugggugaugaaaaucggaauuggcguccuccugaccuggaucgggcuuaauucuaagaacaccagcauguccuuuucuugcauugcuaucggaaucauuacacuguaucucggcgccgugguucaggcggacaccgggugugugaucaauuggaaaggaaaggagcugaagugcggcagcgggauuuucgucacaaacgaggugcauacguggaccgaacaguacaaauuucaagccgauucccccaagcggcuggcuacagccaucgcuggcgccugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggcuaagaucgugaccgcggaaacacaaaacuccagcuucauuaucgauggaccuaauacccccgagugcccgucugccuccagagcuuggaacgucugggaaguggaggacuauggcuuuggcguguucacaaccaauaucuggcucaaacugcgcgaagucuacacgcagcugugugaccaccggcuuaugagcgccgccguuaaggaugagagagcugugcacgccgacaugggguacuggauugagucccagaaaaacggaucuuggaagcucgaaaaagcgagccugaucgaggugaagacaugcaccuggccuaagucccauacccuguggucuaauggcguccucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacagugguuaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauauggucaaaucccuggugagcgccggaucuggcaagguugacaacuucaccaugggggugcugugccucgcuauucuguuugaagaggucaugcggggaaaguucggcaaaaagcauaugaucgccggcguguucuuuacauucguucuucugcucagcgggcagauuaccuggcgcgauauggcgcacacacugaucaugauuggauccaaugcuagcgacagaaugggcaugggggugaccuaccuggcccuuaucgccacguuuaaaauccagcccuuccuggcucucggauuuuuccugcggaagcucacaucuagagaaaaccugcuucugggcgucgggcucgccauggcuaccacacugcaacugccugaggauauugaacagauggccaauggaaucgcgcuuggccugauggcccucaaacugauuacccaguuugagaccuaucagcucuggacagcucugaucucccuuacguguagcaacaccauuuucacacugaccguggccuggcgcacagcuacccucauccuggccggcgugucccugcuuccggucugccaaucuagcuccaugcggaagucugacuggcugcccaugacgguugccgcuaugggggugccuccccucccucuguuuaucuucagccucaaggauacacugaaaagacgcuccuggccccuuaaugagggagugauggcggucggccuggugucuauucuggccagcucccuccugagaaacgacguuccuauggcugggccccuuguggccggaggccugcucaucgccuguuacgucauuaccgggaccagcgcugaucugacaguggaaaaggccgcggacguuaccugggaggaagaggcugaacagacaggagugucucauaaccucaugaucacggucgacgaugacggcaccaugcggauuaaagaugacgagacagagaauauccugaccgugcuucugaagacagcccugcucaucgucuccggcauuuuuccguacagcaucccugccacccugcuuguguggcacacguggcagaaacagacccgcagaucugggguucugugggaugugcccuccccucccgaaacacaaaaggcugagcucgaagagggagucuaucggauuaaacagcagggcaucuucgggaagacccaggugggaguuggcgugcaaaaggagggggucuuucauacaauguggcacgugacccgcggagccgugcugacauacaacggcaaaagacucgaaccgaauugggcgagcguuaagaaagaccugauuucuuauggcgggggauggcggcuuuccgcucaguggcagaagggcgaggaaguccaagugaucgccguggagccugggaaaaaccccaagaauuuccagacgaugccuggaaccuuccagacaaccaccggcgaaauuggggccaucgcucuggauuuuaagcccggaacaagcggcucccccaucauuaaccgcgagggcaaagucguggggcuguacggaaauggcguugugacgaagaacgggggauaugucagcggcaucgcccagaccaaugcugagccugacgggccgacacccgaacucgaggaagagauguucaaaaagagaaaccugaccauuauggaucuucacccuggcucuggaaaaacacggaaguaccugcccgccaucgugcgcgaagcgauuaagagacggcucagaacccugauccucgccccuacgcgcguuguggcugccgagauggaggaagcucugaaaggccuucccauccgguaucaaacaaccgccaccaagagcgagcauacagggagagaaauugucgaccugaugugccacgccaccuuuacaaugcgccugcucuccccugugcggguuccgaauuacaaccugaucauuauggaugaggcucauuucaccgaccccgcgucuaucgccgcuagaggauacauuagcacgcgcgugggcaugggggaagccgccgcuaucuuuaugacagccaccccucccggaacagcggaugcuuucccucaguccaaugcccccauccaggacgaggagcgggacauuccggaaagaucuuggaacagcggcaaugaguggaucaccgauuuugccgggaaaacggucugguucgugccuuccauuaaggcuggcaacgacaucgccaacugucuucgcaaaaauggaaagaaggugauucagcugucucggaaaaccuuugauacagaauaucaaaagaccaaacucaacgacugggauuucgucguuacaaccgacaucagcgagaugggcgcgaauuuuaaggccgauagagugauugacccccggcgcugccugaaacccgugauccugacagaugggccugagagagucauccucgcuggacccaugccugugaccgccgcuuccgccgcucagcggcgcggcagaguugggcggaacccgcagaaggaaaaugaccaguacauuuucacgggacaaccccuuaacaaugaugaggaccacgcccauuggacagaagcgaagaugcugcuggacaacaucaauaccccugagggcauuauccccgcccucuucgaaccugagagagagaaaagcgcugccauugauggggaauaucgccugaagggcgagucucggaaaaccuuuguggaacuuaugagacgcggagaccugcccgucuggcucgcucacaagguggccuccgagggcaucaaauacacagaucggaaguggugcuucgacgggcagagaaacaaucagauccuggaagagaacauggauguugagauuuggaccaaagaaggagagaagaagaaacugcgcccgcgguggcucgacgccagaacauauagcgauccucuugcucugaaggaauuuaaagacuucgcggccggccgcaagucuaucgcucuggaucucgugacggagauugggagaguccccucccaccuggcccaucggacccgcaaugcccuugacaaccuggugaugcuccacacaagcgaacauggaggcaaagcuuacagacacgccgucgaggagcugccugaaaccauggagacacugcuccuucugggccugaugauccuccugaccgggggagcgaugcuuuuucugauuuccggcaaggggaucggaaagacgucuaucggccucauuugugugaucgccagcuccgggaugcuguggauggcugaaauuccccugcaguggaucgccagcgcuauuguucucgaguucuuuaugauggugcuucugaucccugagcccgaaaaacaacggaccccgcaggauaaucagcuggccuauguggucauuggaauccucacacuggcggccaucauugcugccaacgagaugggccuucuggaaaccacaaagcgcgaccucggcaugucuaaagagccugggguugugucccccaccagcuaccuggauguggaccugcaccccgcuucugccuggacgcucuacgcugucgccacaaccgugaucacaccuaugcuuagacauaccauugaaaauagcaccgcgaacguuucccuggccgcuaucgccaaccaagcugugguccugaugggacucgacaagggcuggccgauuucuaaaauggaucugggggugccccuucuggcccucggaugcuauagccaggucaauccucugacacugacggccgcggugcuccuucugaucacccacuacgcuaucauuggccccgggcugcaggccaaggcuacacgggaggcccagaagagaaccgccgcuggaaucaugaaaaacccuacaguugacggcauuaugaccaucgaucucgaccccgugauuuaugauuccaaguucgagaaacaacugggccaggucaugcuucuggugcucugugccguucagcugcugcucaugcgcacgucuugggcgcuuugcgaagcccugacacuggcuaccgggccuaucaccacacucugggagggaagcccgggcaaguuuuggaauaccacaaucgccguguccauggcuaacauuuuccgggggagcuaccuggccggagcgggccuugccuuuucuaucaugaaauccgucgggacgggaaagagaggcaccggcagccagggggaaacacugggagagaaguggaaaaagaaacucaaucaacugucccgcaaggaauucgaccuguauaaaaagucuggcauuaccgagguggaucggacagaggcuaaagaagggcucaagagaggagagaucacccaucacgccgugagccggggcuccgcuaagcuucagugguuuguugaacgcaacauggucauucccgaggggagagugaucgaccugggauguggccggggcggguggucuuacuauugcgccggacugaaaaaggugacggaaguccgcggcuacaccaaagggggaccuggccaugaggagcccguuccuaugagcacauacggguggaauauugugaagcucauguccggaaaagauguguucuaucugcccccggaaaagugugacacccuucugugcgauaucggcgagagcucuccuucccccacagucgaagagagcagaaccauccgggugcucaagaugguugagcccuggcugaaaaacaaucaguucuguauuaaggugcugaacccuuacaugcccacagucaucgaacaccucgagcgccuucagagaaaacacggcgggaugcuggugcggaauccucugucucgcaacuccacccaugaaauguauuggauuagcaauggaacgggcaacaucguugcuucugugaauauggucagcagacuccugcuuaaccgguuuacaaugacccacagacgcccgaccauugagaaggacguggaucugggggccggaacacggcaugugaacgcggaacccgagacgccuaauauggacgucaucggcgagagaaucaaacgcauuaaggaagagcacaacuccaccuggcacuacgacgaugaaaaucccuauaagacaugggccuaccaugggucuuaugagguuaaagcuaccggaagcgccuccagcaugaucaacggcguggugaagcuccugacaaaaccuugggacgucgugcccaugguuacccaaauggcuaugacagauaccacgccguucggccagcagcggguguuuaaggaaaaagucgacaccagaacaccucgcuccaugcccgggacccggagagugaugggaauuacagccgaguggcuguggcgcacccucggccggaauaagaagccuagacugugcacgcgcgaggaauucacaaaaaagguucggaccaacgccgcgaugggggcuguguuuacagaggaaaaucaaugggauucugccaaagccgcugucgaggacgaagauuucuggaagcuuguggacagagagcgcgagcugcacaaacucggaaaguguggcagcugcguuuacaacaugauggggaaaagagaaaagaagcugggcgaguuuggaaaagccaagggcucccgggcuaucugguacauguggcuuggggcccgcuaucuggaauucgaggcgcucggauuucugaaugaggaucauugguucucuagagaaaacagcuacuccggcguggagggggaaggacugcacaaacucggcuauauucugcgggacaucucuaagauccccgggggcgccauguacgcugaugacaccgccggaugggacacgagaauuaccgaggaugaccuucauaaugaagagaaaaucacacagcagauggauccugagcaccggcagcuggcuaacgccauuuuuaagcucaccuaucaaaauaaggucgugaaaguccagcgccccacaccgaccggcacagugauggacaucauuagcagaaaggaucagcggggguccggacagguuggcaccuacgggcugaacacguucacaaauauggaagcgcaacuuauccgccagauggagggagaaggcgugcugaccaaagccgaccucgagaacccucaccugagcgaaaagaaaaucacccaguggcuggagacaaagggggucgagagacucaagcggauggcuauuucuggcgaugacugcguggugaaacccaucgaugaccgcuuugccaacgcucugcuugcccugaaugauaugggaaagguuagaaaagacauuccccaguggcaaccuuccaagggcuggcaugauuggcagcaggugccguucuguagccaccauuuccacgaacucaucaugaaagacgggcggaagcuggucgugcccugccgcccucaggacgagcuuauuggaagagcucggaucucucaaggcgccggguggucccugcgcgaaaccgcgugucucggaaaggccuaugcucagauguggagccugauguacuuucacagacgggaucugcgccucgccucuaacgccauuugcuccgcuguucccgugcauugggucccuacaagcagaacgaccugguccauccacgcccaucaccaguggaugacaaccgaggacaugcugacaguguggaaucgggucuggaucgaagauaaccccuggauggaggacaaaaccccugugacgaccugggagaauguucccuaccuuggcaagagagaagaucaauggugugggagccugauuggccucacaucucgcgcgaccugggcucagaacaucccgacagccauucagcaggugcggagccugaucggaaaugaggaauuccuugacuauaugccuuccaugaaaagauuucgcaaggaggaggaaucugagggcgccauuugguga

SEQ ID NO: 20712 - RNA, 9873 nt, Artificial Sequence
  derived and/or modified CDS sequence (opt5) from DENV-3__FJ390372__SS-prME
accagccugugccucaugauggugcugcccgccgcucuugccuuccaccugacauccagagacggcgagccucggaugaucgucgggaagaacgaacgcggaaaaucucuccuguuuaagacggcgagcggcauuaauauguguacccuuaucgcuauggaucugggggagaugugcgacgauacaguuaccuacaaauguccgcauauuacagaaguggagcccgaagacaucgauugcugguguaaccucaccuccacaugggugaccuauggaacgugcaaucaggccggcgagcacagacgggacaagcgcucugucgcccuggcuccucauguggggaugggacuggauaccagaacacaaaccuggaugagcgccgagggcgcuuggcggcagguugaaaaaguggagacaugggcccuccgccaccccggcuucaccauucuggcgcuuuuucuggcccauuacaucgggacgucccucacacagaaggucgugaucuucauucugcuuaugcugguuaccccuucuaugacaaugagaugugugggagucggcaaccgggacuuuguggaagggcucagcggagcuaccuggguggaugucguucuggagcacggcgggugcgugaccacaauggccaagaauaaacccacgcuggacaucgagcuccagaagaccgaagcuacacaacuggccacccuucgcaaacuguguauugagggaaagaucacaaacauuaccacggauuccagaugcccuacacagggcgaagcggugcucccggaggaacaggaccagaauuaugucuguaaacacaccuacguggaucggggcugggggaacggaugcggccuguucgggaagggaagccuuguuaccugcgccaaguuucaaugucuggagcccaucgagggcaaagugguccaguaugaaaaucucaaguacacagugauuaucaccguucauacaggggaccagcaccaggugggaaacgagacgcaaggcgucaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaagugguugugcucgggucucaggagggagccaugcacaccgcucugacaggcgccaccgaaauucagaauuccgggggcaccagcaucuucgccggacaucugaagugucgccucaaaauggacaagcuggagcuuaaaggcaugucuuacgcuaugugcacaaacacguuuguccugaagaaagagguguccgaaacccagcacgggacaauucucaucaagguugaguacaagggagaagaugcccccuguaaaaucccuuucagcaccgaggacggccaagggaaggcgcauaacggaagacugauuacagcuaaucccguggucaccaaaaaggaggaacccgugaacaucgaggccgaaccuccguucggcgaguccaauauugugaucgggauuggcgauaacgcccugaaaaucaauugguauaagaagggaucuagcaucggcaaaauguuugaagcuacggcccggggggcuagacgcauggccauucuuggagacacagcgugggauuucggcuccguugggggaguccucaacagccugggcaagauggugcaccagaucuuugggucugccuacaccgcucuguucuccggcgugagcugggucaugaaaauuggaaucggcgugcuccugaccuggauugggcuuaauucuaagaacacaagcauguccuuuucuugcaucgccauuggaguuaucacccuguaucucggcgcugugguccaggccgacauggggugugugaucaauuggaaaggaaaggagcugaagugcggcagcgggauuuucguuacaaacgaggugcauacguggaccgaacaguacaaauuucaagcggauucccccaagcggcuggccacagcuaucgccggcgcuugggagaauggagucuguggcauuagaagcaccacacgcauggaaaaccuucucuggaaacagaucgccaaugagcugaacuauauucugugggaaaauaacaucaagcucaccgugguugugggggacaucauuggaguccuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgugugggaagucgaggacuauggcuuuggcguuuucacaaccaauauuuggcucaaacugcgcgaaguguacacgcagcugugugaccaccggcuuaugagcgcugccgugaaggaugagagagccguccacgcugacaugggguacuggaucgagucccagaaaaacggaucuuggaagcucgaaaaagccagccugaucgaggugaagacaugcaccuggccuaagucccauacccuguggucuaauggcguucucgaaagcgauaugauuauccccaaaucccuggcggggccuauuagccagcacaaccaucgccccggauaucacacacaaaccgcuggcccuuggcaccuugggaagcuggagcucgacuuuaauuacugcgagggaacgacaguggucaucaccgaaaacuguggcacacggggccccucucugagaaccacaaccguguccgggaaacugauucaugaguggugcugucgcagcugcacgcuuccgccucuccgguauaugggagaagauggcuguugguacgggauggagaucagacccaucucugaaaaggaggagaauaugguuaaaucccuggugagcgccggaucuggcaaggucgacaacuucaccaugggggugcugugccucgccauucuguuugaagagguuaugcggggaaaguucggcaaaaagcacaugaucgcuggcguguucuuuacauucguccuucugcucagcgggcagauuaccuggcgcgauauggcccauacacugaucaugauuggauccaaugcgagcgacagaaugggcaugggggugaccuaucuggcucuuaucgccacguuuaaaauucagcccuuccuggcccucggauuuuuccugcggaagcucacaucuagagaaaaccugcuucugggcguggggcucgcuauggccaccacacugcaacugccugaggauaucgaacagauggcuaauggaaucgcccuuggccugauggcgcucaaacugauuacccaguuugagaccuaccagcucuggacagcccugaucucccuuacguguagcaacaccauguucacacugaccgucgcuuggcgcacagccacccucauucuggcuggcguuucccugcuuccggugugccaaucuagcuccaugcggaagacggacuggcugcccauggccguggccgcuaugggggucccuccccucccucuguuuaucuucucucucaaggauacacugaaaagacgcagcuggccccuuaaugagggagugauggcgguuggccugguguccauucuggccucuagccuccugagaaacgacgucccuauggcugggccccuuguggccggaggccugcucaucgccuguuauguuaucaccgggaccuccgcugaucugacaguggaaaaggccgcggacauuaccugggaggaagaggcugaacagacaggagucagccacaaccucaugaucacgguggacgaugacggcaccaugcggauuaaagaugacgagacagagaauauccugaccguccuucugaagacagcccugcucauugugucuggcguuuuuccguacuccaucccugccacccugcuuguguggcauacguggcagaaacagacccaacgcagcgggguccugugggaugugcccucuccucccgaaacacagaaggcugagcucgaagagggaguuuacagaaucaaacagcagggcauuuucgggaagacccaagugggagucggcgugcagaaggaggggguguuucacacaauguggcacguuacccggggagccguccugacauauaacggcaaacgccucgaaccgaauugggcguccgugaagaaagaccugaucagcuacggcgggggauggagacuuucugcucaguggcaaaagggcgaggaagugcaggucauugccguggagccugggaaaaaccccaagaauuuccagacgaugccuggaaccuuccagacaaccaccggcgaaaucggggccauugcucuggauuuuaagcccggaacauccggcagccccaucauuaaccgggagggcaaaguuguggggcuguauggaaauggcgucgugacgaagaacgggggauacguuuccggcaucgcccaaaccaaugcugagccugacgggccgacacccgaacucgaggaagagauguucaaaaagcgcaaccugaccaucauggaucuucauccuggcagcggaaaaacaagaaaguaucugcccgccauugugcgggaagcgaucaagcgcagacuccggacccugauucucgccccuacgagagucguggcugccgagauggaggaagcucugaaaggccuucccauccgcuaccagacaaccgccaccaagucugagcacacagggcgggaaauuguugaccugaugugccaugccaccuuuacaaugagacugcucagcccugugcgcgucccgaauuauaaccugaucaucauggaugaggcucacuucaccgaccccgcguccauugccgcucggggauacaucucuacgagagugggcaugggggaagccgccgcuauuuuuaugacagccaccccucccggaacagcggaugcuuucccucagagcaaugcccccauccaggacgaggagaaagacauuccggaacgcuccuggaacucuggcaaugaguggaucaccgauuuugccgggaagacggugugguucgucccuagcaucaaagcuggcaacgacauugccaacugucuucggaagaauggaaagaaaguuauccaacuguccagaaagaccuuugauacagaauaccagaaaaccaagcucaacgacugggauuucguggugacaaccgacauuucugagaugggcgcgaauuuuaaagccgaucgcgucaucgacccccggagaugccugaagcccgugauucugacagaugggccugagcggguuauccucgcuggacccaugccugugaccgccgcuagcgccgcucagcgcagaggccgggucgggcgcaacccgcagaaggaaaaugaccaauauauuuucacgggacagccccuuaacaaugaugaggaccaugcccacuggacagaagcgaaaaugcugcuggacaacaucaauaccccugagggcaucauucccgcccucuucgaaccugagagagagaaguccgcugccaucgauggggaauaccggcugaaaggcgagagcagaaagaccuuuguggaacuuaugcgccggggagaccugcccguuuggcucgcucacaaaguggccucugagggcauuaaguauacagauagaaaauggugcuucgacgggcagcgcaacaaucagauccuggaagagaacauggaugucgagauuuggaccaaggaaggagagaagaaaaagcugcggccgagauggcucgacgcccgcacauacuccgauccucuugcucugaaagaauuuaaggacuucgcggccggccggaaaagcaucgcucuggaucucgugacggagaucgggagaguccccucucaucuggcccaccgcaccagaaaugcccuugacaaccuggugaugcuccauacauccgaacacggaggccgggcuuaucgccacgccguugaggagcugccugaaaccauggagacacugcuccuucugggccugaugauucuccugaccgggggagcgaugcuuuuucugaucagcggcaaggggauuggaaagacguccaucggccucauuugugugaucgccucuagcgggaugcuguggauggcugaaaucccccugcaauggauugccuccgcuaucgugcucgaguucuuuaugaugguccuucugauuccugagcccgaaaaacagagaaccccgcaggauaaucaacuggccuacguugugaucggaauucucacacuggcggccaucauugcugccaacgagaugggccuucuggaaaccacaaagcgggaccucggcaugagcaaagagccugggguggucucucccaccuccuaucuggauguggaccugcaucccgcuagcgccuggacgcucuacgcuguugccacaaccgugaucacaccuaugcuucgccacaccaucgaaaauucuaccgcgaacgucagccuggccgcuauugccaaccaggcugugguccugaugggacucgacaagggcuggccgaucuccaaaauggaucugggggugccccuucuggcccucggaugcuacucucagguuaauccucugacacugacggccgcggugcuccuucugauuacccauuaugcuaucauuggccccgggcugcaggccaaggcuacaagagaggcccaaaagcggaccgccgcuggaaucaugaaaaacccuacagucgacggcaucaugaccauugaucucgaccccgugaucuacgauagcaaguucgagaaacagcugggccagguuaugcuucuggugcucugugccguccagcugcugcucaugagaacguccugggcgcuuugcgaagcccugacacuggcuaccgggccuauuaccacacucugggagggaucuccgggcaaguuuuggaauaccacaaucgccgugagcauggcuaacauuuuccgcggguccuaucuggccggagcgggccuugccuuuagcaucaugaaaucuguggggacgggaaagcggggcaccggcucccaaggggaaacacugggagagaaguggaaaaagaaacucaaucagcugagcagaaaggaauucgaccuguacaaaaaguccggcaucaccgagguugaucgcacagaggcuaaagaagggcucaagcggggagagaccacgcaccaugccgucucuagaggcaccgcuaagcuucagugguuuguggaacggaacauggugauucccgaggggcgcgucaucgaccugggauguggcagaggcggguggagcuauuacugcgccggacugaaaaagguuacagaagugcggggcuauaccaaagggggaccuggccacgaggagcccgugccuauguccacauacggguggaauauugucaagcucaugucuggaaaagauguguucuaccugcccccggaaaagugugacacccuucugugcgauaucggcgagagcuccccuagccccacaguugaagagucucgcaccauuagagugcucaagauggucgagcccuggcugaaaaacaaucaguucuguaucaaggugcugaacccuuauaugcccacgguuauugaacaccucgagcggcuucaacgcaaacauggcgggaugcuggugagaaauccucugucccggaacagcacacacgaaauguacuggaucucuaauggaaccggcaacaucgucgcuuccgugaauauggugagccgccuccugcuuaacagauuuaccaugacacaucggagaccgacgauugagaaggacgucgaucugggggccggaacccgccacguuaacgcggaacccgagacaccuaauauggacgugaucggcgagcggauuaaaagaaucaaggaagagcacaacucuaccuggcauuaugacgaugaaaaucccuacaagacaugggccuaucacgggagcuacgaggugaaagcuaccggauccgccucuagcaugauuaacggcgucgugaagcuccugacaaaaccuugggacguugugcccauggucacccagauggcuaugacggauaccacaccguucggccaucagcgcguguuuaaggaaaaaguugacacccggacaccuagauccaugcccgggccucgccgggccaugggaaucaccgccgaguggcuguggagaacgcucggccgcaauaagaagccccggcugugcacaagagaggaauucaccaaaaaggggcgcacaaacgcggcuaugggagccguguuuaccgaggaaaaucaaugggauagcgccaaagcugccgucgaggacgaagauuucuggaagcuuguggaccgggagagagagcugcacaaacucggcaaguguggguccugcguuuauaacaugaugggcaaacgcgaaaagaagcugggagaguuuggcaaagcuaaggggucuagagccaucugguacauguggcuuggagcgcgguaccuggaauucgaggcccucggcuuucugaaugaggaucauugguucagccgcgaaaacuccuauucugggguggagggagaaggccugcacaaacucggguacauucugagagacaucagcaagauuccuggcggagcuauguaugccgaugcuacggccggcugggacacccggaucacagaggacgaucuucacaaugaagagaaaauuacccagcagauggaccccgaucauagacagcuggcgacagccaucuuuaagcucaccuaccaaaacaaggucgugaaaguccagcggccgacaccuaccgggacggugauggacaucauuucccgcaaggaucagagaggaucuggccagguugggacauauggacugaauaccuucaccaacauggaggcucaacuuauccggcagauggaaggcgagggggugcugagcaaagccgaccucgaaaauccccaccugcccgagaagaaaauuacacaguggcuggaaaccaagggcgucgagcgccucagacggauggcuaucuccggagaugacugcguggugaagccuauugaugaccgcuuugccaacgcucugcuugcccugaacgauaugggcaaaguuagaaaggacaucccgcaguggcaacccagcaaaggguggcaugauuggcagcaggugccuuucuguucucaccacuuccaugagcucaucaugaaggacggacggaaacuggucgugcccugccgcccucaggacgaacuuauuggcagagcgcggaucucccaaggggccggauggagccugcgcgagacagcuugucucggcaaggccuacgcccagauguggucucugauguauuuucacagacgggaucugcgccucgcuuccaaugccauuugcagcgcgguucccgugcauugggucccuacgucuagaaccacaugguccauccacgcucaucaccaguggaugaccacagaagacaugcugaccguguggaaccgggucuggauugaggauaaucccuggauggaagacaagacgccggugaccacaugggagaacguuccuuaccuugggaaaagagaggaucaaugguguggcagccugaucggacucaccucccgcgccacaugggcccagaauauucccaccgcuauccagcaggugcggagccugaucggcaacgaagaguuccuugacuacaugccuucuaugaagagauuucgcaaagaagaggagagcgaaggggccauuugguga

SEQ ID NO: 20713 - RNA, 9873 nt, Artificial Sequence
  derived and/or modified CDS sequence (opt5) from DENV-3__FJ205870__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacacuuauugcuauggaucugggggaaaugugcgacgauacagucaccuacaaauguccgcauaucgccgaaguugaacccgaagacauugauugcugguguaaccucacauccaccugggugacauauggaaccugcaaucaggccggcgagcacagacgggacaagcgcucuguggcucuggccccucaugucgggaugggacuggauacgagaacccagacauggaugagcgcugagggcgccuggagacagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccagcuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucagugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccaaaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucaccaaaaaggaggaacccgugaacauugaggccgaaccuccguucggcgaguccaauaucgugauugggaucggcgauaacgcccugaaaaucaauugguauaagaagggaucuagcauuggcaaaauguuugaagcuaccgccagaggggcuagacgcauggccauccuuggagacacggcgugggauuucggcuccguugggggaguccucaacagccugggcaagauggugcaccagauuuuugggucugccuacacagcucuguucuccggcgugagcugggucaugaaaaucggaauuggcgugcuccugaccuggaucgggcuuaauucuaagaacaccagcauguccuuuucuugcauugccaucggaaucauuacacuguaucucggcgcuguugugcaggccgacaccgggugugucaucaauuggaaaggaaaggagcugaagugcggcagcgggauuuucgugacaaacgagguucauacguggaccgaacaguacaaauuucaagcggauucccccaagcggcuggccacagcuaucgccggcgcuugggagaauggaguguguggcauuagaagcaccacacgcauggaaaaccuucucuggaaacagaucgccaaugagcugaacuauauccugugggaaaauaacauuaagcucaccgucgugguuggggacaucauuggaauccuggagcagggcaaacggacgcuuaccccucagcccauggagcugaaguacucuuggaaaacaugggggaaggccaagauugugaccgcugaaacacaaaacuccagcuucaucaucgauggaccuaauacccccgagugcccgucugcguccagagccuggaacgucugggaaguggaggacuauggcuuuggcguguucacaaccaauauuuggcucaaacugcgcgaagucuacacgcagcugugugaccaccggcuuaugagcgcugccguuaaggaugagagagccgugcacgcugacaugggguacuggaucgagucccagaaaaacggaucuuggaagcucgaaaaagccagccugauugaggugaagacaugcaccuggccuaagucccauacccuguggucuaauggcguccucgaaagcgauaugaucauucccaaaucccuggcggggccuaucagccagcacaacuaucgccccggauaccauacacaaaccgcuggcccuuggcaccuugggaagcuggagcucgacuuuaauuauugcgagggaacgacagugguuaucaccgaaaacuguggcacacggggccccucucugagaaccacaaccguguccgggaaacugauucacgaguggugcugucgcagcugcacgcuuccgccucuccgguacaugggagaagauggcuguugguaugggauggagaucagacccauuucugaaaaggaggagaauauggucaaaucccuggugagcgccggaucuggcaagguugacaacuucaccaugggggugcugugccucgccauccuguuugaagaggucaugcggggaaaguucggcaaaaagcauaugauugcuggcguguucuuuacauucguucuucugcucagcgggcagaucaccuggcgcgauauggcccacacacugauuaugaucggauccaaugcgagcgacagaaugggcaugggggugaccuaccuggcucuuaucgccacguuuaaaauucagcccuuccuggcccucggauuuuuccugcggaagcucacaucuagagaaaaccugcuucugggcgucgggcucgcuauggccaccacacugcaacugccugaggauaucgaacagauggcuaauggaauugcccuuggccugauggcgcucaaacugaucacccaguuugagaccuaucagcucuggacagcccugauuucccuuacguguagcaacaccaucuucacacugaccguggcuuggcgcacagccacccucauccuggcuggcguguccauucugccggucugccaaucuagcuccaugcggaagucugacuggcuucccaugacgguugccgccaugggggugccuccccugccucucuuuaucuucagccugaaggauacacucaaaagacgcuccuggccccugaaugagggagugauggcugucggccuugugucuauucuggcgagcucccugcucagaaacgacguuccuauggccgggccccugguggcuggaggccuucugaucgccuguuacgucauuaccgggaccagcgccgaucucacaguggaaaaggcugccgacguuaccugggaggaagaggcggaacagacaggagugucucauaaccugaugaucacggucgacgaugacggcaccaugcggaucaaagaugacgagacagagaauauucucaccgugcugcuuaagacagcucugcugaucgucuccggcauuuuuccguacagcaucccugccacccuccugguguggcacacguggcagaaacagacccgcagaucugggguucuuugggaugugcccuccccucccgaaacacaaaaggccgagcuggaagagggagucuaucggauuaaacagcagggcaucuucgggaagacccaggugggaguuggcgugcaaaaggagggggucuuucauacaauguggcacgugacccgcggagcugugcucacauacaacggcaaaagacuggaaccgaauugggccagcguuaagaaagaccucauuucuuauggcgggggauggcggcuguccgcgcaguggcagaagggcgaggaaguccaagugaucgcuguggagccugggaaaaaccccaagaauuuccagacgaugccuggaaccuuccagacaaccaccggcgaaaucggggccauugcccuugauuuuaagcccggaacaagcggcucccccaucauuaaccgcgagggcaaagucguggggcuguacggaaauggcguugugacgaagaacgggggauaugucagcggcaucgcucagaccaaugccgagccugacgggccgacacccgaacuggaggaagagauguucaaaaagagaaaccucaccauuauggaucugcacccuggcucuggaaaaacacggaaguaccuucccgcuaucgugcgcgaagccaucaagagacggcugagaacccucauucuggcgccuacgcgcguuguggccgcugagauggaggaagcccucaaaggccugcccauccgguaucaaacaaccgcuaccaagagcgagcauacagggagagaaauugucgaccuuaugugccacgccaccuuuacaaugcgccugcuguccccugugcggguuccgaauuacaaccucaucauuauggaugaggcccauuucaccgaccccgcuucuaucgcggccagaggauacaucagcacgcgcgugggcaugggggaagcugccgccauuuuuaugacagcuaccccucccggaacagccgaugcguucccucaguccaaugcucccauccaggacgaggagcgggacauuccggaaagaucuuggaacagcggcaaugaguggaucaccgauuuugccgggaaaacggucugguucgugccuuccauuaaggccggcaacgacaucgcuaacugucugcgcaaaaauggaaagaaggugauucagcuuucucggaaaaccuuugauacagaauaucaaaagaccaaacugaacgacugggauuucgucguuacaaccgacaucagcgagaugggcgccaauuuuaaggcggauagagugaucgacccccggcgcugccucaaacccgugauucugacagaugggccugagagagucauccuggccggacccaugccugugaccgcugccuccgcugcccagcggcgcggcagaguugggcggaacccgcagaaggaaaaugaccaguacauuuucacgggacaaccccucaacaaugaugaggaccacgcucauuggacagaagccaagaugcuucuggacaacaucaauaccccugagggcauuauccccgcgcuguucgaaccugagagagagaaaagcgccgcuaucgauggggaauaucgccucaagggcgagucucggaaaaccuuuguggaacugaugagacgcggagaccuucccgucuggcuggcccacaagguggcuuccgagggcauuaaauacacagaucggaaguggugcuucgacgggcagagaaacaaucagauccucgaagagaacauggauguugagauuuggaccaaagaaggagagaagaagaaacugcgcccgcgguggcuggacgccagaacauauagcgauccucucgcccuuaaggaauuuaaagacuucgcugcgggccgcaagucuaucgcccuggaucuggugacggagauugggagaguccccucccaccucgcucaucggacccgcaaugcccuggacaaccuugugaugcugcacacaagcgaacauggaggcaaagccuacagacacgcugucgaggagcucccugaaaccauggagacacugcugcuccuuggccugaugauccugcucaccgggggagccaugcuguuucuuaucuccggcaaggggauuggaaagacgucuaucggccugauuugugugaucgcgagcuccgggaugcucuggauggccgaaauuccccugcaguggaucgcuagcgccauuguucuggaguucuuuaugauggugcuccuuaucccugagcccgaaaaacaacggaccccgcaggauaaucagcuggcuuauguggucaucggcauucucacacucgccgcgaucauugccgcuaacgagaugggacugcuugaaaccacaaagcgcgaccugggcaugucuaaagagccugggguugugucccccaccagcuaccucgauguggaccugcaccccgccucugcuuggacgcuguacgccgucgcuacaaccgugaucacaccuaugcucagacauaccauugaaaauagcaccgccaacguuucccuugcggccaucgcuaaccaagccgugguccugaugggacuggacaagggcuggccgaucucuaaaauggaucucggggugccccugcuugcucugggaugcuauagccaggucaauccucucacacugacggccgccgugcugcuccuuauuacccacuacgcgaucauuggccccgggcugcaggcuaaggccacacgggaggcucagaagagaaccgccgccggaaucaugaaaaacccuacaguugacggcauuaugaccaucgaucuggaccccgugaucuaugauuccaaguucgagaaacaacucggccaggucaugcugcuugugcugugugcuguucagcuccugcugaugcgcacgucuugggcccucugcgaagcgcuuacacuggccaccgggccuauuaccacacugugggagggaagcccgggcaaguuuuggaauaccacaaucgcuguguccauggccaacauuuuccgggggagcuaccucgcuggagccggccuggcguuuucuaucaugaaauccgucgggacgggaaagagaggcaccggcagccagggggaaacacuuggagagaaguggaaaaagaaacugaaucaacucucccgcaaggaguucgaccuguauaaaaagucuggcauuaccgagguggaucggacagaggccaaagaagggcugaagagaggagagaucacccaucacgcugugagccggggcuccgccaagcuccagugguuuguugaacgcaacauggucauucccgaggggagagugaucgaccuuggauguggccggggcggguggucuuacuauugcgcuggacugaaaaaggugacggaaguccgcggcuacaccaaagggggaccuggccaugaggagcccguuccuaugagcacauacggguggaauaucgugaagcugauguccggaaaagauguguucuaucugcccccggaaaagugugacacccugcuuugcgauauuggcgagagcucuccuucccccacagucgaagagagcagaaccauccgggugcugaagaugguugagcccuggcucaaaaacaaucaguucuguauuaaggugcugaacccuuacaugcccacagucaucgaacaccuggagcgccuccagagaaaacacggcgggaugcuugugcggaauccucugucucgcaacuccacccaugaaauguauuggauuagcaauggaacgggcaacaucguugccucugugaauauggucagcagacugcuccugaaccgguuuacaaugacccacagacgcccgaccaucgagaaggacguggaucuuggggcuggaacacggcaugugaacgccgaacccgagacgccuaauauggacgucauuggcgagagaaucaaacgcauuaaggaagaacacaacuccaccuggcacuacgacgaugaaaaucccuauaagacaugggcguaccaugggucuuaugagguuaaagccaccggaagcgcuuccagcaugaucaacggcguggugaagcugcucacaaaaccuugggacgucgugcccaugguuacccaaauggccaugacagauaccacgccguucggccagcagcggguguuuaaggaaaaagucgacaccagaacaccucgcuccaugcccgggacccggagagugaugggaauuacagcugaguggcuguggcgcacccugggccggaauaagaagccuagacucugcacgcgcgaggaguucaccaaaaagguucggaccaacgccgccaugggggcgguguuuacagaggaaaaucaaugggauucugcuaaagccgccgucgaggacgaagauuucuggaagcugguggacagagagcgcgagcuucacaaacugggaaaguguggcagcugcguuuacaacaugauggggaaaagagaaaagaagcucggcgaguuuggaaaagcuaagggcucccgggccaucugguacauguggcugggggcucgcuaucuugaguucgaggcccugggauuucucaaugaggaucauugguucucuagagaaaacagcuacuccggcguggagggggaaggacugcccaaacugggcuauauccuccgggacauuucuaagaucccugggggcgcgauguacgccgaugacaccgcuggaugggacacgagaauuaccgaggaugaccugcacaaugaagagaaaaucacacagcagauggaucccgagcaucggcagcuugccaacgcuauuuuuaagcugaccuaucaaaauaaggucgugaaaguccagcgcccgacaccuaccggcacagugauggacaucaucagcagaaaggaucagcggggguccggacagguuggcaccuacgggcucaacacguucacaaauauggaagcccaacugauucgccagauggagggagaaggcgugcuuagcaaagcggaccuggagaacccccaccucucugaaaagaaaaucacccaguggcuggagaccaagggggucgagagacugaagcggauggccauuuccggcgaugacugcguggugaaacccaucgaugaccgcuuugcuaacgcccuccuggcucuuaaugauaugggaaagguuagaaaagacauuccucaguggcaaccgagcaagggcuggcacgauuggcaacaggugcccuucuguucucaucacuuccaugaacugaucaugaaagacgggcggaagcucgucgugccuugccgcccccaggacgagcugauuggacgggcccggaucucccaaggcgcuggguggagccuucgcgaaacagccugucugggaaaggcguaugcccagauguggucucucauguacuuucacagacgggaucugcgccuggcuuccaacgccaucugcagcgccguuccugugcacuggguccccaccuccagaacaacguggagcauucaugcucaccaucaguggaugaccacagaggacaugcucaccguguggaaucgggucuggaucgaagauaacccuuggauggaggacaaaacacccgugaccacgugggagaauguuccguaccugggcaagagagaagaucaauggugugggucucuuauuggccugaccagccgcgccacaugggcgcagaacaucccuaccgcuauucaacaggugcggucccucaucggaaaugaggaguuccuggacuauaugcccucuaugaaaagauuucgcaaggaggaggaaagcgagggcgccaucugguga

SEQ ID NO: 20714 - RNA, 9873 nt, Artificial Sequence
  derived and/or modified CDS sequence (opt5) from DENV-3__FJ390373__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggcagagggaaggcccauaacggacggcugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcccgccggauggcuauccuuggagacacagccugggauuucggcuccguugggggaguccucaacagccugggcaagauggugcaccaaauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaggccgauucccccaagagacuggcgacagccaucgcuggcgccugggagaauggaguguguggcauucgcagcaccacacggauggaaaaccuucucuggaaacaaaucgcuaaugagcugaacuauauccugugggaaaauaacauuaagcucaccgucgugguuggggacacgaucggagugcuggagcagggcaaaagaacccuuacaccucagcccauggagcugaaguacucuuggaaaaccugggggaaggccaagauugucacagccgaaacccagaacuccagcuucaucauugauggaccuaauacacccgagugcccgucugcuucccgcgcguggaacgugugggaaguggaggacuauggcuuuggcgucuucaccacgaauaucuggcucaaacugcgggaaguuuacacacaacugugugaccacagacuuaugagcgccgcugugaaggaugagcgcgccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucggcccggauaccauacccagacggcgggcccuuggcaccuugggaagcuggagcucgacuuuaauuauugcgagggaacaaccguugugauuacagaaaacuguggcaccagaggccccucucugcgcacaaccacggucuccgggaaacugauccacgaguggugcugucggagcugcacccuuccgccucucagauacaugggagaagauggcuguugguaugggauggagauccggcccauuucugaaaaggaggagaauauggugaaaucccugguuagcgcuggaucuggcaagguggacaacuucacaauggggguccugugccucgccauccuguuugaagaggugaugcgcggaaaguucggcaaaaagcauaugauugccggcguuuucuuuaccuucgugcuucugcucagcgggcaaaucacauggagagauauggcucacacccugauuaugaucggauccaaugccagcgaccggaugggcaugggggucacguaccuggcgcuuauugcuacauuuaaaauccagcccuuccuggcccucggauuuuuccugagaaagcucaccucucgcgaaaaccugcuucugggcguggggcucgccauggcuacaacccugcagcugccugaggauaucgaacaaauggccaauggaauugcucuuggccugauggcccucaaacugaccacacaguuugagacguaucagcucuggaccgcgcugaucucccuuacauguagcaacaccauuuucacacugaccguggccuggcggacggcuacacucauccuggccggcgucucccugcuuccgguuugccagucuagcuccaugagaaagaccgacuggcugcccaugaccguggcugccaugggggugccuccccucccucuguuuauuuucucucucaaggauacacugaaacgcagaagcuggccccuuaaugagggagucauggccgugggccugguuuccauccuggcuucuagccuccugcggaacgacgugccuauggcggggccccuugucgccggaggccugcucaucgcuuguuacgugauuaccgggacauccgccgaucugacgguugaaaaggccgcugacgugaccugggaggaagaggccgaacaaacaggagucagccauaaccucaugaucaccguggacgaugacggcacaaugcgcauuaaagaugacgagaccgagaauauccugacgguccuucugaagaccgcgcugcucauugugucuggcaucuuuccguacuccaucccugcuacacugcuuguuuggcacaccuggcagaaacagacacagagaagcggggugcugugggauguccccucuccucccgaaacccaaaaggccgagcucgaagagggaguguaucggauuaaacagcagggcaucuucgggaagacacagguuggagugggcguccaaaaggaggggguguuucauacgauguggcacgugacccgcggagccguucugacauacaacggcaaaagacucgaaccgaauugggcuuccgucaagaaagaccugauuagcuauggcgggggauggcggcuuucugcccaguggcagaagggcgaggaagugcaagugaucgcggucgagccugggaaaaaccccaagaauuuccagaccaugccuggaaccuuccagacaacgaccggcgaaauuggggcuaucgcccuggauuuuaagcccggaacauccggcagccccauuaucaaccgcgagggcaaagugguugggcuguacggaaauggcguggucaccaagaacgggggauauguguccggcaucgcccagacaaaugcugagccugacgggccgacccccgaacucgaggaagagauguucaaaaagagaaaccugacgauuauggaucuucacccuggcagcggaaaaacacggaaguaccugcccgccaucguucgcgaagcuauuaagagacggcucagaacccugauccucgccccuacccgcguggucgcggccgagauggaggaagcucugaaaggccuucccauucgguaucaaacaaccgccacaaagucugagcauaccgggagagaaaucguggaccugaugugccacgcuacguuuacaaugcgccugcucagcccuguucgggugccgaauuacaaccugaucauuauggaugaggcccauuucaccgaccccgccuccaucgcugcgagaggauacauuucuacacgcgucggcaugggggaagccgcugccaucuuuaugaccgccacgccucccggaaccgcugaugccuucccucagagcaaugcgcccauucaggacgaggagcgggacaucccggaaagauccuggaacucuggcaaugaguggaucacagauuuugcugggaaaaccgugugguucgugccuagcauuaaggccggcaacgacaucgccaacugucuucgcaaaaauggaaagaaggucauucagcugucccggaaaacauuugauaccgaauaucaaaagacaaaacucaacgacugggauuucguugugaccacggacaucucugagaugggcgcuaauuuuaaggccgauagagugauugacccccggcgcugccugaaacccgucauccugacagaugggccugagagagugauucucgcgggacccaugccuguuaccgccgcuagcgccgcucagcggcgcggcagaguggggcggaacccgcagaaggaaaaugaccaguacaucuucaccggacaaccccuuaacaaugaugaggaccacgcccauuggacagaagcuaagaugcugcuggacaacaucaauaccccugagggcauuauccccgcccucuucgaaccugagagagagaaauccgcggccauugauggggaauaucgccugaagggcgagagccggaaaacauuugucgaacuuaugagacgcggagcucugcccguguggcucgcccacaagguugcuucugagggcaucaaauacacggaccggaaguggugcuucgaugggcagagaaacaaucagauucuggaagagaacauggacguggagaucuggaccaaagaaggagagaagaagaaacugcgcccgcgguggcucgaugccagaacauauuccgacccucuugcccugaaggaauuuaaagauuucgcugcgggccgcaagagcaucgcccuggaccucgucaccgagauugggagagugcccucucaccuggcucaucggacacgcaaugcccuugauaaccuggucaugcuccacaccuccgaacauggaggcaaagccuacagacacgcuguggaggagcugccugaaacgauggagacccugcuccuucugggccugaugauccuccugacagggggagccaugcuuuuucugauuagcggcaaggggaucggaaagaccuccauuggccucaucuguguuaucgcgucuagcgggaugcuguggauggccgaaauuccccugcaguggaucgcuuccgccauugugcucgaguucuuuaugauggugcuucugaucccugagcccgaaaaacaacggacaccgcaggacaaucagcuggcuuaugucguuauuggaauccucacccuggccgcgauuaucgccgcuaacgagaugggccuucuggaaacgacaaagcgcgaucucggcaugagcaaagagccugggguggugucucccaccuccuaccuggacgucgaucugcaccccgccagcgcuuggacacucuacgccguggcuaccaccguuaucacaccuaugcuuagacauacgauugaaaauucuaccgccaacgugagccuggcggccaucgcuaaccaagccgucgugcugaugggacucgacaagggcuggccgauuuccaaaauggaccugggggucccccuucuggcucucggaugcuauucucaggugaauccucugacacugaccgccgccguucuccuucugaucacacacuacgcgauuaucggccccgggcugcaggcuaaggccacccgggaggcucagaagagaacggccgccggaaucaugaaaaacccuacaguggauggcauuaugaccaucgaccucgaucccgucauuuaugacagcaaguucgagaaacaacugggccaggugaugcuucugguucucugugcugugcagcugcugcucaugcgcaccuccugggcccuuugcgaagcgcugacacuggccaccgggccuaucacaacgcucugggagggaucuccgggcaaguuuuggaauaccacaauugcugucagcauggccaacaucuuccggggguccuaccuggcuggagccggccuugcguuuagcaucaugaaaucuguggggaccggaaagagaggcacaggcucccagggggaaacccugggagagaaguggaaaaagaaacucaaucaacugagccgcaaggaauucgaucuguauaaaaaguccggcauuacggagguggaccggaccgaggccaaagaagggcucaagagaggagagaucacacaucacgcuguuucucggggcagcgccaagcuucagugguuugucgaacgcaacauggugauucccgaggggagagugaucgaucugggauguggccggggcgggugguccuacuauugcgcuggacugaaaaaggucaccgaaguucgcggcuacacaaaagggggaccuggccaugaggagcccgugccuaugucuaccuacggguggaauauugugaagcucaugagcggaaaagacgucuucuaucugcccccggaaaagugugauacacuucugugcgacaucggcgaguccagcccuucucccaccguggaagaguccagaacgauucggguucucaagaugguggagcccuggcugaaaaacaaucaguucuguaucaagguccugaacccuuacaugcccacagugaucgaacaccucgagcgccuucagagaaaacacggcgggaugcugguucggaauccucugagccgcaacucuacccaugaaauguauuggauuuccaauggaaccggcaacaucguggccagcgucaauauggugucuagacuccugcuuaaccgguuuacaaugacgcacagacgcccgaccauugagaaggauguggaccugggggcuggaacacggcaugucaacgccgaacccgagaccccuaauauggauguuaucggcgagagaauuaaacgcaucaaggaagagcacaacagcacauggcacuacgacgacgaaaaucccuauaagaccugggcguaccauggguccuaugaggugaaagccacaggaucugcuagcuccaugaucaacggcguggucaagcuccugaccaaaccuugggaugugguucccauggugacgcaaauggccaugaccgacacaaccccguucggccagcagcgggucuuuaaggaaaaaguggauacaagaaccccucgcagcaugcccgggacgcggagaguuaugggaauuacagcugaguggcuguggcgcacccucggccggaauaagaagccuagacugugcacacgcgaggaauucaccaaaaaggugcggacgaacgccgccaugggggcggucuuuaccgaggaaaaucaaugggacuccgcuaaagccgccguggaggaugaagacuucuggaagcuuguugauagagagcgcgagcugcacaaacucggaaaguguggcucuugcguguacaacaugauggggaaaagagaaaagaagcugggcgaguuuggaaaagcuaagggcagccgggccaucugguacauguggcuuggggcucgcuaucuggaauucgaggcccucggauuucugaaugaggaccauugguucuccagagaaaacucuuacagcggcgucgagggggaaggacugcacaaacucggcuauauucugcgggauaucuccaagauucccgggggcgcgauguacgccgacgauacagcuggaugggacaccagaaucacagaggacgaucuucauaaugaagagaaaaucacccagcagauggacccugagcaccggcagcuggccaacgcuauuuuuaagcucacauaucaaaauaagguggucaaagugcagcgccccaccccgacgggcacaguuauggauaucauuucuagaaaggaccagcgggggagcggacaggugggcaccuacgggcugaacaccuucacaaauauggaagcccaacuuauccgccagauggagggagaaggcguccuguccaaagcggaucucgagaacccucaccugcccgaaaagaaaauuacccaguggcuggagacaaaggggguggagagacucaagcggauggccaucagcggcgacgauugcgugguuaaacccaucgacgaucgcuuugcuaacgcccugcuugcucugaaugacaugggaaaggugagaaaagauauuccucaguggcaaccgucuaagggcuggcaugacuggcagcagguccccuucuguucccaccauuuccacgaacucaucaugaaagaugggcggaagcuggugguuccuugccgcccccaggacgagcuuauuggaagagcccggaucagccaaggcgcuggguggucucugcgcgaaacggccugucucggaaaggcguaugcccagauguggucccugauguacuuucacagacgggaccugcgccucgcuagcaacgccauuugcucugccgugccuguccauugggugcccaccuccagaacaaccuggagcauccacgcucaucaccaguggaugacaaccgaggauaugcugacggucuggaaucggguguggauugaagacaacccuuggauggaggauaaaacccccguuacaaccugggagaaugugccguaccuuggcaagagagaagaccaauggugugggucccugaucggccucacaagccgcgccaccugggcgcagaacaucccuacggcuauucagcagguccggucucugaucggaaaugaggaauuccuugauuauaugcccagcaugaaaagauuucgcaaggaggaggaauccgagggcgccauuugguga
